United States Patent 7,745,391 (HUMAN THROMBOSPONDIN POLYPEPTIDE) - sequence listing, part 252

SEQ ID NO: 716899 - DNA, 1374 bp, Homo sapiens
ttttttattttgtcacaaatcatttaatcttaaaaaatcctgggagtaattaaaagaatatgtgaaaaaaaaaagttcaaagtggtgttcccctttatgtgggtgtgagtgccaccagtgagtggccctcacacaagccagtgactcaatcgccagcgaaaagcacgtggagtgccaaagagttagtggcgtggcaaaagggcactcgagggcgcccacgagtccgcgaaagaagttgtggggtatcacgggagcctcgtggcacagcgggttacacagaagcggcaagcaaacaagaaccatcagttaagagggaacccctcagagaggacaccagggccgcgcggagggcggaggctcaagtacaagcacccttgggaaaaggcggttatcgtgtgggagtgaggtgacactctcagggtgtctcgacagaaagactaatgtggggtccaatccgctggcggacataacacccgtgaaccctaggacagttgggctgtgaacaccagatctctttgttgtggtccccatactgcgcgggactccacaaatttaccatacacaaggcggtataaacagaccgcgcgaaacaccatccgcgtgggcacgcggtgaggagggcacacaccccgcgggcgcggaaaacaaaccgatgcacagcgcgctatagataagaggccacacggggggagcccccaaaatcggcgggcgcatagcatacccataagaaactccggccgcatgagcgcgcccggcaccaaagagagaataatcgccactcggggggggtgccccccaaaagctataatagcgcccggaacacccgccagaggaatctccctgggggtaccacaggggggggtaccccgaaataagagcgacgacccagaaataaaaaaacgcatagggccactgggggaccgcgcgcgattaacaccacgtcccgcgccacgtggggcacacctctgccaaccctaggggacaaccgtcgggcgacaaggaacccttacctaccgggccgccgtcgccccccaacttgggccccacaccaccaaagcacagaatacaccgcgccccacgagcacccactacaaccttcacaaccgcctcccccgtgccaccccacccgccccacccacacagctgaccaacttggcccaagggaaacaacccaacaccccttacccacgcagcagccacacaaccaccccccaccgccaccccccgccaccgcaagagcacccaacccacgaacaacaacacccaagcccagcacccaacgacacaacacacacaaacgcacccaccgaccagacccaccagacccgacacccacacccccgaacaaacagaagcaccaggcagagaccccag

SEQ ID NO: 716900 - DNA, 346 bp, Homo sapiens
ccaaatcccatagatggggtgaagctggggtggggagggtctgctctttgaattacttgatggttctgactccaaggctgctgttgcccacttatgtgtgagggggacactgtcactgcatgacctgtgatgctgcatacaccaccattctgtgtgcgggtgtgtgttggggggcacgtaggtacatgttccatgtcctgttgcatccttctccctgtgacccatgttctctgttggggggaagcaaagacaactggacacaattcactggatgctagtggactttttctctacccaatttttccattactggctgttccctgcccgcgaaccacctgtgtttgtt

SEQ ID NO: 716901 - DNA, 333 bp, Homo sapiens
tataaaaaccatcttaactattgcttacatcttaagtactattagttttattcggggcagcagactgggatattggtgttacttctttgaagttaccttctgtttctatatgctgtctactacactaaaacatgttacccaggaataaagtggctaattccataagtggcttattacctgtgacacctattgactgagcctggtacgacatcgatgacattacagacattctatgtgaagttgaaataatctcctattattttacattatttatttattctttacatatgacactaatctggatatgtatgcttggaatgctgttgtatctcg

SEQ ID NO: 716902 - DNA, 194 bp, Homo sapiens
gagctgataaccaggaatacaaactcctgctgcatgtgaatacgccactgcagcagaagactggccatactaacggtgcgactgctggatggagaggatgaccacctgattcagttcataaaagaaccggtgtatcacccgtcaggtgcgtaccattgtggaagaggtccaggatggcaaggtcatctcctccc

SEQ ID NO: 716903 - DNA, 380 bp, Homo sapiens
ggcacgaggtgaggcactcaaactgccgaggagccgcctcccgagagacatttaatccgggggatttgcagttaacttctaaattaaggatagcccttctgcagctgaggggggcacgccggtccctgcgcccggcagctgccgtgagtcacgccccgaaatacgccgagggcctccttccgcagctgccactgggtccggctgtcactcagaggaagcacggagcccccagccaaagggtcccctccccttcgcatcgccggggtttttccagccgaccatgggccattttttcctccgacggctggcagggaagagggggacgggggcgggacccaagggaggcggtacccatgtgggtgggcgaagggggcggccgc

SEQ ID NO: 716904 - DNA, 121 bp, Homo sapiens
tcagctcgtacccacttacacgttggcagtggggacacggaaggcatgcagagcttccctgttcagctcagtgatgacttgcccacagccttgtgcagcgacagctgaggctgcggggcat

SEQ ID NO: 716905 - DNA, 727 bp, Homo sapiens
ggtgagggctccctgtgccctacaccagccccactaagcagtgaaggaaccctctgtccttccccagccaggaggagcagagctgtgggctgtgtaggggctccagccagtgcccactcctgtctgctctgccagtgtggaaggagtggaccacggtgaactcacagcattgaagaacgtttctgaacttgtgctcctcaaagccagcagccagaaggtcatttggggtctgcctagtacgcgttctttgaaccctacacgagggggcacagacctgacgtgtttacagtgcaatacacagcgagcagtgctgtgatatggcaatctgtgcgtcaccctctcagacgccactgcgccacacacaacgctcatactactagtccaggccgcagaacctcccgcccctgaccccaaaacacaggcacatgcagcgtgcacatctacacacctgggcctgacgggccctggtggctgagctgcacttgtgtgtgtgtgcactggtggaaagagcgatcacgacagagggcgtgcagtgacttacgacatctttagcgaagtcacctactccagagaccctcatgaagggacagcactgacatcagtccatgataataatgacatcctgaaaccacagcaatcggcagacaacacaacatcaggactcccgaaagcccaaagacggacagtaagcatatggacagcaccacaataaactttagagaaccac

SEQ ID NO: 716906 - DNA, 102 bp, Homo sapiens
gtctattcatataatataaggcgaattatagagtgtgacgaaactctgatacagagccaactttgagcatgcattaaaatttacaaaagggcgggctttaat

SEQ ID NO: 716907 - DNA, 225 bp, Homo sapiens
aagatcatgttttcctctatcaatacttcatcaaggctattaagtgtgactgctctgtaattgtaaacccctgttttctttctccctctacttatgttctcctgagcaaattctttatctgaaaactgtttcttcttaatatgtaaataaatataatcattatacatacttcctatcagtatttcgaagaaaagaaggtgatgtttgccaagtgctttccgttgc

SEQ ID NO: 716908 - DNA, 1120 bp, Homo sapiens
aaccacaaagacattggaacactatacctattattcggcgcatgagctggagtcctaggccacagctctaagcctccattattcgagccgagcatgggccaggccaggcaacctatctaggtaacgaccacatctacaacgttatcgtcacagcccatgcagtttgtaataatcttcttcatagtaataccccatcatcaatcggcaggctataggccaactgcactcagtatcccctcaataatcggtgcccccgatcatggcgtttccccgcgataaaccaacataagcttcatgactcttacttcgccatctctcctactcctgcatcgcatactgcatatagatggaggccggagcaggaacaggtagaacagatctaacacctcaccttagcagggaactacgtccacaccctggcagccatccggtagaccgtaagccagtcttcgtccattacacgctaagccaggtgatctccatcctatcttcaggggaccatcaagtttacagtcaacaacaatgtatcacactagtaaaagacccgctggccataaacccacatacccacaacgccgcctctatcgtcatgatcacgtagctcaatcgagcagacgtcactacatatctgcgcatatcgtctcgccgagtcctaagcctgctgggcactcgctaatagtcactaagcagatcggcaatacatcaacagcgaacattctatcgaccaccgccgggacggaggagcacccacagtgtctactcacaagcacataatcctgcatataaatcgggttcaccctgaaagtctactatcttatcctaccacgggctcggaccatacctaccaacatgacaaccacaccatacggacaaacacagcaccccctgccaccctacgacgaaccgacccagaaccacaaccgggaacacacggataaccagaaaaccacacaagattacacgaagcaaacgacgccaacagagagataaacacacgcacaaaaaaaccgacaacacccgaagcaacataccacaaacacaaccaccagaaaaacacgaagcaacacaaccgaacaaaaagcacacgcagcaaagacaccagagtacaaaacaaaaacaa

SEQ ID NO: 716909 - DNA, 960 bp, Homo sapiens
tctttccagaataggggtttgtcaaaagcattcccccctttttgatcggtgtcactcgtcccactaatcttgggccactatcacatttgtcgttatagcattccaagtgatttcctcgcaacctctttcccgccatgtggcccataaaccgatatgggttccatcggcaatcgtcacaacgtacccctacgtgcgaatactttgaccccgggccaatgtgcatcgatacaccgccgccaagacgtgatgccactaaagacccgcgtgtagaaagtcaaaactggtccaataaggcctacctgggttcggcactgccgtctgggctactggaaacggccctaggtcccctttttgctaccctggcggataagacacaggacgtaatctatcactgctagcgtatacgaattgctaggaccagcgccatagcttgaagttgcttcgagcttccatctactcgctagccatttacagcatctatttaggtagaggcctttttccactacttggtcagttgtggagtaggtacaaccatttcttgcacaattgctttgtctccctcgcttgtacgcatgcatacgtcgagtagtcgacatcaatggatgcaatgacaactccccccttcattgcttcgctataccaatagagcagtatactattagactgtcagttagtctcaactcatcgaatgccatgtggcgtttgtgtatgtctctgctgcttggttttggcctcctcgttctatgccttcttatgttgtcgacaatggtagacatgtatgagatatttaaagttcacatggtaattttgttccggtatcagcagtaagcaaaaattagcaaagagatagtctaaatggcctctcagcttggtatgtgaaaatgagttgacatacctttctataagtccaaatacaaaagcatagtctctggaagattgtgttcatgtgcatttctgata

SEQ ID NO: 716910 - DNA, 143 bp, Homo sapiens
caggcttaggagcctagcttggtcatgaagttggttgcttccactgtgcgatgcactcctcagaaattttgaagtcagcctgcaacttctcgaagactttcttcttgggcttgagctcctcgagtctggttggcccttttcat

SEQ ID NO: 716911 - DNA, 906 bp, Homo sapiens
tgtaggcaccggtccgaggtgcctgccctctgtccccgcggctgggtctcgatctgctccggttcctgggctcctaattcttggtccagacttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggacagatggaaccatgaagaacagccacaagacgagagaaagccagaagtaacttgtactctggaagacaagaacgttcgacaacgagggaacgacagaaaacaagggcaaaacaggagatgaggacatgttaaccggctagccggacaagccacgacgagtgagggacgaggcacaaagacggaaagtcagcagagggagggagagtcagagatggcagggaggatcagagagcagagggaaaaccagagcatagcagggcacagccagagagtgcacagggagagccagggacgtgaaaccacagggctgccaggaacgcgcccaggctgacggatgcatgctacccagggacaaagccaaacagaaacacactcacatacaggggctggcctccataacctcaacgcaggcactacaagagggccacacgctcgacactgacacgttaccgccaacagacggggacagggacacagacaacctgcgaccaacaatgcactccgggtcgccggcatgcccacgacacaagacgcacagcacgaccactagccgccccctcccaggaggcaagccacaaaaacatacacaggacacccctataacccccaaagggacccacgcaaaacaacggcagacacaccgacccccagaaaaggc

SEQ ID NO: 716912 - DNA, 125 bp, Homo sapiens
  misc_feature (13)..(13): n is a, c, g, or t
  misc_feature (26)..(26): n is a, c, g, or t
  misc_feature (29)..(29): n is a, c, g, or t
cttatggccgganccgcggccgcaanaanaatattcccccccccccccccgctttgtggttttcaggaagagctaaatatggctgaatttctagatgaccaggaaactcgactgtgtgacaactg

SEQ ID NO: 716913 - DNA, 874 bp, Homo sapiens
  misc_feature (325)..(325): n is a, c, g, or t
  misc_feature (358)..(358): n is a, c, g, or t
gacagagacccttgaagatttgtactcaaaccacacaaaatctcaaatcctcgagttgagagattatttcaggtgtctgctgcacgagtagctttacaatccccgggagcgtcttacccccaattacatgcgagacagtatgaggaatatcgctgatatccgtcccgtgtgaggtgactacatcgagaagtcaagattcctctctctaaaataaagaccctttttcctctgattgacgccaagaaaaaggatcaagtgactgtcaggaaattttccaagacaaccatgaagatggacctacagctaaaaaattaaagactgagcnagggggagcccacttcagcgtctccagtctggntgaaggcagtgtcacctctgttggaagtgtgaatcctgctgaaaacttccgtgttctagtgaaaccagacagaaggccagctttgaggaagcgagtaaccagctcataaatcacatcgaacagttttctggatactaatgaaacaccgtattttatgaagagcatagactgatccgagcttccgggagaagccattagtttcagaagagcaggttaacaattctgaaagccttcagagaaagtggacataacactaatcattctggaaatgtgtcccggatggaatatctgatcacaaagaggaggctccggaattctgtagaagtgggagccaaaaggttctggcccaagacaaccgttggacaggacgtgcttgcaaaggggggggccaattgcacaaaagcggggttggggcaaaaaagcccggggcgagctcaacacaggggcccagggcaaaaaccacccgggcgcattggcacattagatcccacacagactggtcggcaaaacacaaca

SEQ ID NO: 716914 - DNA, 641 bp, Homo sapiens
  misc_feature (585)..(585): n is a, c, g, or t
cctaatcctaactacctgattcctacccttaacaatcatggcaggccaacgccatttatccagggaaccactatcacgaaaaaaactttacctttctatcctaatctccttacaaatctccttaattataccattcacagccccagacctaatcatatttaatatcttcttcgaaaccacacttatcccaaccttggttatcataacccgatggggcaaccagccagaacgcctgaacgcaggcacatacttcctattttacaccctagtaggttcctttcccctactaatggaactaatttacactaacaacaccttaggttcactaaacattctactactaactttaactgcccaggacctatcaaactcctgagccaacaacttaatatgactggcttacacattagctttaatggtaaagatacctctttacggactccacttatgactccttaaagcccatgtcgaagcccccatggttgggtcaatagtacttgccgaagtactcttctaggcggctatggaataatacgcttaacactcattctaaaccccttgacaaaccacatagcctaccccttnccttgactatccctatgaggcatattattcaggttccatctgccttacgccggctt

SEQ ID NO: 716915 - DNA, 409 bp, Homo sapiens
ccctgtctccacaagaaagctgtaacctgtaacagagttgtaatttaaagcttctacaacagtatgctatttactataaattgtaatgtgggatacttaaaaaaaattttttttcaagatacattaagttctgaaagattagaaacaaagggttaagaaaagatatctaaacacacacacacaaaaaagaaagtagatttagttatagcatataaagcagaaaaaacaaaaacattagttatggtaaatacagttttatttgctagtcagttacagcatgttttagaactacacaaaacagcctagtgtggaggccatgtcttaatcacaacacttccattactctggagtcagaggcgagatgatttctctcagttctaggactaccagaggtacatagagaaaattc

SEQ ID NO: 716916 - DNA, 433 bp, Homo sapiens
  misc_feature (36)..(36): n is a, c, g, or t
  misc_feature (41)..(41): n is a, c, g, or t
  misc_feature (86)..(86): n is a, c, g, or t
  misc_feature (148)..(148): n is a, c, g, or t
  misc_feature (421)..(421): n is a, c, g, or t
  misc_feature (423)..(423): n is a, c, g, or t
cccaccaagcccccctccaggagtaccctcctgggnccctnccccccggaaatcccacctcagtcagcaatgatttaggggggccnccccatggcacagcacccatggtaaagcccatgtggattaaagggaattcctactcctgagnccctaattcctaacaaatttacatcctacagacagtccctagaccttataatgattcaacctaaatgattcccttgactttatgatggtgtgaaacttcccaattttaacacaatgtacagtattcaataaacatgagatattccctactttattataaagtaggctttgtgttagatgattttgcccattgtaggttaatgtaagtgctctgagcatgtgtacggtaggcgaggctaagctacagaggtttggtaagttgggtgaattaaangnattttcaact

SEQ ID NO: 716917 - DNA, 486 bp, Homo sapiens
ttcggccagaggggcggcggtcaccagcagcctggagatgtcagcgctctgagggcccacccgaggggttaaagctgccagcacagaacttaacgatggagccagctctgcattatccgaggtcacagggcctggggagatcgagaagtgatatcccagctcacgtctatctcacctcgtcccatcaagccttacttgactctacaagtgaccggattatgggctctctccagtggggctcctggtccttgagacaaatctcatgcaggcctgcaagtgggtgaaagatggaacccgctgctgagtgcaccacttcaagtgaccaccaggaagtgccgtcacaccactgtgtatttaactgccatgggtacaattatttatgcctctgtttaaaaaacgaacaccctagtctgttcctaatggccccttgggtcttctctgtatgattccctgatggagatatttacatgagttgaattttacttt

SEQ ID NO: 716918 - DNA, 137 bp, Homo sapiens
gcttttccctagcttttccagaaggcctgttaaaagcaaggtcttccacaagcaacttctctgccacattggcaccccgtgccttttgatctagcacagagcccttcacccctcacctctgatgcagccagtagctt

SEQ ID NO: 716919 - DNA, 390 bp, Homo sapiens
  misc_feature (21)..(21): n is a, c, g, or t
  misc_feature (38)..(38): n is a, c, g, or t
  misc_feature (92)..(92): n is a, c, g, or t
  misc_feature (99)..(99): n is a, c, g, or t
  misc_feature (109)..(109): n is a, c, g, or t
  misc_feature (113)..(113): n is a, c, g, or t
  misc_feature (128)..(128): n is a, c, g, or t
  misc_feature (134)..(134): n is a, c, g, or t
  misc_feature (145)..(145): n is a, c, g, or t
  misc_feature (158)..(158): n is a, c, g, or t
  misc_feature (182)..(182): n is a, c, g, or t
  misc_feature (195)..(195): n is a, c, g, or t
  misc_feature (240)..(240): n is a, c, g, or t
  misc_feature (255)..(255): n is a, c, g, or t
  misc_feature (286)..(286): n is a, c, g, or t
  misc_feature (342)..(342): n is a, c, g, or t
aatgtgatggctggaattccngtcccccttttggcccntgaggccacccccctaaaaatgtggagtggctaaaaaaagcctgtgttcctganaacttanaggccccggncctntattccaggcttggncccccncctttagactnttatatgaggaanccatcaacttttcccttgtttcancccctttcccttncagtcaaacctgaattgtaagggaaattgctttcctgaaagcaancctgttggatttttnccagaatccctgggccccttttaccagtcanatttgtttaatccccctttaaaaatgggggcagtgaaactgggccatgggccccgnctgggctttgtttgcccctttttgataatttataattttttccaaata

SEQ ID NO: 716920 - DNA, 488 bp, Homo sapiens
  misc_feature (154)..(154): n is a, c, g, or t
  misc_feature (249)..(249): n is a, c, g, or t
  misc_feature (358)..(358): n is a, c, g, or t
  misc_feature (393)..(394): n is a, c, g, or t
  misc_feature (470)..(470): n is a, c, g, or t
taatttttaatttaaagagacaaggtctcactccctgtcatccaggtgggagtgcaggggtgctttcacagctcacggcagcctcaaacttcgtgggcctcaaggtgattcctccgtggcctcaggcctccgtgagaaggcgtgggcaccacanggcagtgttggcccagttatcacccaagttaacttcttttctcgtgtttatcttttgtgcacagaagttctcaactcgtgttgtgggccgtgggntggagagtgtgacaggtggtcaacaatctcttgtgggtctccacgagacaagccttctacacccttccgcgggttctccaaggcagaattcctcgcgtggccttacagncctctccgtgaaaatattctgtgggaacatcacgnngggcgcccacacacacacagcgcccacagacataatatttgtgtggatatttttatagatagaacaagcggggggntcttcgagccgagagatg

SEQ ID NO: 716921 - DNA, 488 bp, Homo sapiens
tcggagcaagcggggaaccagcgggaaagtcatcagggcccagggacatgagcacctcgggccatggctctagggccaggtgacctcccatctcagaactttctcggcttccggggggatgtgtggaagaagggcctctgggccctacagcggttcagctccaaccccacagccagcggtgctgagtccttacccgtgcttcggaccccggtgatataactcacatcccatacgattcccctccctccgggagcacgggatatgggcttctcgcggcccggtcggaggcctacatctcatccggtgccttcagccgggaggtcgtgccctcctccagggctcagattccccggacacggatctctcggtgcccatctccttccttccccttccttcttcggtgtgttttctttcttttaaaccagccgggccaaaagggtgaaactctgtctctactaaaaaatacaaaaattagctgggtgcagtgg

SEQ ID NO: 716922 - DNA, 245 bp, Homo sapiens
atccgcggttaccatctgtgctcctgaaatcaaagagtaattcactcctccagtcgagcatggcagatcaatctataatcccagtgcttttggaggccaaagctggagcatcgcttgagaccaggagttcaagaccagcctgggcaacatagtaagaccttgtcttctacgaaaaataagatattagccaggtgtggtggctcatgcctgtggtcccagctacttgggaggcacagattgcacgt

SEQ ID NO: 716923 - DNA, 151 bp, Homo sapiens
gctgacatggaagctgtggcaggatgcgaagccctcaatggacagtccgacttcccctacctgaggcgctttcccctatcaacccagtgcctcattcattcatgaccccgagaagtgtgtgttccgtggcctgagatgctgctgctgcaca

SEQ ID NO: 716924 - DNA, 1113 bp, Homo sapiens
  misc_feature (1113)..(1113): n is a, c, g, or t
ggagagagaactattctcgagttcttttttctttttttttaacgaacaaaaggctttttaactatgaacaactatgtattggggcaccaaaaatgcaaccacacgagtaagaaacaccatattctactcaatttagtgatatctcgtgtaatctaagaacaccaccagaaaagtttggttattaggcacaagtgccaagagaggaaaaagaaactcgtggtaaaagtcctattcgaatatatcactgtgtggtatgacggagaaagaggagtgtttatatttgtggctttatgtggtcaaacagttctccactcaagtgtgtcttacactctttctgtgaatacagtctctcaagacttctcaaagtgcgttactctagtattcactgcgctttgcggctatctctctacacatatctatcaccatctgtagagagcccaaagagagacagcgcgtatatggcggccctatataagacgtctctaacaaatagagggaaacctaccccctatatatatgtctcctctctcacaacaagagggataatccagcacagctgcgcgtagagcgctctttaatatctcttgggcgccacgagaagtttttccccttcccgtggactagtagaggacgggcctctcacatcttcaagaagagcatcgtagatagtagagaacacaacacgagcagaagacaaaacagagctaatacaccagtggcggcccctgtcttgggcagcgttgcacacacacgttagtggctatcaaccctcgctttggagcaagcaccccctgtggaaaattatccccccacacaaaatgccgtcgaaacaattctaacgccgtaccgttgtgcaacctgttgtggagccgtagtagtataagacaacaaaacgtcattcaccgagatgaaattcctcactgtggaacaaccacaagacggacaatattgtaatctcacaacaactcatttagtgggggagccccgccctacttataccgtgggtatcagagagcacactaaggcaaagtggtcgcaacaacacttccagtagagacactattccatccgctttggggacacaacaattagccccatccgtggagctgatan

SEQ ID NO: 716925 - DNA, 274 bp, Homo sapiens
cggatcccttctcatttcagttctagggctcggcacacagatccactttttcctcctgcgataccaggcttgcaatgggaggaacttccacaaaagtctctgacatgccctggagacattttcttcatagtcttgagtgattaaccatttggctccttgttacttatggaaatttctgcagtgggcttgaatttctcctcagaaaatgggattttcttttctattgcattgtcaggctgccaattttccaaacttttttgctgttttccttttg

SEQ ID NO: 716926 - DNA, 100 bp, Homo sapiens
gccgctttttttttacagtttgaaacagccctttatctcagaatatgcacagagcacagtgagctactgagctctctcttctctctctgatcaggaacgt

SEQ ID NO: 716927 - DNA, 102 bp, Homo sapiens
  misc_feature (35)..(35): n is a, c, g, or t
  misc_feature (69)..(69): n is a, c, g, or t
tgtttttttgaaggttacagggaagactaaacatntatttagaagttacagtgtttgtttttacagagntatgttgccacggattattgattctggaaggtt

SEQ ID NO: 716928 - DNA, 1245 bp, Homo sapiens
  misc_feature (1008)..(1008): n is a, c, g, or t
gggccggacactctatgagggctgctggagacctcgcgtcgtgttggcagacatccgctggaccgtcaggaacgttattgtttggcgcctgggttcattgacggctcttgcttctctctttaccttattccagctctaaggccagctgactgccggcatgtacccaagacctgtgagcaagggatgttcagcccgacgcttgccggagaaagcttaaccctcgcttgaccccttattgaacggcacgtgttggttctcaaccttactacggcaatcctgaatgggcgcaccttggtggttgttaacacatgataaaccacgcattggactttcacgttataacgaaccatgttgttcctcgtgctaccaaacgtgtgggctccaagggccattgccacgtttcgacaggtgggcacaatttgaccttcacttgggactccacgtgggcaaattcttatcgtgaacaccttccacttgggagcgctcttcaaagcgccagggattcccctacatttggtgcattccaagaccctttccacgttgaacatttatgacaggaagacatctacaccaggatcgctctctggggctggctacctacaacgcaccatggcactccaaatgttcttacaaaggtcacttgttcccgcggacacacgtgactttggtgactaaacaactttttccacaatctaggtctccacacgccatacaatttggccggcaacttttacaatgtggatataggccgcaaaaggggcacaaggtccccccgggccacatatggtgttaacacccaaagttggcaagacaactttggcccggcgttgaccacgtgttgggtttgtcttggcaaaccattgtggcacacagcaaccctttgtggggttctgagtgtcggattcaccttataacagggatcacaccctgtttacgtcacagtttcaccttcagtgtatgagtggccacacgctgtaaacgtcactgcacacaacgctgtttggtttncgtcgtggcgcacacctaggacccacaagtggctcaccgcttatgcaagtcttgtatcacacccctaacacaagttggtgggcagtctgtggtttccacagtaaaaaccgtcattacaagcacacgggctcccacatctagaccgtgtgtcacacgattctttcgcctatctttctagaacgcttaaccaccttattagcgaccagccacgccattactagtgagacatttgtgcca

SEQ ID NO: 716929 - DNA, 124 bp, Homo sapiens
atggaacaaaacgaccagcaatgttagatattgaagccgacggaaataaaacaatgattgagctcagtgattatgaaaactctgggacaatattcctggataaagttgatcccgagctggctgc

SEQ ID NO: 716930 - DNA, 234 bp, Homo sapiens
  misc_feature (55)..(55): n is a, c, g, or t
  misc_feature (123)..(123): n is a, c, g, or t
  misc_feature (154)..(154): n is a, c, g, or t
  misc_feature (188)..(188): n is a, c, g, or t
  misc_feature (199)..(199): n is a, c, g, or t
ccactgctgctgtgtccttccaaagaagaattagccgtctcctcaaacaggaaangctgattttaatggtggggcccaattgatgactgagtctgcctggctggcctgaatggaagtcattgntatccatggaagaagccatgtcttctcaggngttttccaccattttgtgaagaaagtacgtcgangcggcccgaanttttaggtagttagttaagcgggccgctccttaga

SEQ ID NO: 716931 - DNA, 721 bp, Homo sapiens
  misc_feature (66)..(66): n is a, c, g, or t
  misc_feature (92)..(92): n is a, c, g, or t
  misc_feature (96)..(96): n is a, c, g, or t
  misc_feature (99)..(99): n is a, c, g, or t
  misc_feature (114)..(114): n is a, c, g, or t
  misc_feature (117)..(117): n is a, c, g, or t
  misc_feature (122)..(122): n is a, c, g, or t
  misc_feature (126)..(126): n is a, c, g, or t
  misc_feature (141)..(141): n is a, c, g, or t
  misc_feature (144)..(144): n is a, c, g, or t
  misc_feature (146)..(146): n is a, c, g, or t
  misc_feature (152)..(153): n is a, c, g, or t
  misc_feature (155)..(155): n is a, c, g, or t
  misc_feature (157)..(157): n is a, c, g, or t
  misc_feature (193)..(193): n is a, c, g, or t
  misc_feature (214)..(215): n is a, c, g, or t
  misc_feature (223)..(223): n is a, c, g, or t
  misc_feature (229)..(229): n is a, c, g, or t
  misc_feature (231)..(231): n is a, c, g, or t
  misc_feature (238)..(238): n is a, c, g, or t
  misc_feature (286)..(286): n is a, c, g, or t
  misc_feature (307)..(307): n is a, c, g, or t
  misc_feature (311)..(311): n is a, c, g, or t
  misc_feature (349)..(349): n is a, c, g, or t
  misc_feature (351)..(351): n is a, c, g, or t
  misc_feature (423)..(423): n is a, c, g, or t
gagggagaggcggtgccaatgccaggccttgactaaacctggagactcgggtggccgaggggcttnataccagctgaagagcgacaagccgntggnagncgcggatctcaccgncgntcagngttnttagaacttcagccnatnanaatggnntnanattttccttgatcatatcggtggtacccgtctgttntcttgtgcaaccggtgatgcnnatcctgantctacngntcagaantcatctccactcgtttcacaggctgccactgggagagcatttcttttnaacaaggtagttaacctgcantacngtgaagttcaagatcgggtcatgctcactggccgcacntnggtacgagatgtgagctgcaaaaactgcaatagcaaactgggatggatctatgagtttgccactgaagacanccagcgatataaggaaggccgcgtgatcctggaacgtgctctagttcgagagagtgagggctttgaggagcatgtaccatctgataactcttgaagatacagagagaaatccatcttttcccaggtctccttcactgaaaacaaaaatctacttacatacactgtcaccttagcatcagagtcggattaatgaactgcggaacaagaggttgtgagaatctaagatggaacctttctttcttttctttctttttttaaacttttgtattttccatccaacagcagtgtgtagcagaga

SEQ ID NO: 716932 - DNA, 179 bp, Homo sapiens
ctcagggtttgttataattttttatttttatgggctttggtgagggaggtaggtgtgccttgtggtaagaagtgggctagggcatttttaagcgaagctcgcaacccactgatcactgggcccactcataaggggatgggcatcgctaggttcatagactatcgactggcccttctgta

SEQ ID NO: 716933 - DNA, 329 bp, Homo sapiens
gatcccccgatgggtcgatgaccctcacaggtcctttacaaatcacgtcacttttctgtcctgctccaccatcttccacaactttcctactgctcctattatcaaaatacatgactcctccttctggctggcctactgggcgcagccctggctcccccttccatcccactcactgtctccctgctactccctcctctgcggcccacactggtcaacccttcctctttcctctacacgacgggcctattgcccttgccatttcctctactcagaatgctcctcctctagctctccagtgggttggctcctccttaccttcccagtttcct

SEQ ID NO: 716934 - DNA, 1000 bp, Homo sapiens
  misc_feature (717)..(717): n is a, c, g, or t
ggcgtttgaatcgcggtgcgagaaggatagtggtggaatctcctcgtggtccgattagcctttctctgccttgcttgctgacctcagggaatcgaaatggctggcggataaagtgctgtgaaagggatctccggaaaggccaaagacaaaaggcggttacccgctcgctgagagccggtttgcagtattccagttgagccgtgattcatcgacaccctaaaaatctaggatgaaccaggtcatggcatccgtgtgggcggcaactgcccgcttgattttacaagcggccaccccactcctggaagtagccttcaccgaaagaagggtactttgaaactgggcagggaacaagcttgcctgttcatgatgggatctttaacagcgggtgtaaagaggggatattgacccccgtcgtcaactttgacgaacttttgcatattccggggagagaatgaccgacatgtagggattgtctctacatcaagggattacagaatgcctgggtgggtcgttggtcatacccaccgaattcggacgaaatctcctgattggggttgcacgaaaggggacatagcagacagactgtctaaagcggattgcctggtatccctggttaatcatcaagagactctaaaatactctagacagcgtgctccagtcggcaggagcatacccagggccagctgtatcctctgtgagacaaccccacatgttgcncctgttggtaatacctatttggcagcagttggccaggtttgaattgagctttccaaacaaccaaatttctgcattcgacgtctcccgatatttaaagtgttagcggtggcctccaaaaagacaatgaattctggacagaggggtttgaagagacaggcaggcttcaacacacgcgtggcgttgtatgtgtgccccaaggttttcgtccacacgttggttgggccacatatctctcctggggaaatctacaaggccttccccacattttttcaacaacaagaaa

SEQ ID NO: 716935 - DNA, 527 bp, Homo sapiens
  misc_feature (230)..(230): n is a, c, g, or t
  misc_feature (242)..(242): n is a, c, g, or t
  misc_feature (255)..(255): n is a, c, g, or t
  misc_feature (279)..(279): n is a, c, g, or t
  misc_feature (336)..(336): n is a, c, g, or t
  misc_feature (393)..(393): n is a, c, g, or t
  misc_feature (425)..(426): n is a, c, g, or t
  misc_feature (456)..(456): n is a, c, g, or t
  misc_feature (494)..(494): n is a, c, g, or t
  misc_feature (501)..(501): n is a, c, g, or t
aaaacaaacaagaaaaagaaaccattattatagacaccaagtgctatgcaaggtgatttacatctgttatttaattctctgacaacactgcgaggtaaatattattatccccatttttctaggtgagggaatggagggtcagagaattagttaaacttgtctgagtccacacagttaacagctggcagagcatggtttgaacccaggtcactccaccttcccaaacccgnttcctcatctgnaaactaaatctgngccatcataaaattcaggctaggnacaggctagcgggtttagaaaccctttctgcttttcccacccctagggtcaatggcnaagaccttgggcagggctttagctgggccaagcatggcaatgaagacccaagactgnatttggaggcttctagggcccggccagggggnnctgaggctggcctcttcttccacagatccnttacgaatgaatggtgtaggaatttcatccagcatggnacaaccnaatggaaggaggtggaaatgggatgg

SEQ ID NO: 716936 - DNA, 465 bp, Homo sapiens
cgacactcttggttggagtgtaatggcacgacctcggctcactgcaacctctgcctcccgggttcaagtgattctcccacctcagcctcccgagtagctgggattacaggcacccaccatcatgctcggctaatttttgtatttttgtagagatggggtttcaccatgttggccaggctggtcttgaacttctggcctctggtgatccgcctgccttgacctcccaaattgctggaattacaggcgtgaaccaccgcgccagtgagccaaggtcacacagctgcactccggcctgggcgacacagcaggactccatctcaaaaacaaaaaccaaaaaaaaaaaaaaaccaaaaaaaaccaatttgaccttaattggaatattggaggaattagctagctgtggggatggcaactctgcagctgtccaccgttgggaaaccttgagatctgcacccaagagtgtcg

SEQ ID NO: 716937 - DNA, 164 bp, Homo sapiens
gacgctcaatatatacatactggcagaaaagtacacgcaaggtgtcactcaataaattttcaccaagtatgttatatattgagtgaagcatttatttaaaaataattagattttttttcccctcgggggtttacttaggttggattcagatgctttcagaggta

SEQ ID NO: 716938 - DNA, 1034 bp, Homo sapiens
gcaccgagtcgctccctgttggggtgctggcaaatcccaagagagcatgctggagagtggggacatcctcatgtgtgcaggaggtctgtgcaacacttatgtgtcgttggttcgctgaactgtagtgtgtggtctccttgtgtcactccgtgcggatctcgtgcctgatgtgtcggtgttggtcgcccgtccagcaggctgtgccaggggatgaggttgcttcgcgatgtgcggcgcgggattctgcgggagctgagggttgctagcagctggtggcttcccctcgtacgtccttgtgggagtggaccggtgatctctacatggcctagcccacgtgctctggtcgagttgttaggtagtccgtgagccgcatatggactgattcatttctttggacagggcagtagaaacgacatattggaatgtgaccagcagagagcaggagcgagtcgagatagtccgccatggcgtgatctaccacgtctcgaaacgtgcacctgtgtcattgtgagacttgaccagggtgcgtgggtagcgggaacccttttccctttggcacgtgtatggaagtggaaaaagatgcaaggggagtgcctcatacagaactgaatctaggggtgctaaaaagaggcactgcaggtgaggggctcacttgaaaagcgttcgtgcctcaattggtaaccgttgtggatgtaagacagatgggcgttgaacacgccaagtggctctccgtcgcaagggggatcgttgccaattggcgcccttgggttatttcagtagctcaccgatacctggggaactccgggcgaagtccgttcattgggcgatcatttttccccttggggagagagccttgatcggtttcgcctaaggcaattggagggagcaccgttgaacaggggttgaactcaaaagggatcgagaactagtgacgtcggcggcggggccctatgagtcgcaagaccattcacaggaattcgtgctagccgattgtaccccgggcacgggccttaggggccacctggggtcacgta

SEQ ID NO: 716939 - DNA, 183 bp, Homo sapiens
tgagtcgccctcgcaggttacgacgaggaagtggcggagacatgcacggcgacatgtgcacagggtctgggaaggagcctgagattattcttctcagtgccatgtgaagccactgaaaagcttttaatgtataccagggacacttaatcagcctccctcattttacggaggtgtgcctctgga

SEQ ID NO: 716940 - DNA, 315 bp, Homo sapiens
ggcggctgggtcatgcctgccaaggcaggttgatcatttgagctgagaagttcaagaccagcctgggcaacatggtaaaagcccgtctctaccacatactttgctgtgcattgtggtgtgcacccatcgccccagctactttggacgctgatggggaccgcattgcttcagcctgggaggtggatcgcgccacttcactcctacgtgtgtgacagaacgagaccccgtctaaaagaagcaagccggggtcaggcacagtgactcacacccatcatcccgccactttgggaggccatgcgtggactgccaggtgtt

SEQ ID NO: 716941 - DNA, 369 bp, Homo sapiens
cccgaaagttgcccaaatgctggaattacaggtatgagccacgacacctggttccaatgtttattctagtagtttcataatttcaggtcttagacttaagtctgtaatccatcttgatttgatttttgtgtatatagtgagagatagaggtccagtttcattcttctgcgtatggttatccggttttcccagcaccatttattgaagagactgtcctttgcccattggatgttcttggtgcctttgttaaaaatgggttggccgtaaatgtgtggatttacacctgggttctgggtcctgttccattggtctttgtgtctgggttgttttgttggtttgtttgttttgttttttaccaatgccatgctg

SEQ ID NO: 716942 - DNA, 618 bp, Homo sapiens
cctgggcgcaatagatatagtaccgcaagggaaagatgaaaagattatagccgagcgataagtatagcaaggacgtaaccgcctgagtaccttctggcataatgaagtgtaaggtagaagataactctgcgaaggagagccaagagctaagacccgccgaaaccgagacgagctacctaaggaacagctagaagagcacaccacgtctatgtagcaagaatagtgggaagatttactaggtaggaggcgacaaaccgtaccgagcctggtgatatgcgtggtcgtccaaagatgagaatcttagttcgacttcaaatttgcgcgcacagaagacctctaagatccccattgtaaagtttaactggttagtccaaagaggaacagcgtctgtcggacacgtaggaaaggaagcgtgtagagagagtaacataatttaacacccatagtaggcctaaataggagccaccaattaaagaaagcgtgcaggctcaacacccactaggcgaaaacagcctaatacacaaatcccgggggaacatgccggggggggcgaatgaggatgagcggggccctggtcgaagcggtgccgggcccgcttctggtccaatggggcccccc

SEQ ID NO: 716943 - DNA, 784 bp, Homo sapiens
  misc_feature (486)..(486): n is a, c, g, or t
ctctctgaattacagatgatctgtttttctaacaatacgacccaacgtggagaaaccccatctctacttggctggttttttaattttttgtagagatggagtctcgctgtgttgcccaggctggtctcgagctcctggcctagggtgatcctcctgccctggcctcccagcaaattttttaaaataaattggctgggcacggtggctcccacctgtaatcccagcactttgggaggccgaggtgggcggatcacctggggtcaggagttcgagaccggcctgaccaacaagagcaaaactctgtcaaaaaaaaaaaaaaatttctccgtggataatagggctcttggaagaggggaggattacccatgggtttcacgtaggaacatattttgagtgagctacttatttacgcaagaaccgtgttgcctaaagaaatatctgatgagcctgaaaacttttcttagtaacttggaattaacttgttcnaaggggaaaaatctccgtaggtattaatattcccatggttccaactttgagaaccattttcaggactcaattcggaagtaacttcaatcccactcggagctaatgggtcactatgtgttcctaaaaaaagttcagtcccatagagtatcagaaaaaaagctgtgacacaaaagcggttggccatatctatcgcatcatgctcacttcgaacggcacattgttcatatatcagtgtagattcccgtggacattggcacgctttgcactttccacacgagtccaatgaaggtcatctacg

SEQ ID NO: 716944 - DNA, 419 bp, Homo sapiens
acggccatctggaagttgttagctgttattacctgtggacagtgtggatggcacatgagcctcagttcccctcgtctgtaaagtgagggcggtgatcccacatcatggattagagctgccgttccctgggtgcccatgttgtgcagtcaggagccaggctcggtggccaccctgccttctgccacgcagtctgccccaggctctgcagagctccgaggaggggccccggaggccttggtggtgcagtgccatgcccctgggaggctggggacacgtgtcccaggccctgacaccctcgcaggccgctcagtggattacagggccacagacctgtcctgacagggccacatacagctgccaagatgatggctgcttacctagcaaactctaatgccagaaaccaccttcttccttcaaaa

SEQ ID NO: 716945 - DNA, 212 bp, Homo sapiens
  misc_feature (34)..(34): n is a, c, g, or t
  misc_feature (83)..(83): n is a, c, g, or t
  misc_feature (96)..(96): n is a, c, g, or t
  misc_feature (114)..(114): n is a, c, g, or t
  misc_feature (120)..(120): n is a, c, g, or t
  misc_feature (129)..(129): n is a, c, g, or t
  misc_feature (134)..(134): n is a, c, g, or t
  misc_feature (137)..(137): n is a, c, g, or t
  misc_feature (139)..(139): n is a, c, g, or t
  misc_feature (165)..(165): n is a, c, g, or t
  misc_feature (174)..(174): n is a, c, g, or t
  misc_feature (195)..(195): n is a, c, g, or t
ctgggcccaggtgggcgtgggtgaggctgtccanccgaggcgctcttgggggggtgtgggctctgggccctgcccgctgagantggacaggcagcngccggacatacccagccncctggntggttctgnggtgnctngngttttgcgcaatttggctttcccccngccgccggngccatctccacagccctgtcnagggcagggggcaggct

SEQ ID NO: 716946 - DNA, 139 bp, Homo sapiens
tatgcttctgggtatatacccagaagtggaattcctcgataatatggtaattccattttaaatgaagagataggattgtcctactgtattaccacaatggtgtgccattttacattcccatcaacagtgtacaaatgta

SEQ ID NO: 716947 - DNA, 1871 bp, Homo sapiens
  misc_feature (223)..(223): n is a, c, g, or t
  misc_feature (329)..(329): n is a, c, g, or t
  misc_feature (1697)..(1697): n is a, c, g, or t
  misc_feature (1870)..(1871): n is a, c, g, or t
cattgaacgcacctgagtgactttacttgaggtaacgccttactagcaccagggggacttggagccaccagagacagcttctagttaacctatgctatagcactcctaacatcaatactggcgttgaattactactatctctcgctgccagccgggagagaagcagagcgggtagtagaggcctccggcgacggattggcaaggcaggctttcgttctgatantcttgcagactgtgcaaaatgagtcgtagatagagttcgacctcgtactggggaggccatagggataacaaaccacaagtaggagtcgcctgacaaacacgcgccntgattcctctgtaagggagtctatcacctagggtacaacaaaatagacctctccaagccttccatgggcgcaagtatattaatcatcgcgttcgaacccttcccactaacttcgcaggtgggtgtccagactcgggtaagcgcgggcttttgtagctttgattttccctcataaacgagaaaaggcgcaacccatacaacgaatccgaattaagtggcaaagcgaggcattaaatatagctctttgacttttgagtcctcccaagcgtccaaggccgaggtttgaaccgccttgcgggtagacgattcgccctaaagggggtccacctagggggctttgccctaaatatggcccgctccccattttagatatcccagaaaagtccccacgatagccggtcgcgcgggccacaaggcaacgaaggagcaacaatacgcctgttcttctcttgagggggctcacacgggagaacaccaggacaaaattctccttcactttaaactggtctcctgagttctgggttcttacagaaggctccactcaaatggcgaatttttaggattaaatctttacaacttcagttggtgcggttctcaccaccttaagtttggaaagttaactccccttagttccaagttgaaatttgccgtggggacagggtcctttttagggtgcccaaaaaaagtgtgtgagcttagagagatataccccgcgcggtgaagattggaacatcacggggggtggaacgcccccaggggaactttaagttggggggcggttctattcgcgccctcgggacaaagtaataactatccaacaccccactataaaagggtcctccttcctgtggagagcgtacctttgttggatcccttttcccccaattagcttagctgtctcgtttaaccatcaccgttgaacatgcggccaaagttcattggcgtaaataaaggcacggcggagaagagaccctggggatgtcgcaagtgaatcaccaccgcggctattggaaacacacggttctctggaaacactctttcctcccctatatagcccacagtggggaagagcggttatgggttctcccgcgaaacacccctggtgtgaaagccccgattccgggttaggataacccgttcaagccccaatttgcgtgttgttcattccccctaataacaagtgcctgatgatgcatgagttgaggccccccccattgtacatatactgtaatgcaggggccgcggtacacaaaaattcgcggagcatccagaaggagcaccttatgacctatgaggtgaagagaaccccgcgtattggcagcaataattgcgcaccaaatgatcggaagagaaagcccccggtatattngcggagtttagagttagcgtgcgggatacaacacacaacggaggcggatcgtgaaggtgtctacctgacatcactcaatggtcgacgactgaaagaacagacaggagatgtcacacacataatgtggagagagaagacgcgagaccttgtaaaatgaacatcgactgctaggnn

SEQ ID NO: 716948 - DNA, 188 bp, Homo sapiens
acccccccgaaatatttcttaaacccacttccatcccaacctctatcccatacttcaaccccaactaaactcttatatcaccatacacccaccccatcatctcacaatctacaactaattaatttataaacttcaccatcctacgaaccaccccttttatgataattgaaatacaccaacccacccac

SEQ ID NO: 716949 - DNA, 796 bp, Homo sapiens
ggaagatctacatccatcccccttgctctagccctccctgcggtgagattcatgttgcagcttttattattgaatcttcttctccttaggacacgcagcccccaattcgtccctccggcctgggcggcccctggctcccgcgcgccagcagtgggacgagctgatggtgactctgcccgcggacccgccgtgcgtgatgcacatggaaggtccacgtcctgcctgctgtcccgcatatcctcggtcgttcgtgaggaaccgggtgtccaagggaaactggataacgcgcatgcgtgaagatgcggtacggttggcttagatcattggatttagtgtgttagcagggtacgaatcgttatggggaccctaggaaccgcacggtattcaattctcctggaaggtgacgctagtagtgttctaggccgcggcgatacgccccgtctggaagaaatccctgggcgctaaggtctcgttgctttaccagttgaacacagaactctcaccaacacccactcgttaactttactgactaaccaagacggggtctcgtacaacttgggacgctattaacgcaaacttctgcatgagctcatgggaaatgctttatctcactacgataacgactcgtgccagcctagcacgtggggtgtgaaccatgcaaaatggcaggcccaacagcgacatgagtccatacttataactaccgtcactttcctctgaatgagtggtgagtactacgcagttcaagcggtagaactggtggcctaagcctcggggacaataagcttacttgtca

SEQ ID NO: 716950 - DNA, 756 bp, Homo sapiens
taacatcttgtttttaaaatagaatgatagaacttgccagtctttaagatctggcttaatttaatgtattaatctgttagtgcgaacataataccaccatttaaaaatgttagggagatgagttgcaggtgtttctactaatagacttttcttctgtaacagcttagggctatagtaaagacattcacaccgtctgtcccgtcaaaactggactaacttacgttttaacagtgcacgctcattcgctggtttagaactctcggtactggttgcgctctccacttattgagctctccctcctaaccgaacatcgaggagagggactgaatagacacgcccaacattcagtactaaacacgtcgcgtctcaaacgccttcgtactctacaaacgtagatcatatacacgaaaaaacatcacttcctcactctgactgtttggttagaccaccgaaagtccgatgtcgtcgtctctggtagctcagttcccagaccagcttttacaggctagtggaggacggtcgcctctcatgtggccactctggccatctctatattccacattggccacgggctcaggctgtggctcttctgaagccaggtggctcgttaagggaacgctaccagggcatgcccgtgagctccggaatagatgtccttcactcacttcttccacctgtcatgtcgacccctgtattcttacctatgtcctcagatccccagctttctcctctgcaatgcattccttccagtgccgc

SEQ ID NO: 716951 - DNA, 365 bp, Homo sapiens
gcggagttcccacatccgtagggactgcgatcttgtgtagaggctgactgttcactccttactgcacgccctccatcatcttcaggaactcgtcgaagatcaatgcggccgtcggtcgttcattgtcgccgtcgtttatcagagattcgatctcctcgtcagtcacgtgctccccggaggccctgaaaatctcagccagctcctccgggtcgatgtaaccgtctgcattcctgtcgaagatgcggaagcactcggccagctcctcctcgctcttccctttcgcgtcctctttcatctggcgcaccatcatgagcaagaactcctcgaagtcgatggtgccgctgccgtcctcatccacctcctcg

SEQ ID NO: 716952 - DNA, 422 bp, Homo sapiens
  misc_feature (75)..(75): n is a, c, g, or t
  misc_feature (82)..(82): n is a, c, g, or t
acaaacattgtggggctgctgctggagcgtgacgtggacatcaacatcatagattggaatggagggacgcccctnctgtacnctgtgcgcgggaaccacgttaaatgcgtttaggccttgttggcccgaggcgctgacctcaccaccgaaaccgactttggttacaccccgatggacctttccgtggccctgggataccggaaagtgcaacaggtgatcgagaaccacatcctcaagcttttccaaagcaacctggtgccccctgaccctgagtgaaggccgcctgccggggactcaaacactcagggaacaaaatggtcagccaaagctggggaaacccaaaactgacttcaaaggcagcttttggacaggtggtgggaggggacccttcccaaaaggaaccaataaaccttttgtgcaga

SEQ ID NO: 716953 - DNA, 177 bp, Homo sapiens
gtcgacaacacggtgaaccctgttagacaggatcgtcttgatctcctgatctcgtgatccgcccacctcggcctcccaaagtgctgggattacaggcgtgacaccgcgtctggcctattcacacacactcttgatttcagaaaccatgacccaatatgaagcgtcgacgcgtccgga

SEQ ID NO: 716954 - DNA, 429 bp, Homo sapiens
tggtttctaactatttctaaactttttttcattctttaaaccaaattatataacattccttggcctctatttacacattctcttacatatcaccactatcactctttattatctaatcaccccaaataacttttcaccaataccactttttacctttctaaatactatcaaactatttctcctcaataattattacccaccaaaccccattatttctctatctcttttaattaatcttaaatatcaatcttcatttcctctcaactctcctctatcctcttacactcattactcttcatatctaactaatttaactccttcttcacctaattactcattcccactaattaaacaaatccttttttatcactattaacctaacatcctctatcccccactcaaatttccacacctcccatattcttttcc

SEQ ID NO: 716955 - DNA, 344 bp, Homo sapiens
tttgttgaacgttgttatcctaggaagagaaacctatgacttgtgtacctagatcatctggttacattagaaagcgggtctttcagcagtagagcgataaatggaggttaccttgtcgggaaacaatctaggttgtaggtgtatgaggtaggttgattatggtgctgatgttgagtagccacatttgactgatgtctggattctctgtgatgctgtggctagcagcagagctcgccagttcatgcctggacatagtgggcaggctgggccctccagctagctcctttggggttgagtccgtatctttgtgatgtggaagtataaagcaagtatggtgatttgta

SEQ ID NO: 716956 - DNA, 408 bp, Homo sapiens
  misc_feature (44)..(44): n is a, c, g, or t
  misc_feature (62)..(62): n is a, c, g, or t
  misc_feature (154)..(154): n is a, c, g, or t
  misc_feature (399)..(399): n is a, c, g, or t
gtttttcctgtttgccacctgaatacgtggaaccaccatccacncagctggttaaaccagantcactcagaaatctacctctccttcgatattattcataactgccagtgttaaaattctaattgctggccaggcacggtgctcatgccagtantcctagaactttgggaggccgcggcaggtggatcacgaggtcaggagatcgagaccatcctggctaacatggtgaaaccctgtctctactaaaaatacaaaaaaaattagccaggcgtggtggtgggtgcctgtagtcccagctactagggaggctgaggcgggagaatggcgtgaacccgggagcggagcctgcagtgagcggagatcgcaccattgcactccagcctgggcgacagagcaaantccgtctca

SEQ ID NO: 716957 - DNA, 669 bp, Homo sapiens
ccgagtgacctctaccgcaagtcgggtgctgccaaccgacttgcgggagctccggcaggcgcttgcagacagaccccgcagcagtcaagctggagaacttcccgcatccacgccatctacatggggtggctgacagctagtagggtagcgaggagcgtgcccgagcccctcgatgaccttcgcgacagtacggcgacttcctccgaagccgtcgagctgccggagaagcaggagcagctggctgccatctatgccgtccttggagcaccttccagaagccaaccacaactcccgtggagagactcatcgttccaccttgttcaaggtggcccgtgcatcgaggatgtcaaccgcatgtcacctgtgtgcgctggccattatcttcgcaccctgctcctgcgctgcccgtgacaaactcggacccaactgaccagcatgaaggacgtcctcaaagatcaccatgtgcgtggagatgctgatcacacggagcagatgaggaaatacaaagtgaagatggaggagatcagccaactggaggctgcagagagtatcgcttccgcaggctttcgctcctgcgacaaaaatgctccatggcctctcgaactggggttacagactccctatgaggggggtcctgaacaagagccccaagaccgggacctccaggag

SEQ ID NO: 716958 - DNA, 910 bp, Homo sapiens
gcaccaacatggggagatgacgccggtgcgaacgtgggtggctcgtaggagccttgcgtggacctgggatggggtaccgcagtggcttccgggtaagcttgacggctataggaagtaccggggcacgggggtacgctagagccatggaaccggaggtgcatgtggcgacgcgaccgtcggagacgtgcgacgagagtgaatgcgacgcgatgcgtgtaaagagcgttgtattgtccgatatgcaacggcgtgccgccttggtcaattgtaccttgcactgcatgcaacggttccactggagaggtaaattctagtgctgcgttactcgcctgatgccatttatcactgacatgcagaagagtcattggaatttcactgtcctgtgtgcggtgcacgctgctacatgagtggtgagggctaagtggagggaatcaagtgcacagagtggaatcgaacaaactagcaaccgctgggtgccccgagcacatggtccgcaatagcgaagcggtctcaaagtcgccagttcttgatctgctttattcaggcgggactataaccgctttgtggcacagcgaggtactggggtcagtgtgcaggttgggtaacctttgggatctcaaaggggcaagtgttgggccaacggtgtcacaattgccggataggggggccatttctaattcacgtggtccccaagagcttacatttgctattctgttgcccacagttgcacgcacaagaacgtagctaacattgaggtgtggacagcaacgaactccgcgagaaaggccctccagcaacataggttccccgtatggcactggggatagacaaagggtaacgaggttgactacggcattcttgcttgcgttgggattacggacgcttaccagttccccgtgccaccccacag

SEQ ID NO: 716959 - DNA, 89 bp, Homo sapiens
agaagcaggatgaacttgaaacggatttgccacaagaatttggcagcaagcatgcacagcatattaaagtgagtgaccctgcgacccac

SEQ ID NO: 716960 - DNA, 418 bp, Homo sapiens
ggctaggttctgatacttagacaggtgggctcatcctgacttagaactcgaggaggagcactcttccttccccttctatgagcagcagctccaacacctcgcacttctgtcctcgacatgtgtcccagaataaccagccatgatgagcgctctgagaagggtctataggccttgcaagcagacagaaaggtgcctgacctctgacctggattcagggggtgtctggggtcatccccaaagccaagtatggttggaaaggagaaggactgagaaaagactgatggccctggaatcagcaggttgaggcccaggatgacccatgctagaatctgggggaggacgcgggccctgcccaagccaagcagttggtcatctctgggggcacacaaggccatgccagtcaagctcctcctcagat

SEQ ID NO: 716961 - DNA, 258 bp, Homo sapiens
  misc_feature (214)..(214): n is a, c, g, or t
tgagtggagagagaaggaaatagggaaaaggagttgggactgagggaagtggtgaggaagggtaggaagagaggggatcctgagagaagtggatcaagaagatttgtaacccgtgatttcccgtgtgtccgtgaatggtcgtggagtgagggtaagtggagggtgtgtgggcagtgcgcatgagcctgtgcacacatcaccctttgagtgtccncttagatgggttcccctctcagtgctagactacccccgtctccc

SEQ ID NO: 716962 - DNA, 294 bp, Homo sapiens
tatgctttctttccaatcctgctctgcaaaacaaacacaagatttgtgtcacagcgtgccagtacaacttttatcaggtggacctaatgctgcacaatcctgtagaaagaacactaattcagatgtgagaagatcttggttctacttatctgctatgtaatcttggccaaatcattcaaactcaaaattttggtataaaatagaaacatggtttgtatctgcactgtcctacagaaatataatgaaagccacaaatgaaattttaaaaatttctagcagccatttgaaaaaggg

SEQ ID NO: 716963 - DNA, 118 bp, Homo sapiens
gagtggtatgtcgccgtgcgtacctcactgttgacccagctggtgactgtaactcgggttcgattccggagagggagcctgataaaacggctaccacatctcaacggagggtacctga

SEQ ID NO: 716964 - DNA, 293 bp, Homo sapiens
gagacacacaggaggttgacgttgagaggagcacatcagttcaaggacacattgggtggcttgcactttttttccctttcctagaaggaaaaattttcgcggttagaggggtttccccccacggacccgcactctctggcgggcacccggccctttggtttaaaatagggtttggctgggaacccaagagaggccctggcctctatatccccccttaaagggaaactcttttccccttttgggccccccctctttaagaactctccccataaaaaaccctacccttctcccga

SEQ ID NO: 716965 - DNA, 702 bp, Homo sapiens
cgcacacatgcctattgctgaagaggcttctgtcttatttgaagggcagcccacacccagctactttgaccccaggtttatggaaaatgtcaggccttcccccccactcccgtctaactgctgtcgcccccctacttgctggctctcagaagcctaggggagtccctgtggtcctggattctttcccccaagacgagcccgccttttacccaccttaagggccccaaggccttggaccaactgcatggagctgccactcttaggagaaggaggggaacccagatagttagatacaggggagggagccggagtgtccctcccgtcagtgcctacccacacctgtgaggcacgccttctgatggcctggcccacccttccccacgaaaccacggggaggcctgaggcttcacgttttatctctgctgccaaatgaaggcgggcctgcagccgagctacaccctacggaggctgttgaggaccatttcacttcccattaaaaattataaaaatactgactggctggcacaggcacagtgccaagtctgggaacagggacgcggggagcttcacctttttgttttggcttttctttgggctgtgggggggcatccctttccaccgggtcggggaggaaatacccaaagcattgttgttctgctccatacatctcacttgtttttaataaagcaagcagctgaacca

SEQ ID NO: 716966 - DNA, 439 bp, Homo sapiens
gaggatcccccgagagactgtcatcgccttactctagttatgactagtagtaaagtaggtaaatgatcctcccatgtacaattatcgttcgtataatctaatctgctccaggtgtccgcccttccacagagggcctgttataacgctttgttttcacaggacggaaaataattagaatcacaagcataataattcggcgcgaacctttcgtgatcccgggccgaagcaggtcataagcgctgagactgtggagtttgcagtgcatgcttcttaaatcagttcttactaaatcatcaagaaaagtcactggtagatgtttggagtggcttttctcattgcgaagcttatttcaaaagcaaaaagaaacaaactcacttggcagagaacagaagccaaataacttgcatttccaagagtaaatattgacaagatgacagtc

SEQ ID NO: 716967 - DNA, 1244 bp, Homo sapiens
ctgagatctctgtggcatggtatagggaacacaggaacgggtaccgatataccacaagcacacatggcaggccaagatctcagtcattcgcccttcaacgggacacgagagctgtatggcgggctgtggctgtctgagctacttatgtgctgacagcagcacatagtattcacatgatggcactgaccacaggaacactcaatcacaggctcacgcgtaggaggggagcacagcgggaccctgggagcatagaagctagctcactcatatcaccccaactcacaaccattaatgggaacaaacagaaccagcgacatcctgaaattacactgactatcgacggtacgcctgatcacagctcaacgacataacgctgacacatatcggccaagcactaatccaggcctcaataatcgtactaccccctgcaccgcgaggggaaacaagatccgagcctctatgagcgattacctaccgaagataaacagttagacaagccaatcacaaccggacagacacccgccacccccatgacccaccgcgacaatcaaaagactccatggcacagacgcaacccgaacagacgcgcacgaaacacacagcacgcgacacacaaaacacggacgacacatacaatcaccaggacatgcaggccaaacacaacaaagccccgaacgacgacaacaacgacggcccacacaagtaatagacgaccaacaccataaccagacacaagtcaaagggaaaacatcacaacaaacgtgctgcaacaacactaccgaagaatcccataggatacaatggacacagacataacatccaaaatactaggacacccgaaatacgtcatgcacaaaggaggaatcacgagtacgctccctatctgaatagacaaaaccaaccaacagacggagtcctacattacaccgctcaggtagtactataacaatgtgagagagaacataattagaacatcgctgtgctgcacaaccacagaaaagggaaaaagcaggagacaaggaataaccgcccgcgccaacgacccacatcacccaattacatagaagtagagtccagataaggagtagcaccacaacaaacatgacagtgctatcacaatcaaagacaacatagcaagaggacagaccaatcagcaactggaccatacaacagacaagcaatcacaaagcgcacagccatgcagtacaagacactacgagagcgaagaggacgttccatatcaa

SEQ ID NO: 716968 - DNA, 949 bp, Homo sapiens
ggtggcacctgtgggttcccaagctacttgggaggctgaggcaggagaatcgcctggacctgggagactaaggcaggagaatcggcctgggcctgggaggcggaggttgcagtgagcccagacggcaccattgcactctagcctgggcaacaacacgaaactccgtcccaaaaaaaaaaaaaaaaaaaaatcccaggggttgatgccaaacccaataccctttttttaacccctatttgtttaaaaaaaattaaaaaaagttttcaagcagtagcacctcgggtgttggcataacaccgtgtttgcagggcttgaccttacacaatagttcttgacattaacaacatcatcctcttaacaccggtgttgaattgttgccacttagaaagttcaggtatggcgtggttgacacaaccgtggggggtctcccgtgcggaaagcgggtgagtggtttctctataagccaccccccacaaggagaatttacaggtagccaaagggctagtgacttaagaaacgtgggcgattttaggggggcgcaatagccttcttatcgcaaagtgtcccgatatacgagctcatctagcccccttggtgagttctgggaagtgttcgacataaaaaagtcttctccacagttcgtcaagttggacgccgatcattgaggttggtcctcttgagagaacaggggatcctataaagacggagtcaggggcgtagaagcctggatcggaaagagaggacaacacaaacagagccacgcatagcgattgttagtcagcctacgacaagtgttcggtaacgcgaccccaagccccttgtttataggctataaaagcgacaagaaataacacaggcaccgtcgtaacgacaggcagagagcattaacgtggggagacaaccccccggcatttagtcggggccatttatcgtcgcgacaagatagaag

SEQ ID NO: 716969 - DNA, 782 bp, Homo sapiens
  misc_feature (48)..(48): n is a, c, g, or t
  misc_feature (66)..(66): n is a, c, g, or t
  misc_feature (171)..(171): n is a, c, g, or t
  misc_feature (177)..(177): n is a, c, g, or t
  misc_feature (202)..(202): n is a, c, g, or t
  misc_feature (209)..(209): n is a, c, g, or t
  misc_feature (243)..(243): n is a, c, g, or t
  misc_feature (271)..(271): n is a, c, g, or t
  misc_feature (273)..(273): n is a, c, g, or t
  misc_feature (299)..(299): n is a, c, g, or t
  misc_feature (317)..(317): n is a, c, g, or t
  misc_feature (333)..(333): n is a, c, g, or t
  misc_feature (345)..(345): n is a, c, g, or t
  misc_feature (379)..(379): n is a, c, g, or t
  misc_feature (381)..(381): n is a, c, g, or t
  misc_feature (432)..(432): n is a, c, g, or t
  misc_feature (472)..(472): n is a, c, g, or t
  misc_feature (515)..(515): n is a, c, g, or t
  misc_feature (571)..(571): n is a, c, g, or t
  misc_feature (657)..(657): n is a, c, g, or t
  misc_feature (680)..(680): n is a, c, g, or t
  misc_feature (694)..(694): n is a, c, g, or t
  misc_feature (774)..(774): n is a, c, g, or t
cagcggtgaggggcccatggggcggggcctgaaggtggattgagggcnttggttttttgttgagtnatgatagctccatgttccttccagtggccctgcagcccctctattccccagctttagccgctacttccagtggggcaggaggagcttccattgccatctggagancctggnagggacttgcccatccgatccacanaccagcngggacctcggcgctgcccctgggaggagcggcantgccgttccggtagaagcctcgatggtnanaattgggcacgtagagtgtttgagcncctgggtagaactcagtntggagttgctgcagcnctgagtccagangtctacggcatgggcccatcttagtgttttggananccgcagaattgggctgggagggcgtggtagaggtgcctggattcctctgtnggtctctgcggttcaaatcctgtgggcgggcagtgcctgnatggggtttaatctccttaggattttcctctgcaacagcaggngcgcgggccggaaggagcggcctcggccgagcagtagcgccccgcaaaggggcctngtcgtccttgggcggatgggaatgcagttctggggcgcagtcaggggtgtagacccgcactcctgcccctccctcctgagaaagcnctcagcttccgcgcagcctcggntggggaccccccancctccttctccacgcagccccctggacaacccgcctgcaccccttgcccgcagcctgggcaccgcgccaaggcgcatacnggggctgg

SEQ ID NO: 716970 - DNA, 464 bp, Homo sapiens
agataataaaaacgcttccccacccgaaacccccagtccggggttcctgtatcgggaaagggaaaaagggcccaaaagcaaaaccctcttccgggggggggggagtatttttaataaaaaggggggccaaggtttccgcttgaaaaaagggcaatagaccccccgccaataatttggtttggctccccccttaagagccccccggtttacaaatttttcttccggcccaaaattttttggggaaattgaaaagaaaaaaaattttccccaagaaataattttttcccttttttccccaaaccttaaaaaaaccccccccaaaagaaaaaaaaaagggagggcccccccgggggggggccccttaaaaaaaaaaaattcccccgcccccaaaaaattggccccaaggggggtccaggggggggcccccagggaggttttgcccttaaaaagggggggtggggggg

SEQ ID NO: 716971 - DNA, 222 bp, Homo sapiens
tagggtagcgagggtgggatgtagccttgggtcccgttcaccggcgtgacggtgggcaagaactcgagtgttctgtgtcccccgggccgtggcacccatgagtacgtggggaaacccgtgccagtgtggggtcccaaacgaggctggggtgggggtgactcagtgattcacttcaccccttgcccgggtccttcttccttgcatccagcttccgaacggagg

SEQ ID NO: 716972 - DNA, 125 bp, Homo sapiens
taagcattggagagcatatgacacgcgccagctagcaggatttcacatcaaattagagtctgattttgattaatatcatcactagaggagtttggattttgcaagaccaatcttcaatgttgagc

SEQ ID NO: 716973 - DNA, 254 bp, Homo sapiens
tgcattctaacctgggcgacagagcgggactccgtctctaaaaaaaaaaaccaaaagaatgattcctcagttaggtgcatcattaaaaggggattgcaaatatcttttaaataaaaatttgcatcctatatgttgtagaatacagaggattttaaaaataaattttatcgcatgtttagacaattgctttctttcaactgtttacatatggaagcacaaatgctaaacataagtcagaatggaagaatctttaa

SEQ ID NO: 716974 - DNA, 251 bp, Homo sapiens
atccccaacacccatcccaggtgtagcaccaaatgtaagaagtaaagaaagagaaaagaaacatgaaaagtggctcaacagtcaaagacaagtttattttggagaacaaacctgagaggggcttctggacaattttttttttttttttgggtaaggagtgcttgcccctatggactaagagttttaatgggtttcagggtgagagagtttatcacaggctgggaatgtacctgtgtggggcgataacatca

SEQ ID NO: 716975 - DNA, 255 bp, Homo sapiens
ggcgtaatgactctgcctcacgggttcaaatgattctcctgccccagcctcctgagtagctgggattacaggcatgtgccaccacgcccagctaattttgtatttttagtggagatggggtttctccatgttggtcaggctggtctcaaactccctacctcaggtaatccgcctgcctcggcctcccaaagtgctgggattacaggcgtgagacaaccaacgcccagaccctctcgttactttttaatgtcccca

SEQ ID NO: 716976 - DNA, 106 bp, Homo sapiens
ttttctacacagtgttttccaggatcagcatcttcacacactactagatctgtatgacaaaattaacacaaagtcttcaccacaaatcaggaatcctccaagcgat

SEQ ID NO: 716977 - DNA, 87 bp, Homo sapiens
atagtttgggagacctgaagcctggaatatgtttcactgggccaaaatcagtgtgttagcagggctgcacccttctgtcgtcttctc

SEQ ID NO: 716978 - DNA, 552 bp, Homo sapiens
  misc_feature (386)..(386): n is a, c, g, or t
agaaacatttacaaaccacatatccaataaaagactggtatatagaatataaaaagagagtgctcaatactcaacagtaaaagacgaacaatctaattagaaaatgggcaaaaaacatgaacagatatttcaccaaagaggatatataaagatggcaaatgaggatataaaaagatattcaaagtcattagccatcagggagaaatgcaaattaaaacaacaatgatatatcacgtacacatctatcagaatagctgaaataaaaaaatagtgacaatactcataactggtgaagctgagggaaaatcgggcatctcatacattgctggtgggaatgtaagtgatatggcttccatagaaaatagttgaacacgttcattaaaaanacaaacacacaactaccataaaacccagggatgacactcctggagtattcacctagagaaatgggaacattgtatgttcactcagaagcctgtacatgaatgcgtcataacagctttatttataacgagccaaaatctataaagatacaaaatagaggtgaacagc

SEQ ID NO: 716979 - DNA, 818 bp, Homo sapiens
tctgtcctgtcccgcgagggccccgtgcgccagctctggcgtgtttccgagatgccctggtctcaccgtgggagccgggcgcgggtccgccggcatctgcgcggcgtctgggggtgaccgcagcccctcggggtcggcagcgggcccctttgctcccggtggctgcggcctgagggtccctcttccctgcgcagggtgccctgcgctgcctcacctattgtgccccgtgagcctgggactgccatgggcccagcgcttgggggccttcctgggccagcccgtctgccttcatggcaggtcccgagggggaggatttgggtcgcgacctgctgagcgacctgagaagtgagaagctgagcgaacagaccaaggtttccctgctggccctgagcatggagtaccctgcgcagctgtggcccgacgcctctgcggccgaagtggccgacacctccctgttggacaccttggtcctcctacccccgcggacctcagctctccgtacggcactgctgctggcggcaccactgccctggcggcgggcggcgcgctgggccccagctcgggcgcctcctgccggctcctgcccctactgctcggcctggccgcgggtagcgatctggggcgaggctttgtcccctgctcggaacaaggccccttgcaggccacgggctgcgagtgctgcgagagctagagagctgcagcccgggctgctgcggggctccctgaggttgctgcggggcctgctggggcaggaaggccctgtccagccacttcaacctgttgctggacctcgcattgcgccaaaacctatgggctca

SEQ ID NO: 716980 - DNA, 285 bp, Homo sapiens
aatacacccatgtttcccatgttgtgccatgtttttccccaagcaagcatccctactcccgtcaacaaggctctggtccatatcagtgttcgtgcatgctgaagtatgtgatggactgaatttaaatgagctctacataccagtcgcgaacccccggtgcctcgcattggaactcttttggggagtgtgatctgagcagagaaagcagcatctcgggacaaagctccagttgtaatagactttcaagttggtctcttgtgatgacatgtagtatccatgaacatg

SEQ ID NO: 716981 - DNA, 500 bp, Homo sapiens
  misc_feature (12)..(12): n is a, c, g, or t
  misc_feature (63)..(66): n is a, c, g, or t
  misc_feature (74)..(74): n is a, c, g, or t
  misc_feature (85)..(85): n is a, c, g, or t
  misc_feature (89)..(89): n is a, c, g, or t
  misc_feature (91)..(91): n is a, c, g, or t
  misc_feature (100)..(100): n is a, c, g, or t
  misc_feature (125)..(125): n is a, c, g, or t
  misc_feature (188)..(188): n is a, c, g, or t
  misc_feature (284)..(284): n is a, c, g, or t
  misc_feature (333)..(333): n is a, c, g, or t
  misc_feature (375)..(375): n is a, c, g, or t
  misc_feature (477)..(477): n is a, c, g, or t
tgaggccaaggnacacgcagccgggcctgcagattcgagcccagcagggaccattaggttttnnnnggaggcanctgagggcganaggntntgcacaaancagttaggggcagaggacgcagggnccagatgggtctcccaggccaggtgagcccagaacggcccttcccagcccctctagagggtangttgggggcagtagctcaccaggcccaggagcagccccatcctggaggcaaagcctatcccaaaaactggccctgcctcttcctgaggtgaccttnagtccgtaaaactgacgcccctggggtgacgcttgaaaaccggaagctnttccaggaggagggaggggcctcggtttctcccggggcattnttggcaaggaaggccctcgggaatccgcatcagtcccacggccgcggtgcggtcgtcacctgtgatcacggctgcctggcgccccctgccggcccacctcancccttcctcgcaggcctggccgg

SEQ ID NO: 716982 - DNA, 151 bp, Homo sapiens
ggggcggtcaatcggcaggctgcgtgccgatatgccgtttcaccgcgtcagccgcacgccggtgtggttggcggcgtagcggccgtgcacgttgaccgtcaccgttttgccgctgcggcggaatttccattgcgcgtcgctcggcgtttct

SEQ ID NO: 716983 - DNA, 880 bp, Homo sapiens
tgctgcttctggttctcttgtggccaccgtcgctgtccggcttgccttggggtgcgaacagacaaggcgtgggccacagcacctcagaagccgacgcaggtcgacgcaggggccggcaggagggtgggcgatcgcgtgtcggagggcgccggcggtgcaggcgggctgggcgccaagagggggcaaagaggcgcgtgggcggcgggtcagccgttggccgggccggcggggaatgtcgatgcctgacgcgatgccgtgccccgggtcggggaggagctgaatggcaggccaggagatcgatggacgccgagatgtactccttcatggccaccgtcaccaaggcgcccaagaagcaaatccagtttgctgatgacatgcgagggagttcaccagtattccccaccagaattggccggaagatcttggtctcgctcgatctcacagtcctccagtgacagctacgagttcagctgtatctacacagatagctctgatgatgaggttctccccgagagaagcaggaaccaactccgagggcagcagcaatttcgtgtgtgaagaacatcaggcaggcaagaattgtggactgggggaagatgagattgggcgagcaagtacattgtcttgctctgatttcacctcagtgaaaacgtgctcagtgggaagaaagcccttggtggtgcttacaattagtggggctggacacccattcaccagccagactgggtgttgcttggagacactctgtggccctgggggtccaaaggccgtggccagcttgtaacttttatccatcccgaaggattggcttgccactggttgagctgtgtgcaggtcccttggaggaggcgccaaaagaccctgggggattacaccggtg

SEQ ID NO: 716984 - DNA, 149 bp, Homo sapiens
ggcagcttcactgccgtctcttcatacagagcgtagtttcggctctgcccattagactcattttatgtaggagttttaaatgtgtgttatatttcctttcaagtcttacaaagctaagactttttaggctcattcctttttgcatggat

SEQ ID NO: 716985 - DNA, 618 bp, Homo sapiens
gagaacggaagctcctgcccctcctaaagctgaagccaaagcgaaggctttaaacgggcaaggaaggcagtgttagacaatggtgtccacagtcgacaataaagaataagatccgcacgtcatcccacgcttcgcggcggtgcgatagatacctgccgacgtccggagtagcaagcccaaatatcctcggaatgagcgttctcctaggagaaagaagcttgagcatctatgctatcatcaagatatcgcgtctgaccacagtagtctctgcacagtgaagtaagaatagaatgaactaactaatctactacttgatgttcatccgttgtgatgtttgaaaggccaaagcgaagcgacctaggattacaacagtgctgctgtaagtagagctgctattgtacaattgcatgttgtgcctaagggtctaggatcacccctgtattcgggccctggagtggagtagaaagaaggcatatgattcgactggctccgtgattacgatagctttggatgttgccaacaacaattgggatcatctaaactagagtccagcgtgcctaattctagaatatatatatatatatcttttcaccatataaaaaaagagtaaagatagag

SEQ ID NO: 716986 - DNA, 302 bp, Homo sapiens
ggccgagagtctttaggcttttttctttttaaaaatggtttttttggttttttggaaaagcctttttgccagccgaagctgccgaagaagagctaatgagaagccctttcctaagggggctccaggagccctaaccgggctgcgtggcagggcagcatttaactttttggcttttggttaaaaaaagggagatgagtaagcccccgaggacccagcggttgcaacttaaccagcctccagttaaccccagcccaagccaggaagagaagcccttttcctgtgcagacaggcagaactactgg

SEQ ID NO: 716987 - DNA, 181 bp, Homo sapiens
cccgctgtaccagttgctgggtcagggcaacttccagaccattggcttgagtgcagccgcctgctttaaccagtgcacactgacacgcggcaacaaggtcatctccgtagatgacatcgggccaagcaaagcagggaagtcagtagggcagtggtaaccacccacactgagtgcatgcact

SEQ ID NO: 716988 - DNA, 479 bp, Homo sapiens
ctctggatgcaaagtgtctgagtctgctggggtgggccatttaaagggctgacggcaccactgcagagaactgtgggctaacacaccactagttgtcagtgacttcagctgaagggtcaaaacagttatagcaattaagtaactatgttgaatcacattcaggcatagccaaaattaaagtgaaggacaatacgtcattgttaaaaaaaatagcaaatttgcatatgagaaaagaatgttatttactatgattgtagatagaaattaaggcgattcttacctttcctaatgccaatcaagttagaaagtgaacagaaagaatggtcaacccgatattcaacagcatgacaaggacaatcatgattgaattagggcctgaatccgcttctttttccaaagcagggcatgaatcgttgcttgctggattctttggtatagcaagtacagacttcttagctttagggtcagctttgctttct

SEQ ID NO: 716989 - DNA, 341 bp, Homo sapiens
  misc_feature (50)..(50): n is a, c, g, or t
  misc_feature (65)..(65): n is a, c, g, or t
  misc_feature (76)..(76): n is a, c, g, or t
tgttttttaggggtttcactaaaaagtttcaggtttctatttaacatggnaattctgtataccanaatgtaccagnaaagggttatgttattcatgaaaaaaaaagagaatagttttgtctaattcaatagttatctaaaagttggttcaaattacagatttaaaaaggttattcataaaacaatgtagtaaggaatcattaggcaaaaaatgtgggaaaagtttaaatcataaaatattttttaaaccctgataaagaattggagacgtttggctaattaaacattttcataaagctgttagttttgattaaagtaaaataaaaagtcttgtaaaaatgc

SEQ ID NO: 716990 - DNA, 412 bp, Homo sapiens
cctccaaggcctctgaaaacctctccccttcttccagggtttccagacccaaacacgctacctctgaaagagaatgattgctggccaaagactattcccacagtactggctgcttgaccaaacacagacccagtatttctagacccaaaccttgaagcttggcaaaagttgaacccaaaggttgctgctgttgtggtgccagttaaggtaccaccaaagacagagcctccctgtccaaagccaggactctgcccaaaaccagaagcgttgctttggccaacacagcccccttctgtgtgttgggagaagcctgtccaaatgagaaggactctggagctatgtggtacttgaggcggcaccagacacacttcctctggtgtatgtgagagtagagaaagcctcgtgccgaatt

SEQ ID NO: 716991 - DNA, 259 bp, Homo sapiens
cgactcatagaggatcccgagtagtacagcctggggcagggggagtgtaaggataagaagcaagtgaggtagggcacggtggctcacccctgtaatcccagcatatagggaggcgaggtgggtagatcacgaggtcaggagtacaagatcaacctggacaagcttgaacccgggaggcagagatagcagtgagccgagatcatgccactacactccagcctgggcgacagagtaagactaccgtctcgggggcgggtag

SEQ ID NO: 716992 - DNA, 245 bp, Homo sapiens
cggaggaagtgttcctaaatagtcctgggggctgggcacggtgctcctaccagcactttggaagctaaggcaggtggatcgcaaggtcaggagtttgagatcagcctggcaatatggtgaaacccatcactactaaaaagtaaaaaaatggctgggcacggtggcccatttgccttccagtgatgagcctgcctgaacagaaacaccagatgcagctggaattcattgtggaaaacatggcgaaa

SEQ ID NO: 716993 - DNA, 188 bp, Homo sapiens
  misc_feature (2)..(2): n is a, c, g, or t
antagacccccacccccgtttttttttttcccctccccccctctttgccctgtagaaaggcggtgatggagtccccccccttgtttttatatattaaaaatttcccaatctgttttgggccttttttactgttgggaacttataatccaaaccttttctaggggttttaattaattttgtttttctta

SEQ ID NO: 716994 - DNA, 906 bp, Homo sapiens
ctagttctagatcgcgacggcgcccttttttttttattgtttaaaggatttaaaaatatatctatttggaaatattctgaaagtattattaatcacctatggggaaggaaagaaatcaacccaatgaaatttaggaagaaaattgcaaacgcagttgcaaaatcctgccccttccaccccaaggggcacagcccggaaaatagaagcttattttaggatcccaagtgcacgctctggtagaccggaggatgactttgtcagatctctctggctgaagggcccttggtccaaagtcaggatcagaaataggtcagctcatacatgctttggccttaggaaggtctggtagtctagatacaggtacaaagggccaggcatcatcaactgagggaaacatgggaacaaaccagacagagttgcacagagaacacatcgatcagacgaacgtggcaaccatataatagaactacgatatgggccccgacgcaccacccgggaccttgaacatgacccggccttcacccccaggggaaaaatcactagtaacacctatcacactatcaagctagggacacaccaacttagcgccacacgccgagggaaaaccacgcgaattcacgactggcaatgccatgaaaaacccaagaaagggaccataattaacactgagggatataacatctcaagaaagacagtggaaccaatggagaagggcacaagcaacccaatacgtatccgggccaataacatccccacatcgcccatagaagaaataaaaggaggaagacccaacagatatacacaaaagggcgcccccaagggcgaacacccagaagtaaacaacctacaacaaacccagaacgagagcagcacttaacaaggcaccaagacgacggacaacctcag

SEQ ID NO: 716995 - DNA, 134 bp, Homo sapiens
ttactcctcccggagtagcttcacgagctaagactgctgcaagtcactgccttcacaagtgcagcaacccagcccatgtagattgcctcttactaggcagttgctcaagccatgtatttatcctttatctggag

SEQ ID NO: 716996 - DNA, 192 bp, Homo sapiens
  misc_feature (47)..(47): n is a, c, g, or t
  misc_feature (83)..(83): n is a, c, g, or t
  misc_feature (99)..(99): n is a, c, g, or t
  misc_feature (142)..(142): n is a, c, g, or t
cttggacatggctacttatcggtcattcccgaatttgaataaaggantttagatgtgggcaacatgcacagtgctagcttggnttgccctttcctctanatcctggggccctattcttggcagtttaacattcatcttaagnccaagcaatacatagctcacaagattggggcctcttgtccttcagggtca

SEQ ID NO: 716997 - DNA, 156 bp, Homo sapiens
gggtgtgtgtgtgtgttacatcatagatcagtccagtggtgccttcacgggtgctgtgggatagtagatacatatataaagtgccttaaaatgcctaacacacaataggcacctaataagtactgatttccttctcttccaactgcatgcgtatat

SEQ ID NO: 716998 - DNA, 119 bp, Homo sapiens
tcagtgatgaaccttcttaccttcactgtcttgcagatataccgacactgtcacttgaccaatactgaccctctttacctcgcccacgcggaccacacgccctccgtgtagtcgctttg

SEQ ID NO: 716999 - DNA, 174 bp, Homo sapiens
tttggagacagagttttccggtctttaattggcccagggtgagtgcaattgggcggtggatccttcgggtcaacaataaacttacaaaccttcccgggggtttccaaaggcggaatttccttcaacgggccctttcaggcccttttccccccggaagttaaggccttgggggac

SEQ ID NO: 717000 - DNA, 862 bp, Homo sapiens
ccgggaatgtgcgctggctatgacatttatggtcgctcgagtgaacgctgacaacgatgcgcttttacgggcattacaataactctcataagcaggaagccataactgacggaacaatgaaaaaacctccgccgtggttgaagagaccagggcaggccgtggacaccacgtctacaacctgtcgcaacagaaacaaaagagtaagaacaataccgcattgattctcagcgcggtggctatcgctattgttctggcggcgggcatcggtttgtatggctggggtagacaacaggccgtcacatcagaccgccaccagcgatgccctggctaaccaactgacgcgccattgcaaaaagcccaggagcagccaaaaagccgagctggaaggcatctcattacgcaacaagctgcacaacttaagcaggcgaatcgtcagcaagaaacgctggccaaacagttggctgaagtccaacaaaaggtcgccaccatttccggcagtgatgctaacacctggctgtggctcaggccgattttctggtgaaactcgccggacggaagctgttggaggcgatcaggacgtcaacgaccgcagtgcagcgttgctgaaaacgtgcagacggccagcctgccggatattgaatgacccgagtctgatcaccgtcgtcggggccatcacggatgatatcgcaggcctttctgaagaatcgaaggttgcacttatgacggcatcatcctttacgcttaatcagcgtcaatcaggcacatacctgcgtctgggcgctaatggccccgagcgtcgccacgcacttcaacgccacaactcacacgtcccacagcggagcggctccacacgcaacacacg

SEQ ID NO: 717001 - DNA, 697 bp, Homo sapiens
  misc_feature (26)..(26): n is a, c, g, or t
gaggacatgaaaccttgaaagccacnagctagacgactgaccatattacgccaaccttggcacgagggattgacaatgccaccgggagcgatttcgggtataccacgaatgctgttcatgtggtgtataccactggctgccggaattacgcccacacagactgcccgggtcatgcagattatgttaagaatatgatcacaggcactgcacccctcgacggctgcatgctggtggtagcagccaatgacgggcccatgccccagacccgagagcacttattactggccagacagattggggtggagcatgtggtggtgtatgtgaacaacggtgacgctgtccatgactctgatatggtggaactggtggaactggagatccaggagctgctcaccaagttaggctataaaggggaggagaccctgttcatagtaggctctgctctctgtgcccttgagggtctggaccctgaggaaagcctaaattctgtgcataatctattgggtgctgtggacacttacatcccagagctggcaccgaacctggagaaaccttttctgatgcctgtggaggcagcttactccgtacttggacgtgacaaccgtgtgacaaggaaattagacctgggcattttatgaaggtagacgagtgtgagcctcttggactttctagaacattcgaactgtagttaaaggca

SEQ ID NO: 717002 - DNA, 1331 bp, Homo sapiens
  misc_feature (1113)..(1113): n is a, c, g, or t
  misc_feature (1116)..(1116): n is a, c, g, or t
  misc_feature (1128)..(1129): n is a, c, g, or t
  misc_feature (1164)..(1164): n is a, c, g, or t
  misc_feature (1226)..(1226): n is a, c, g, or t
  misc_feature (1235)..(1235): n is a, c, g, or t
gttgttatcttccttattttctccctcatgtgtttttcatacctttttcctctgatgttctatttttggacaatactatttgattctatactactgtgtattttcatatgcttcgctacatagacatgtgttcttcccagtggttttggtttcactgttattattgtgcccatataccgttgcgggcacatatatggccaactttgtcatgctttatattgcttgtttcttgacctagttctttctccaattaaatttgtttcgttgccctttccttatttattatgtctccggtgcctacccagtttacgtatgatgtcttactatgtttccagctgctctcgttggacccagacaatcttctgagagcaatggctctacattttccggggtaaaccctcgccattgccaaatgctggtatcgggttcacactttcctttgtgttatctcatttgcctcaaggtatgaacgtccattgaggtatccacagcccgggttctgggttgatgtgctgcgctctggtaagcttggagtcttgtaataaccctgcttgcagctaaggatcccggctactagtgggttctcactttctactttgtctcctccagggctatcatgaatggcgccttctgcgttgacagtccatgctttgatgacctgatggtgaagaaatcttggcggcagtactcaggaagatgcctgcgccggcgggttggggggtactctgagtacgctcagacagcctagcaagcagtgaagtccccgactcatctgcttgagtcacactgatgccacccgggagtctatggtcaaactctcaagtaagctcgagtgccgatgagcttcgccggggaattcggcagtcccagcacagatgccagtgccagtcgatgtcctacggcaatcttcgccttcgagggcattggagatgaggatctgtaatgctccactgcttggatgtctgccctgctacccgcagaggaatttacagaaacttgccctgtgtcctgtagtcccccatgctaggggcggagggcgtcgttttcacgttgcttgctgttccgtacgctacccgctgttgctacgtggccacggggcctcgtatcctaccnttnccgttgtcaccnntgggctggctgcaacagaggattgccccttctctnttcagagctggccctcgatgccaaattagcatttagtattttgcacaaagtctaaagggacnatggctgcntgccttggggaggaacatatctccctctgggcagcttctggcctcttggagccatgggccaaaggccataaaaggaaccgagagaggtactagtgt

SEQ ID NO: 717003 - DNA, 300 bp, Homo sapiens
cattaggcactttgatgttgccatgtcagcacagctgccaccagcaatttctctgctgtccgagacctctgtattgtcggaatgtcccaacatgaggcctgtctcatccacactctgcaaacccaacctgaggctgtgaaatgtatgttctatgctgatcatcaaagcatgcaacatagtctgaagggtcagacctgccgacttctgcttcgtgacgaggccacccacatctcaccggaagccaggaatctctctgctccagctatgaggcatctgtaccttctgtgcccatttccaccc

SEQ ID NO: 717004 - DNA, 153 bp, Homo sapiens
cgacgtccataacgaaccggggaccaccccggaggtggcgccgtaacgcgcgaactggttaaccgcgtagagcggtcccagttgccaccgcggggtccggaggtcatcggtgtctggccaccggggtcccgacatgcggcgcgggggcggccg

SEQ ID NO: 717005 - DNA, 282 bp, Homo sapiens
tgagctcacgcctgtaatcccaggactttggcaggtcaaggcaagaggattgcttgagcccaggaatttgagcccagcctgggcaacatagcaagacccagtctctagaaaaaaataaaaaattggccaggtgtggtgtgcatgcaggtggtcccagctacttgggagactaaggcagaaggatctagaggtcaggctgcatgattgcaccgccacacagcagcctgggcgacagagttagcccttgtctcaaaaaaactaactaaatatcattcaaatata

SEQ ID NO: 717006 - DNA, 578 bp, Homo sapiens
cgttgctgcagagtgactcgagaggatccccacccatgcgaagagtctggacggagactaggaacggcatcacacttggaatgccagtgatcgtctcaggtctatgagttctccgacgacttcatggtgatggtggtctcagtagcatctgtcacatgagcccttcttggtgggctgacattctccagattggtgatgggaaaatgctgtgggtctgcttgtcaaagtgtccttaagagcatagacactcacttcatatttggtggccaccataagtcctgatacaaccacggatgagctgtcaggagcaaggttgatttctttcattggtccggtcttctccttgggggtcacccgcactcgatatccagtgagctgaacattgggtggtgtccactgggcgctcaggcttgtgggtgtgacctgagtgaacttcaggtcagttggtgcaggaatagtggttactgcagtctgaaccagaggctgactctctccgcttggattctgagcatagacactaaccacatactccactgtgggctgcagccttcaatagtcatctctgtttgatctggaac

SEQ ID NO: 717007 - DNA, 3195 bp, Homo sapiens
  misc_feature (100)..(100): n is a, c, g, or t
  misc_feature (134)..(134): n is a, c, g, or t
  misc_feature (143)..(143): n is a, c, g, or t
  misc_feature (263)..(263): n is a, c, g, or t
  misc_feature (707)..(707): n is a, c, g, or t
  misc_feature (709)..(709): n is a, c, g, or t
  misc_feature (818)..(819): n is a, c, g, or t
  misc_feature (863)..(863): n is a, c, g, or t
  misc_feature (890)..(890): n is a, c, g, or t
  misc_feature (899)..(899): n is a, c, g, or t
  misc_feature (903)..(903): n is a, c, g, or t
  misc_feature (1409)..(1409): n is a, c, g, or t
  misc_feature (2496)..(2496): n is a, c, g, or t
  misc_feature (2501)..(2501): n is a, c, g, or t
  misc_feature (2528)..(2528): n is a, c, g, or t
  misc_feature (3165)..(3165): n is a, c, g, or t
tgaggcttaaacacctaatccttataaccaccttgaaggtaacaattcctcccacttgacaaatgaggaagtgacgcccagcaaggttcagacatctgtnctgggtctgacagcaaataagtcaccagccagtnacctgagcngccggagccagtttcttcatgtacaaaactgggggtgcagaggttgacggggtgactaatgagggcacacaaacctgaaggaggcccgggctcggtgtgacacctggctgcacccaacanatttaagttccttacttccctcccctggcacaaaggagccgagctggcacagccaggggcagtaacggagctgcgggggaggctggcagggaaagggaaacgcttccccagcccagactctagctccctctggctgcggggagccaaggccccggcccattagtcggtccttctggactggaagcaggctggtcccgtttgtttccagggaaagcgggttaggactgcctgtggaaggccccgttgcaggctcctcacaaccccagtggtagacattattccccccacgcagaggaaatgaaggctccgtgagtaactgacacggcgataaaccaagtctaacttggctcaagatcttttctttgctgggaggggctggtgaggctgcagcagagggtcccccaagctttctggccaagcgacctgggtgggtgtccgtgactntncctgctcagggcttgcctctagctgcctccgaaccctacccttttccaggctggtggcccaggggatgcaggaacagctctagtctactaagctgaacccggactcaannctaacgcgtgcccccaccgccttgagggttgggatgggcctgtnactaggccacctccaaggaaacaaatncctcttccnactnacgtcccgccgggacattcaggggcctcagcttgaagctagactggagcaatcgccaagcaccgctcccctgcaaggcagcacatccagagcgaaacaaagagtcaagggttgtggctcctggaaccggcattccctctgtccacagccgccccaggactctgctgggccggggtcggggcttcccactaggggctcccaagctacgagccaagaacccacgcagatgaaggtacggtggggtgcaggggcagaaagaggagggaaaatgggccggccagaaagccgacttggaaccctgcagtgtcatcgcagccaagtgtcttcacctcgcagggcccgagtcctcctcggtaaatgagtccactcggtcccatggggcggttgggtagctttaacaagccagtgagccccgggtcaccgcactctcctcacaggtgccccaacctggcgtccgtcacgctctcgggctgcggccacgttaccgacgactgcctggcgcgcctntgcgctgctgcccacgcctgcgcgcactgcgcctggagaactgcgcgcgcgtcaccaaccgcacgttggctgccgtggcggcggacgggcgcgcgctgcagacattgcacgtggacttctgccgcaacgtgagcgcggccggcctgcgccgcctgcgcgccgcgtgcccgcgcctggccctgcgggcagagcacagcgccgccatgctgcccgaccagcccccgcgcccgcgcgcgcccgccgcggccctcggcaagctgctgcagcgctagacgccgccccgccgctgcccccggggaaggagcgcagccccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttggaaaacactcggctggttctcactcaacaccaccgcctttcccctcttgcttccgccccaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagctttngatantggaaccattataagctgacaagctanattttcacctgtggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaatacaaaaaattagccgggcgtggtggcgggcacctgtagtcccagctactcaggaggctgaggcaggagaatggcgtgaacccgggaggcggagctngcagtgagccaagaacggccacggcacccc

SEQ ID NO: 717008 - DNA, 191 bp, Homo sapiens
accctgagtcccgatgtattccctgctgatttgacctactacccaagtctccctgataaggattccagttgggggttaaattaatttatttctctcccccctccctttttccccatgagatgataagtgttctttttgtgcaccaacagactttaataacttcaaaagcaatggctttggtctaaccaggg

SEQ ID NO: 717009 - DNA, 3202 bp, Homo sapiens
  misc_feature (778)..(778): n is a, c, g, or t
  misc_feature (848)..(848): n is a, c, g, or t
  misc_feature (851)..(851): n is a, c, g, or t
  misc_feature (953)..(953): n is a, c, g, or t
  misc_feature (1416)..(1416): n is a, c, g, or t
  misc_feature (2503)..(2503): n is a, c, g, or t
  misc_feature (2508)..(2508): n is a, c, g, or t
  misc_feature (2535)..(2535): n is a, c, g, or t
  misc_feature (3172)..(3172): n is a, c, g, or t
agaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgagtgttgaattttgagttatgaagcaatttcaatgggaaagtgcttgactgctaagaccatgtctataactttacactatgtgaactgttctgtatttttctctaggattttcagtaaaagctaaaccccttacagaatgaatgcataaggtatgcatggaagaatgattgatagggcagctaaaatgttatttactgaactgatagtagtatcaaactttgactgaaaggtaaattaggtgttcacaatctttgaccgcatctctgtcctccaggtgctatgcttacatttgaaaagatttcattggacagcatatttaagaaataaagttgatacatacgtagaatttccactgagaggcctagacatgaaatgctacttactagaggtaaggtggttacctttttagcatggtgaaaaaatggctctncagtaagattgtcatcacatggagagggtagaggtcatcgagatactgatgtcattgaccactgctcctnctnccttgttctgtagcctgagaacagtggcccggagagctgcctgtatgacctcgccgctgtggtggtgcaccatggttccgggtgagtacaacaccagcttcnggtggtgggaatacctgtggcagcccaatgacctgcagttttgtaccactcttgctagttcttcctattttgaaagctgatcttttgtcctcttcagggcttttcccttgtgccatgttgtctccagcaatatatgtggcttctggctcagagcttctgctgaggcagggcctcgcgctgagtcacatggctctcaactcgtgggcctcctcagtcaacaggtagcaagctcttacagaatccccacgatttggagctgcagtacctgggccaggatgaagtgacctcgcagggcccgagtcctcctcggtaaatgagtccactcggtcccatggggcggttgggtagctttaacaagccagtgagccccgggtcaccgcactctcctcacaggtgccccaacctggcgtccgtcacgctctcgggctgcggccacgttaccgacgactgcctggcgcgcctntgcgctgctgcccacgcctgcgcgcactgcgcctggagaactgcgcgcgcgtcaccaaccgcacgttggctgccgtggcggcggacgggcgcgcgctgcagacattgcacgtggacttctgccgcaacgtgagcgcggccggcctgcgccgcctgcgcgccgcgtgcccgcgcctggccctgcgggcagagcacagcgccgccatgctgcccgaccagcccccgcgcccgcgcgcgcccgccgcggccctcggcaagctgctgcagcgctagacgccgccccgccgctgcccccggggaaggagcgcagccccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttggaaaacactcggctggttctcactcaacaccaccgcctttcccctcttgcttccgccccaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagctttngatantggaaccattataagctgacaagctanattttcacctgtggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaatacaaaaaattagccgggcgtggtggcgggcacctgtagtcccagctactcaggaggctgaggcaggagaatggcgtgaacccgggaggcggagctngcagtgagccaagaacggccacggcacccc

SEQ ID NO: 717010 - DNA, 104 bp, Homo sapiens
ctttcggaaatctaagaatatcctctttgtcatcacaaaacctgactgtctacaagtagccctgacttccagaatactatacaatacgttctttaggggaacgc

SEQ ID NO: 717011 - DNA, 802 bp, Homo sapiens
ccggttaccgggatatctggcgccatcgtccttcttgtgaggccaagcgctgaaaatgcgaagcagagaggcaggaccaataatttgaggcgaatccgaggaacctgacaatgggtctccgggtgcgtgtctctgaaactggaggatatcgggaggaaaggctctccgagtgcgtgagataactggggaagctcttggcgatggtaggctgtaggtacgtgataccggcaggagtcaggagatcaaatatggatacgccgactttttagattcgaaggaagcccttttctgagaacactttgccacaatgaaggtagatataaggatctagtttgacagctactaacgaagaatacacgacatcagtttgagaaagaggctctatcagaacagacacgaagttctgctaaaattgaagccaagagacaaacatcaaatatatgttgagcacttgggatgggaagaatgggtgaactagattgagtggctttagtgaagaagttggatagggagcagtgctccaaagaaagtcagtttacaaatggataactcgcttttaagaaggccataaggtaactgttgcaacgaagaagcccacaggtggccagatcatccacatcgagtttgtgaggaagaaaaggttagtgtcatgtcgtaacttgagagcaaaagccaaccaattaacagcgagaaagcaacagccaaggaccatagacatctcagctggttcaccttactcaatgttgactggaaaagcttcagcaaactttatacctggataggtaccaaaaccattggcccc

SEQ ID NO: 717012 - DNA, 3072 bp, Homo sapiens
  misc_feature (778)..(778): n is a, c, g, or t
  misc_feature (848)..(848): n is a, c, g, or t
  misc_feature (851)..(851): n is a, c, g, or t
  misc_feature (953)..(953): n is a, c, g, or t
  misc_feature (1286)..(1286): n is a, c, g, or t
  misc_feature (2373)..(2373): n is a, c, g, or t
  misc_feature (2378)..(2378): n is a, c, g, or t
  misc_feature (2405)..(2405): n is a, c, g, or t
  misc_feature (3042)..(3042): n is a, c, g, or t
agaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgagtgttgaattttgagttatgaagcaatttcaatgggaaagtgcttgactgctaagaccatgtctataactttacactatgtgaactgttctgtatttttctctaggattttcagtaaaagctaaaccccttacagaatgaatgcataaggtatgcatggaagaatgattgatagggcagctaaaatgttatttactgaactgatagtagtatcaaactttgactgaaaggtaaattaggtgttcacaatctttgaccgcatctctgtcctccaggtgctatgcttacatttgaaaagatttcattggacagcatatttaagaaataaagttgatacatacgtagaatttccactgagaggcctagacatgaaatgctacttactagaggtaaggtggttacctttttagcatggtgaaaaaatggctctncagtaagattgtcatcacatggagagggtagaggtcatcgagatactgatgtcattgaccactgctcctnctnccttgttctgtagcctgagaacagtggcccggagagctgcctgtatgacctcgccgctgtggtggtgcaccatggttccgggtgagtacaacaccagcttcnggtggtgggaatacctgtggcagcccaatgacctgcagttttgtaccactcttgctagttctttcaactcgtgggcctcctcagtcaacaggtagcaagctcttacagaatccccacgatttggagctgcagtacctgggccaggatgaagtgacctcgcagggcccgagtcctcctcggtaaatgagtccactcggtcccatggggcggttgggtagctttaacaagccagtgagccccgggtcaccgcactctcctcacaggtgccccaacctggcgtccgtcacgctctcgggctgcggccacgttaccgacgactgcctggcgcgcctntgcgctgctgcccacgcctgcgcgcactgcgcctggagaactgcgcgcgcgtcaccaaccgcacgttggctgccgtggcggcggacgggcgcgcgctgcagacattgcacgtggacttctgccgcaacgtgagcgcggccggcctgcgccgcctgcgcgccgcgtgcccgcgcctggccctgcgggcagagcacagcgccgccatgctgcccgaccagcccccgcgcccgcgcgcgcccgccgcggccctcggcaagctgctgcagcgctagacgccgccccgccgctgcccccggggaaggagcgcagccccagaccgtcctggcttcgaacccagctcttccaccttcagaccaccaccgcatattctgagcctcattttccccgtctgcacagtggggataagaaagcctacctcacgttacgattttatacataggataaacgcaagattaaatggatatttggaaaacactcggctggttctcactcaacaccaccgcctttcccctcttgcttccgccccaggctttctgctgtgcgctccccacggaggcgggaggcgcctgcaccgtcctcggggactccgatcgccgttggaccgaaatcacctcggtggggaggacctgaccactcggagttcgccgacttgcgctcgggggtgacgggggccagggctgccgcgcgcaggggtctggggagcctccgggcggagcgacccagcgagaccccgccggctcccggagtgtcctggggaccgccacctccaggagccccggtggtgatctcggtgaagcaggaggaggggaagcaggggcgcacgggcagaaggagccaccgagccgctcctccttgcggttttgcccgcacgcgcgtctgcccgcccacctttcctggggcggatgcgttcccgcagtgaccgcactcgcgattgtagaaaattcgctcccaattgttgaatgcttacataaactgcatagttacccatattttctactgttctcataagggaaaaagaaatgatttggaagaaaaaaaaagcctcaaactaaacaaaaacaaaaccagcagccctggctaagctttngatantggaaccattataagctgacaagctanattttcacctgtggatttgctggacatgagcacaagcctaggcttccaatttgaatttcagggctgtagtcactgatgtgtcacatttagtgaaggctctcggccccccggcagccgcctggtcctgggtcactggggagaattctgggtgggtggaagaggcgaggagcactgtgatgggcgctgttcacactccggctccacccagcgccagctgcgacaaagccctttacccctcccaggccaggtgtttcttctgtgtgaaagaggagcttgatccctactcacaggttccttaattcattgctcaaatagggaaacggcaaggaaaaagacaaattctgttctcatgaagcttaccttctagtgggggaagagacaacaggtaactggtatataagagggtagaagggccaggtgcggtggctcaatgcctgtaatcccagcactttaggaggccaagatgggcgattcacgaggtcaggagatcgagaccatcctggctaacaaggtgaaacccccgtctgtactaaaaaaaaatacaaaaaattagccgggcgtggtggcgggcacctgtagtcccagctactcaggaggctgaggcaggagaatggcgtgaacccgggaggcggagctngcagtgagccaagaacggccacggcacccc

SEQ ID NO: 717013 - DNA, 632 bp, Homo sapiens
ggaacgaacttcatcggttcttaacaatcacaactcaagataagaaacaaattcgctatagccgcaacggcagcaaacatgattacacgggataacactgtcgcagctcttaaaacctacagaacgcaaggataaaaggattccatatctaagcaggctccaactcaagttatagtacaacagctgaccgcctaccgcagagatcactatgggatgatgctcgtggctttaccccatcgctggattaaacaccactactttatgattcgtggccattggccatggctgctgcagcattctctagctcagagccaggcgcagacatggcacttccattaccagcatctagaagcggagctgattgcataacttgaagaggtacaggagattttgataggtccctcaagaggcccttatttgcccacatgaggccacaggcattgcatagtgttcttggtccatcgggtccacggcgcatcatcggtgtagctgttgcattagtaccacaatgatgacattcggcagcagatggaggtcggccttcaactaatgcccaattgggggaagcatctacagctgtcatttctgatgctgctgctattcatcaagctttggttctgagaatgtaactg

SEQ ID NO: 717014 - DNA, 142 bp, Homo sapiens
cgagcggttatctttttacctattcacactgatgtgtgtatcctgctaacagtacggtagactgctaccagaatgtcgtccatattatcatatccttccatgaaagcgccctttaaaaaacaacattctgtgatagagactg

SEQ ID NO: 717015 - DNA, 434 bp, Homo sapiens
tacgaatcgagctctgtacctgcatacctgggcacactagaagagcatatgggaggcagggttgggtgtgggtgcacacaaaagcaagcaccatctgggattggcacacgtggcagagccagtgtatgggggtatgtgctgcacttcccagggagaaaacctgtcagaactttccatacgagtatatcagaacacacccttccaaggtatgtatgctctgtggttcctgccctgtcttcactgagcgcagggctggaggcctcttagacattctccttggtcctcgttcagctgcccacggtagtatccacagtgcccgagttcttcgctggttttggcaattaaacctccttcatagtggtttagactacacttacaacaaggaaaatgccccttcgtgtgaccatagattgagatttataccacataccaca

SEQ ID NO: 717016 - DNA, 165 bp, Homo sapiens
ggcagatggggtaggtggagtagagggaacttggcttgcacagtcacatcctggctgggattcgtgtagtgcttcatgtggcatgtcacggactctgcaggctagagtcactgtgctgaccggcagtgacagctgactgcacgagatgtacagtcccccggagtc

SEQ ID NO: 717017 - DNA, 733 bp, Homo sapiens
tgtctctgatgttgttccctgcatttctatcttcctcgctgcccgttgttgagtgatagtgctttcagcccctagcctggccagtccgctccttccgggaggtagctcactgtggtcagtccccgcaccggccagccgccccgcccgggagtcgagatgggggcgcctccgcccggccgctgtcccgtccgggaggtgggggttcgcctctgcccggccgccccgtctgggaggtgaggagcccctctgcccggccaccaccccgtctgggaggtgtacccaacagctcattgagaacgggccatgatgacgatggcggttttgtggaatagaaaagggggaaaggtggggaaaagatagagaaatcagattgttgccgtgtctgtgtagaaagaagtagacatgggagacttcattttgttctgtactaagaaaaattcttctgccttgggatgctgttaatctaagaccttacccccaaccccgtgctctctgaaatatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagggtcgtctgcctaggaaaaccagagacctttgttcacttgtttatctgctgaccttcccaaaactactgtcctatgacctgcc

SEQ ID NO: 717018 - DNA, 367 bp, Homo sapiens
  misc_feature (1)..(1): n is a, c, g, or t
ntgcagcctgctgagtagctgggattacaggcgcccgccaccacacccagctaatttttgcatttttagtagagaaggggtttcaccatgttgtccaggctgttcttgaactcctaacctcaggtgatctacccgcctcggcctccaaagtgctgggattacaggagtgagccactatgcccggcctacttttggttttattgatttttctctgttgtctttttgctttcagttgtgttgatttctgcttttatctttatttttccttccctctgcttgctttgggtttattttgttctttttctagtcttgagatgagagcttagtttattgatttcaggctttccctaaatttccctctcagcag

SEQ ID NO: 717019 - DNA, 663 bp, Homo sapiens
gcacggctccaacttgcagacggcctgttgtgggacacgtctctgtaatcgcgaaacgcaatcatggaagacctgggggaaatacaccatggttttatccacccgtgagatctttgaagcaacgttcatcatcgtcaagcgatgtgtgagggacggcatctgtgaactgtgcactattgtctagtcctcgagtccggccgggattcttcatgctacgcattggcgagtacccctaggcatgagctactgtctagacctggcagtgacaacgcaccgcagtagtcatgattccggtcttcgaacgatcgcgcacactcacctctcatgggtggaacggcgggacgaatgactgacatgactgggtagccggatgctacacaaatgacagggactcggacggctagacgccatggtatgatgtagccaagcccagggcaacacaagtgaccaggggacatctaatccgacgccgttgataggctcgtatcgtcagaacacaggaagtcatccctgtacgcgtcataccgcgacagtacgttcacgggagcggtggaggcccggggccggtagagagtaagagtgcagggacgcacgtcatggcagtcgcacactaggcaggtgatccagccagacacttatgcgattgctgccacgcattgagcg

SEQ ID NO: 717020 - DNA, 889 bp, Homo sapiens
tattcacaggattacccgtggcattcctctactgacttcctgcgagacagcaagatgtccctccgaggacgtcagaggcctagcgtcaaagacgttcctggtccggtagtgacttgcgacacggaacgtccagggaccctgcagtcggcacttgcatgaggatggcatcgcaatcctgaatggctgcaggatactgctgcggtgcagacggtctttggcgtgcgtcggcaccaggacctcagggagacatggccacgatgctacagctaggtccccctcctcacaagccagcatcaaggtagacacttaagacttcaccccatctccgtgaaccgctgcagagatatcgtgtgtaaatgacttggttcttcgagatgacatgattcctgccaagacactggtgcaagtggccatctatgctctgggccgagagcccaccttcttcttcgacccggataatctttgacccaacccgatggctgagcaaagacaagaacatcacgctacttccaggaacttgggctttggcctgggcgtgtgcggcagtagtctgggatcggcggatcgctgagctagagatgaccatcttcctcatcaatatgctggagaacttacagtagttgaaactcctaagcagcctgcagccgatgtagggcaccaacagttcaacgctcattcctgactgcctgaaaagcccatgctccttcaccgttctggccctttaaccaggagagcaacccagcagtgatcagagaggatggcctgcagccacatgggaggaaggcccaggggtggggcccatggggtctctgcatcttcagtcgtgtgtcccaagtcctgctccgtttctgcccagcctagctcagcagttgaatgggttctcagttaa

SEQ ID NO: 717021 - DNA, 239 bp, Homo sapiens
gaaaaaaaaaaaaaaaaggtttcccgtattttaaactttgggcttggggtttttaccatgtgccaatttaggttcatcatttgtaacaattttaccacgccggtgggggatgttgatattgggggagtttatgcatttgtggaagcaggggagatacggaaaatctctgtcaactcctcttaatatttctgtgaacctataacttctttaaaaaaaataaagttcttgaaaaagtaaaa

SEQ ID NO: 717022 - DNA, 109 bp, Homo sapiens
tactgacgactcttctttactttccttttttcgtaaccaccactgtaacacaactttacgacaacggtacgacgccgacgggggactcctctacgacgtcgacccggac

SEQ ID NO: 717023 - DNA, 1303 bp, Homo sapiens
gcgcgtggcccttgtggggcgacacacagggttggctatgcaccgtgggacacagtgtgttgggcgccataggtcctttaatgtgtatttgcgccacccattcgtaaagttgttggggagacctcccacgggatgctttcagcgcggttttgtccacgaaccaaatcttttaggggggcgtacccggatggcgttttttggttgtcgtggaaagggggtggggcccctgttttggtagacaccctggcgaaaaccgccaaggtcttggcattgtttccacgccagggtttgcgtgaaatggcccctgtcggggtgaaaagcgttcttggggaccaccactctcataggggacagcgaacagtagtttgttttttccccgggacacccgctggggagtgcccgccactctgatggaccaaagggttctttgggggggctttgcaacaatacctagactccgggcggtgggaccgagcacaccggggcccgtgccaccctgggggggacccaacagtggagagttcccccgcgaggagtcaaagacgctttctgggaaaaaggaaaatggtggagcccgaaagggtcggggaagacccacagggccacaaacgggagaccaacggggctccacaggggcaaaagaatgggaggcacaacgcagtggtgcccacgcggaccgccacagaggtctgtggagacacaaaccctggactggaaacaggagggaaagagcggggtgataactggccgcgggccgcctcgggggccctggcccacatgactcgccccgtcgggagttcggcgcccaacacaacccggtggctggactggtcgaatccagggcacaattcccgcgaagggaccccctgaaggccttgtccgaagaaaagcctggaaacccacccaatgctctcgacttgcggcggcgagcccagagaaagaggggccctcgctgcgcttttgtcgtcacacctggagaacacccacacactcgcggcaccttccacacgagggcccacgcgccctcggtgtggtgtgcttcttgaaggcgaagaaggccacccgagaggaagctgctggcctatcgaataggcgtgcgggcacagcgcttgaaggccctgctgtccctaacacctgagagcggcaccttttcaagcggctcacgcacggagccctcccacaggcccccgcttttcttggaactttcctttggcacaacatgaagcttcctgtgccggccaccgcccccaccccctggggaacccataaaggcgcatctgcccttagccaaaaaaaataaaaa

SEQ ID NO: 717024 - DNA, 873 bp, Homo sapiens
gggctggggcccggaagctgggaggccgcctgactcgagctccgccgtgcgggcccgactggtgagtccagcccggcagtcgcaggacccggccgcagccttctccctccacctctccctgcccccagcgccaggccgcgggctgcgcctcgtgtggcggttggggggcgcctcaggcggccattgggggagggcgtccgggggccggttccgggccggcgctggcttggagggcgctgaagggaagcccgtttggaagccgcgcggcgcacaatctgggccgcagcacacgttgcgagggaagacaccccggcataaacgagacgaccggagaggaggaggagttacacggcgagaagtggggaatcggagaggccgccgactagttaggacagagctgcacatacggggggacaaccgctggagcttgacaccccagggtgggaatacccgcgcgtcgtgggaggtgggggcccccagcaaaaactaccgataaacaccccgtggggagggagggcatccgccgcggtaacaaagatggggttgtttcccaccccaaaacgacgtgtggggggtggcaaccaactctctccagtatcgtgtgggtcacccagagggagggcacccacccgtgataggaaggggggaaccagaatgaggtgtggagaagcttatcccgccttttgattgttgggtgcgcacccacggggggcgacactgttgtaaacaaattatctacccccgatggagtacacgtgggactgtcgcctatcattgggatggggacgaaaacaacacgacgcctgggcaacgaaacaaccagcgtcggtgtgtgtgtcccacgtgtatgaagggggcagagctcatttagga

SEQ ID NO: 717025 - DNA, 374 bp, Homo sapiens
  misc_feature (105)..(105): n is a, c, g, or t
  misc_feature (107)..(107): n is a, c, g, or t
  misc_feature (114)..(114): n is a, c, g, or t
  misc_feature (140)..(140): n is a, c, g, or t
  misc_feature (145)..(145): n is a, c, g, or t
  misc_feature (162)..(162): n is a, c, g, or t
attcattcaacatggcggccagtgctttcaaaaaacatgaagtcaatgaggaaacaggcaccaatcattacagctttcattttaacatcaaggtctaaagggaantngattccnaagttatcagcgtctgtaaatgcctntctcnaaattccagtccagtcnttggaaatttgccaaccacacactatcatcagagattataatgctcgaaaatcaacagtctgccacagacagctgacacacaagcacatggaccactgtatgttctagtacatcctctcttttctcattttgaattgtaaactttggtagacatgggtgccaagtgatgaataacataacctaatggacaccggaggagcttggatttctat

SEQ ID NO: 717026 - DNA, 274 bp, Homo sapiens
attcattcaacatggcggccagtgctttcaaaaaacatgaagtcaatgaggaaacaggcaccaatcattacagctttcattttaacatcaaggtctaattagtggtgctgggttcttcccactaccctacacgcgtgctcggacagcattcccgtagggtttcgtgcccaactgcctcccggtcgctcgaggacacacactgtgtagcattgcatacgtggaatgatataaatacaagctttgagtgtgtcaggttggcgtggagctgtgacag

SEQ ID NO: 717027 - DNA, 95 bp, Homo sapiens
gaggtttacttgggtacatggcccgcagtggcttttgccccagaaaggggcaccgcacacgcgggtagatgatttctcgcacggcaggaagtccc

SEQ ID NO: 717028 - DNA, 207 bp, Homo sapiens
cgagctgcatcagctgaagcggaccctcttcatcaatggaatctccaaatatgcagagtctagaaaagatccacgaagcattttgaggaagcctatccccaatctgcacagcttctcgtaagcccgcccggtgttacaatcgtggctcgcctcaatgttcctcgtatgcagcagaggaaccaaggcgcgagcggggaaacgctgtac

SEQ ID NO: 717029 - DNA, 1013 bp, Homo sapiens
  misc_feature (240)..(240): n is a, c, g, or t
  misc_feature (286)..(286): n is a, c, g, or t
  misc_feature (314)..(314): n is a, c, g, or t
  misc_feature (316)..(316): n is a, c, g, or t
  misc_feature (397)..(397): n is a, c, g, or t
  misc_feature (525)..(525): n is a, c, g, or t
  misc_feature (556)..(556): n is a, c, g, or t
  misc_feature (766)..(766): n is a, c, g, or t
ggcggggacttggctgggcgacgtggacacccaagccaattaaccaaaaacttggaaggcagaaagtgggtaatttttgggtgtgtcacaccttcttgggaccacgcgcggacatggagattcttacagatagacacacaacaaacacggttggcgcaacatgggtcctggaaggccagcagatggtgtggttccaagtccagaggggcatggtttggggacagcctgggcagagttagnaccaggggcattcattctcctaccagaggtgtggtgagtcatctcncaacacacgtattacaccccacacatcntnttccagagtggcgcacgcacacatttaggcacacaggcagacgcacaatatctcataggcagagtatcaccctgtggcggnggggcccccagacacacacacacagacgcagacgttgagagtgtcgcagagggaaacgcccgcgttatacgcagagcagaggcccccgtgacagagtggcgcagaggaacactcattctcgcagaggntctgcgcataccttctcagaggtgacacacntattatccctttacagagcacatatacaggcgctcagggacacacaccctctttgttgtgacacacggcgtctacactatttatgttggtggttggagcaggcacaccattgtgggatatgccgggggtgttacccatctacaggcagattggggccacgttttcctggcacattgtgcagccatatgagtgccacagagggctcggccnacgttggatacgtctccaggcatatatacaaaaccctatgtgaacccaatgtgggcgcagatgtgaacccagcgatttggaaaagtggggcagcgccagatatccggcgcaggttgtggcagcaaatttggacccggtggtttaacccccctggtcatatggtgggtgtgccccatatggggccacaccctggatcccaagggggatgacccaggttaagaactcaacgtaggaggacctactaggc

SEQ ID NO: 717030 - DNA, 618 bp, Homo sapiens
agaatgtgaaggtcagaagggcaccttgcattaagcacatgatttacagctgtgatggtttagcatttgctctgctacttgagataatggagagcaggttcttttaactcaagttacagtcgatcctgggagagcaaggagccagcaagtctagacattccagagccacaggccctggattctatccaagccacgagggattttatgccctgggcttagattatggtgcgtcagggcagccttccaccctttagcacagagcttggtgttccaaagaccacaaggggttttagacccttgaccctggacatattccaagactcttttacattatgtcagaatgcaagccctgcctcagcttctcccaacactcagcttttcgcaacataatcccagcactttggaacgctgggtggattgcttgaacccaggagttcgagaccatcctgggcaatatggcaaaaccccatctttaccaaaaataaagctgggtgtggtggaacatgcctgtggtcccagcttcttgggaggctgaggttgggagattgcttgaaccccggaggtagaagctgcatggggccatgatcacgaacctgcactccagccctgggcaacaga

SEQ ID NO: 717031 - DNA, 294 bp, Homo sapiens
actagacagatcaaaatgtagtaagacggttatatcaccaattaaacgccaacatattgactcttagtagtgcatgcttgaagcacacattatgacacaacatcccgaagatctatatcgggtaagctgctcgatcaccacgtttcaaggtgtatctagtgatattggagagacttcctataccctgagtactagtcagtgactcacattattattttcagagcagatagttcaacaacctacctagatctatctacctcaatcaatctgccaggtcaacgaagcatcgggtca

SEQ ID NO: 717032 - DNA, 409 bp, Homo sapiens
  misc_feature (7)..(7): n is a, c, g, or t
  misc_feature (62)..(62): n is a, c, g, or t
  misc_feature (64)..(64): n is a, c, g, or t
  misc_feature (111)..(111): n is a, c, g, or t
  misc_feature (127)..(127): n is a, c, g, or t
  misc_feature (199)..(199): n is a, c, g, or t
aacgtcncccccatgagcctgagaggcacagacagctgctgctgcgggcccgtgcgcgccanantgctgtgacagggcagcgccgcgtttccagccctcccctgctcgcangttcggaaactttggncctgtggtgacttcttcacctcacagcagagagatcaagcgggagcagaggctcaggtccgaggctggtgangagccgggctgagcgtgctgcggaccaaggccatgcgggagaaggaggagcagcgggggctgcgcaagtacaactacacgccttgcttttgcgggcggttttgcgcccctccccgatggctgcctcctgcagggcactttctacgctcgggagcggctgggggcggtgtacgggttcgtccgggagggcccctgcaggagcggactgggc

SEQ ID NO: 717033 - DNA, 804 bp, Homo sapiens
ggaaaaaggaaaaaaaaaaaaaaaaaaacaaaagacaaaaaaaaaattaagggtaatttccctcaaagaaaaaacccttcccccaggggttaaaccgaaaaatcacggggccgggaaatttccaggggcactcaggggcccagggctttcacctggtttccttgacaggggcaaggctccagggacgtgcgtcgtaacccggctgtgggacgcgggggttctcattcctacggtccaacaaggccaccttgggtggcacttccggctccagatgagatctcctttgggtcacacttttggcgtcggtgggtcaccaacttacctacttcggtcccttttggacttttggaatttggaggcaccaaggcgaggggcactcaaggtatttccctttcaggcaggcatttggaaagaaggggagggatgtaccggggaaccaccgtggtctgggagtattgggtgcaacacggcggaaaaaaacgcttcaaactatttcaaaaaaacccggagggatttggaaaacaggagggcgctttagaaccccaaaggcttacggaattagaaattatcgcgtggagcctcctgagatgagaggagccccagcgctatgagagtgcgcctaatctgcggggcgaaggcgatgagaaggggagcgggacaggcgcaagagaaccccgggagaagggaagaaatggccatttggacccgcgcagaggagatgagatctccaggggagagaagagaaaccacggatgagatggcatttccaccccccaggttggacaacaggggaggcgaatattg

SEQ ID NO: 717034 - DNA, 323 bp, Homo sapiens
actgcaatcgtgcctcctggatttaagcaattctcatgcctcagcctccctagtagctgggaccacagacacatgccaccacgcctggctaattttttgtctttttagtagagatggggtttcaccactgttggccaggcaggtcttgaactcctgacctcaagtgatcctcctgccttggcctcccaaagtgttagaattacagccatgagccaccatgtctggccactttcctcttttggctcaagattgcttcgactattcagagtattttgtggtcccatacaaattttagtactgtattttctatttctgtgaaaaat

SEQ ID NO: 717035 - DNA, 99 bp, Homo sapiens
ccttgtgtcgcagacagtgagggtaataatgactagtgtggttgattgtagatataggtgctgcgagattgtcagttcagagtatgaatctgacgcagg

SEQ ID NO: 717036 - DNA, 268 bp, Homo sapiens
ctgttccgcatttgtcgcatgccgggactttgcggcgatggtggagctgctggggatgttggatgcccggctcggcgggcaattgagctgcttcgaggccctgtggccggagttctacgagctcacgacgacgccgcctgcgcgcagctcgcccatactgccctatggacaggggatttacgcgctcgttgaagcactcggagcagaccctgagtccgaccgtgagaggtttgagcgggttctttcggatgtgatggagagtggtttg

SEQ ID NO: 717037 - DNA, 120 bp, Homo sapiens
  misc_feature (70)..(70): n is a, c, g, or t
  misc_feature (101)..(101): n is a, c, g, or t
ccatccaaacatcttcactgtccagaacatttcttatcaaagctgattttctgtcagctcaatcacatcncttcttacttgaactatcacttctgcctgtnttccagtactgtatcctcc

SEQ ID NO: 717038 - DNA, 313 bp, Homo sapiens
ccatccttccttctctcacgcaactccttgaggtcgtgttgaactgactgactcatgccagccctacatatttgccctttatgtattggagcaacagcgtggaggctgggctgtttacctggatgaaattgaacacttcactgaagtggatgaagaccaatacccattgtgccccatgctcagcatggaactgttggatgagaaagagcctgaagtcttgcaggactcactggataaatgatatattgaatgcttcaggtgtatcttgaactgcgttacataagccaatcctacaacagtgctgattactcat

SEQ ID NO: 717039 - DNA, 121 bp, Homo sapiens
tatatttatatacaggtgaagaaataggataatttaatcaatgtggagtgcttgcgggtgcagtggttcacgcctgtaatcctgacactttgggaggccaaggcaggcagatcacctgagg

SEQ ID NO: 717040 - DNA, 122 bp, Homo sapiens
  misc_feature (101)..(101): n is a, c, g, or t
  misc_feature (103)..(103): n is a, c, g, or t
gcggccgcctactactactactactgctcgaattcaagcttctaacgatgtacggggacatgatgttgattttttttcaatgtggtgcaatatatacaatnanatttgtcataaccaaaaaa

SEQ ID NO: 717041 - DNA, 191 bp, Homo sapiens
tctgatggtgactcttagaggatcccgtaagatcgagctgaggagccagcagcccggagtcgcccccacagcatgtgactacacgaaggcttgggaggatgtactacaagaagcaagcgcaagtggacaccggatggtgtgtccaggagctcccccaggctccctagtccatgatctacgagtgccggccg

SEQ ID NO: 717042 - DNA, 358 bp, Homo sapiens
catatccaagtaagcataaacagtgtatgtaggttcaagagatagtagatgatacttaaattaaaactaccttcactaatatgcttgaactgtcgccttacctatgttaagcatctagactaaaagccaaaatatcattaattgctgccattctacaaacccaaaatgtagtactctattaacctgaaatgtacactagcccagaacagtataatggtacttactgagctatagcatagcagcttagttgttattgagattatttagtcaacacataatggaaccttctttcttctaaaagtagccagtgccacttttaagacgtgcatcactatatgtgatgtacaagttattaccc

SEQ ID NO: 717043 - DNA, 264 bp, Homo sapiens
  misc_feature (20)..(20): n is a, c, g, or t
  misc_feature (71)..(71): n is a, c, g, or t
  misc_feature (84)..(84): n is a, c, g, or t
  misc_feature (89)..(89): n is a, c, g, or t
  misc_feature (161)..(161): n is a, c, g, or t
  misc_feature (169)..(169): n is a, c, g, or t
  misc_feature (217)..(217): n is a, c, g, or t
  misc_feature (230)..(230): n is a, c, g, or t
  misc_feature (239)..(239): n is a, c, g, or t
  misc_feature (254)..(254): n is a, c, g, or t
catcaaggagcttacaagtnagtgggtgggtgtgggtacagagggacacttgggaccaggcggtgcccttnccacacccacctnatttncagggcgagggaagagcagggtgggccaggagagggaggaagggagagagggagaagggctggagtagagtncgcctggnaactggcacggaggggaccgggccaagcaagcagtgcccctccatcanaggagagccaggnagccctttnggtgaggtcgtcttnggatccctac

SEQ ID NO: 717044 - DNA, 252 bp, Homo sapiens
  misc_feature (18)..(18): n is a, c, g, or t
  misc_feature (21)..(21): n is a, c, g, or t
ccccttgggggggggaanccncccagggttcccccaatttcaaaccccggggggggcctttccttccccctttttttgtttccaccccggggggggggggcaccccctttgggggggggcttttttttttttccccccccccccaaccccccttttttggggggcccaaggggggtccccttttgggggcccttcccccggcccccccccaatggtggataaaaccccctttttttgggggtttttttttta

SEQ ID NO: 717045 - DNA, 271 bp, Homo sapiens
  misc_feature (102)..(102): n is a, c, g, or t
  misc_feature (104)..(104): n is a, c, g, or t
  misc_feature (226)..(226): n is a, c, g, or t
cgactcttgaggatcccaatgcagcggactcggatcatgcgggcgcggcttcgggagctaatgtcctgacccttatcgagaaggacatctgtacccccaatngnctggccatcgaccaccgtgcctgagaagctctacttctctgacgccaccctggacaatgatcgagcggtgcgagtattgacggctcccaccggctatgtgatcctaagagtcagagcctgtncacccctctcgggctggcttgtgtaatggcggagcacatttttct

SEQ ID NO: 717046 - DNA, 107 bp, Homo sapiens
tactggattctgggccagtgatgttgttaagggtgagccgacggagcctggagccagtcctcctctgtgcagtcctgagtgaatgtggggccacagccagtgtgtgt

SEQ ID NO: 717047 - DNA, 1721 bp, Homo sapiens
  misc_feature (1041)..(1041): n is a, c, g, or t
  misc_feature (1305)..(1305): n is a, c, g, or t
  misc_feature (1448)..(1448): n is a, c, g, or t
tggaaacggagtctcactctgtcgcccaggtgggagtgcaggggggcaatctcggctcacggcaagctccgcctcctccgcgggtttcacgccattctccgtggcctcagcctccgtggaggtggcgtgggaacgtgcaggcaccgtgccaccagtgcgcagctaatttttgggtattttatagtaaagaagcggggttttcaccagtgttgggcacaggaagtggtctcagatctcctggatgtttggtgagatctggcgccgctcttgggcctccccaaaggtggcggggagattacagggcggtgagatgtcaccggggctcgggcctttttttatttttttttataaaggggatttctttattaactccctgagagagtttggcgggcgtctcaagcgctccacaaagagtgggcgcgctccaggtgtagtgtgtaaccacacgggggaagtgtgcgagattttattcttatgcgcacaggcgcgcagagaaaggtgtacacacacttttgtgtgtggagcgggggtgtgggcgaacaaatgagacacccgcgggggaggttatacagagagagagacaagcgctccccgcggggtgtatatcacaggggggtgggcgcgctctaaaactacacatacagcaggggggggggaaatagtgttaggagagtgtgccgccccagtggtggtgtgcgcccacaaaaaacctccgttgtgtgtaagcgcggcccccaagatagaagagaccagagagaactcacgaggagtgttgagaccatgtgggggtgttcatcccatcccccccaatgtggttgcgagaacggcggggcgagaaattctaaaccaccacacaaaaagggcgccaaacaaacaccactgctcttttaaacaacacgtgggggcgaaaaaaggtcggcccccccaattttggtgcgtgcccaatcggggatggcccaccccccacaaagattggtgttgtgcgcaggggcggctccacatatcgtggggaggcgggaaccataacaacaagcgcagccnaattatgaggcggcggcgcggggcgagagagcttcaaacaaaccatacacaattaaacgcgggcgggcggcccacgcggtgggtggtggcggggcgtcaatatacgtgcctgtagagtagtgcccacaccaccctatcggtgtggcgagacgcgagcaacacaggcgcgcgaggaagaaacaacaattttggaggcgcccgatgtgttgcggcgaaccccatcttcgtggggacacccatgcgggagaaaaccccctctttttntaccaaaaccaatctacaatactatcggtcgggtggtgggcgagaacaaaaccacacgacaaataccaagaccagacacaccacgaagacacaactagagcaagtagaagtaactgtcagaaagcaataacaaattgcgcgtntcatgtttctggcgggtcggaacaaaatacgtagaggagcatgtagcaatcggtcatgacacaccaattgagaggaggagagctgggccctagtggttttaagggatgtgcgtgtctcgtgatctatcgtatcgttgcgtcgtgccaagagagaaaagatagacagaaataagacgacaggagaacgagaatgatgagtagaaagtaaatgaagttagtagatgaataagatacaatgacgatgaagtgaaacaagaaagaaaagagaggaga

SEQ ID NO: 717048 - DNA, 179 bp, Homo sapiens
  misc_feature (160)..(160): n is a, c, g, or t
  misc_feature (177)..(177): n is a, c, g, or t
cgagtctgtctgtattccaagaactctctgacgtcaggtcgtaacatggtaggatgattacaatcctctgaaggtacctttctaaagcggccctccgtttttcaagaaattctgccagaagaaagaatcttccttcccaactttcacttttgtcatcccntatgaggctcttctccngg

SEQ ID NO: 717049 - DNA, 193 bp, Homo sapiens
gtagtctcagtacagatgagctagtgggaggtctggggcgctccagagccccatagaaatttcggagtctgcctctatgagcccttggaagtgacgtattcgccagggttctctcgagacacagaactgataagatgtgtgtgtgtgtggagagcgaggaaggaatagatttatgtgaagaaatgggcttagg

SEQ ID NO: 717050 - DNA, 513 bp, Homo sapiens
  misc_feature (397)..(397): n is a, c, g, or t
  misc_feature (433)..(433): n is a, c, g, or t
  misc_feature (445)..(445): n is a, c, g, or t
  misc_feature (468)..(468): n is a, c, g, or t
  misc_feature (494)..(494): n is a, c, g, or t
gtcaaaagtctttagtggagcctctcctggctcagggagaagacctggaaagggagggggattcactacaggacgtagattgtccccacaagagacagctttacagggccatgtcagaatatgtcaaagaaatatatttttgggtaaagtacttctgtttctttcagggcctgcaatctgtcatgtgatgctatactagagtcaggttgaaatttggtgtcttattgctacaaagtctgttttgtcagtcttgggatctcttttaatgctaacgctggtcagctgtgcctggaattccatagggagaagggcattaattgaggcaagttcgaccccacatttcccatttatgggctttgaactagttttttcaggtttaactttgggaatgcccttngcccaagaggcagggagtcccatttcagtttgggtnggggggcttagnatttattttttcggtttataccntgctttactgatgtttggcccacggngcaatttcatttcattttt

SEQ ID NO: 717051 - DNA, 226 bp, Homo sapiens
ttttcctttttgggccccttcccccccccaaaaacccctttgggggggggggggtttctcccccccctggtggggggttggggttttttcccccccccccccccaattttgggttttttaattttttggttttccaaacccttaaaaccggggccccctttgggggttttttttttttttggaaatttttttttccccccccttttttttaaaaagggggttttta

SEQ ID NO: 717052 - DNA, 105 bp, Homo sapiens
ctgatctcgaggatcccccttcgatacgggatactcctatttattaccttcacaagttttttatctatcgcaggatttttctgagccttttaccactccagccta

SEQ ID NO: 717053 - DNA, 606 bp, Homo sapiens
caatagtttccgcctaattttcaccgccgatccctgtggtacacacatttagcaaaccgcctatggtcatcgccggacattttataattctccccccggcttacaacctccattacaagttggctacaacaaaaatctgatatctgataccactctacaatggcgacttaagatacctcttcttcaaaggacgctactaattcttcgtccccaccaaattgtgctttttgtggtaacttctttagcgcaaaccgttcgctaactgctgcctttcccccccactttttaacctttgtggaaaaaactctttctgtgtagttgaaaacagcttctgcctgtgtcaaaaatatcaccgtgtcctaattttgacagtgagctcgacatattttgttcgacacggccctaatatactctccttgtaccaaaattttaaccacccaccacacatgtggggctcaacttcatcacccccaccaccacattatcaaaacacttaacccctcttcgttcaccccgcagcaacacccccctcacatggtcttgccccttccccccttttcctccttttcccccacccccaacattcccgggttttctttaaaaaaa

SEQ ID NO: 717054 - DNA, 157 bp, Homo sapiens
ggagggagattagtatagagaggtagagatatctagcgtgatagtgagttcactggataagtggagttggcttggcatgattgtgaggagtacgagtcaggtagtcagtattaggaggggggttgtcagggggtcggaggaaagggttggggaacag

SEQ ID NO: 717055 - DNA, 1212 bp, Homo sapiens
  misc_feature (27)..(27): n is a, c, g, or t
  misc_feature (277)..(277): n is a, c, g, or t
  misc_feature (312)..(312): n is a, c, g, or t
  misc_feature (319)..(319): n is a, c, g, or t
  misc_feature (423)..(423): n is a, c, g, or t
  misc_feature (449)..(449): n is a, c, g, or t
tgttctgggttctcgtcgtatgttgantcctcctcgctgcctattgcatttggcacgctcgtgctagctagattaggtcgagcgtcacacttgcctcgaggtcgtaatctgcgctttgaaggcttgtttagtttagtatggttgatgagtctcgctcggtcgtcctcgtctcgcgtgtgttcgtcgttcggtcgtagtgctcggtcgctctccgccggttggtggctctgtgttgtctggctctgtgtctggtgtacgctagctagctaggtaaggngtaggtgtgactgtctcgtctggcatcatagcatnacatgtnttctctacgcgaatattcccgccccggcagtgtcgtagggagatggataccccggggttgctccgcgcttgtctccgtcctggatgttaagctcccgcccctgnccccccgcaggtctcgtgtttagtcncgcccctcctcattagttttggccgtcgggtttgcttctcccccccaaccgccgcgtctggtctcctgggctccgcccgtagggtcctttgtgggctgggggaatcgccgcgccgcgcaaatacttgtttggtgtgccgaaacaccttatcaccaaggtttctcgctgtcggccgtggccccggaccaaaattcccccgcgggttcctcgcccccctattcccgccggggtgggtggggggcaaaaccacccgtgatgcccgccggcccccttgggggaaccagaaggtgggcgcggctacccagggcagaagagttctacaatgcaccacgcctcggcgcgcaatgagtccagacaccccctgcgcgtctgctgcagttagcagaacaaccaaaagtgctgcccgggcgcccaactgcgctgaaccaccgggaaagcacacgcaccatgtgggggagtgcgagagcacagctggtgttgccccaggagctcggcggatattattataagccacgccgcgtgagcaaacaccaccggagaaccccacctcttctttgtgacaaagaccaacaaggtaatgccccggccggcgccacgaagcggcgccaatagtagccccagcatagctacgaggagcgggtgatggcacggagcgaattgccatgaaacgcccggaggggggagagggtcgccacaccacgggggaccccccccccccttttccgggggcacagggccaaaccccctttttctaaaaaaaaaa

SEQ ID NO: 717056 - DNA, 1206 bp, Homo sapiens
agcgggtggcggtggctggcagcggcggttaggggatgtaacggtcgcccgcctccgtgcgtgacgatgtgcggccgtaggggtccggaggctatgcgcggaacgatgcaggtgagaagctgccctctgtcatggcgggagttccggcgcggaggggccagtcctccccgttcccccgcccccaccaatctgcctaccggggcggacgcgactctcgacggcctcccgaggagacggtgcagaacccggggtgtcactcgagaaggtgctttggcaatcacagcccagaacagcagtgggcctaaccttgtgatcccccggccaccagtggccattgttggcctaccttgggccagggctgttgtggtgggtgattttgtgggacccccaaggagaacaaagcaagctagcagcatctttgaaacacccggccagggaaagtcctcctccagtggctctgggccttttcttccccctgattgggaagaagttacattaggtgcacacggcgcgagcaaatgggggcacttagggcccttgctggtgccgcacaatcctatgggcatgctggcagcgaacgcacagaaatccagtgtggcgcgaagacttgcttaggtgccaagcaaatgttaatttggtgttgggcctttgttgtttgcaccctatcctttaacgcccgaaataatttgacagtggcaacacttcggttgttccccagtgggggcttacccgcaaccatttgaccaattggggttgcctccaagacggtactgggcgacacttgggacagcaacgagacaccattcgtgtaaagtgggtacctatccaaagcaaaggggacaaatcctttggcatcagaagctcactatttggcccccctttcataccactttttcttcaaagaaaggtgaaccaagccacaggacgaaattatttggggtcacacgtgggttatggggaaaaacccaggcaccgacgtggtatgaagggaattgcaatggactacctttggtgaaacaagtattcctcccgcaactgtgtgacaccaacacatggggtgacaacgaaagaaaacagattgagggccacgcagtggttaatgttggaagctctggagggaaattaccagtgggtagtcgaagcctatcaacgagagaaacacaaatatctcacaagcgagggggagatggacactagtccggttcg

SEQ ID NO: 717057 - DNA, 227 bp, Homo sapiens
aacttgtcggctatgcaacatagattgtggatatcgagtataagagatcaggtgcgtccattcgatgttgtgtatggctatcatttgtctggaggttagttggattagtcatggctgggtggtgactggtgggttgttgatgagatatttggaggtggggatcaatagagggggaaatagaatgatcagtactgcggcgggtaggcctaatttctctcggaccaatg

SEQ ID NO: 717058 - DNA, 160 bp, Homo sapiens
atttgggaagacaaatggccaataaatatgaaaagaggctatttttactgaggttttccaattaaaaccatagcaatacgccatattataacccagcagtttcatttcaagagatactgttgcaggccattgtggctcatgcctataatcccaacacttc

SEQ ID NO: 717059 - DNA, 386 bp, Homo sapiens
aaaaggggattttaaatttgattttcctccagccccccccccggggtttaattttttttgaaaaaaatcttttttgggcccgggcccctttttttattttttaagcccccccccacctggggggcagtggtggggaaaaacccccggccttaaattttttttgctttcctttctgggaccccaagagagggccaccaaaaggggggggtttttcccccccccccgcctttaggaaaaaagggggttttttttttttccccccccctttttcccccgcccccagggatgggccccttttggggggggcaggggggccccaattgggccccccttaaaaagtaaaaacccccaacaaaatttttttttaatttaatttttggtttcca

SEQ ID NO: 717060 - DNA, 963 bp, Homo sapiens
agaatgatgaccgaacagtgaaagaatgtgccaaggagacaagaagtgtgtgctccggccccagctgtcgtgaagaagcaggaggctagatgagaatgtggtgaactccccatgttatgaggaaatagggcgctaagaacttttggcattgtgacagtgatcatccagtcctcaggaagagacctcagccgctttgtgacaattggcacccgctaatagtcatggttgcagcgtgccagagatgcctaattgctcttatagatggcggtcttgaaatatgtagtccctccttgacgtattatagaccatggtgtcatcccagggaccccttggaaccgtcgcaaaaaccagggcataacttcattctagccttaaagactggtgcccatcgaagtaccatgaccatagaggactaagagtcacatgacggacagaaaggcaaggacgacgtgtttgggccccccgggtgcccggacgacactgacacggcttggcttggactaagaggggcgtacagtactccgaatcggacaggaatgaactcaacccgtagttccctttccgtatgcaagtgcagttttaaagccaaccggatcgatccgagcccttttggcttgaggaggaaaccgagacgcaacaagcttccagactttgcggtgggctgaatttggcagccaacggaatcgatggggaattcccacaatgcggaaggcgttgcggtatgttcctgtgcattggcccctaggcgcccttgggtgatctgctactgaaaactcgcacgggggattccgctcgtttaagcatgtccattttacttcaaaggggcgacaaacagggtcggaatgaacatgggaggatccggtacttacggatgcccagcaagggaaatgaacacttgacgaaccaatccttgggtcagagccgtatcaggcaaccaaagtgattgaataccctcgcggaaag

SEQ ID NO: 717061 - DNA, 1092 bp, Homo sapiens
gaagtctccatcttatcgttagaacacctcggcgcaaccaagacacagcgaatagggggagctgtgttcgcgccctttgaacacgcccacaaatgttgcgtgtttgtcatcagcacaacactgtcgtcgggaagaagcccgctgtcgtgttcgaatattcttgtctcgtggatgatagctccgtctgtgttgtagaaaccccccccccccgcggctgaggagaagctctcctcttcgtggaagagccctcttatttgtagagcacactcgtcacctgtcttttatgagaccgcgctctttctcttattaggggggcaagacaccacgctgtttctcttcggtgaagtcgcagatgtaggtcactccccccccatcctcgcgacagaatgtgtgtccccctcctggggcacagagacacccccacacactcgagaaacttcttttcccccgagagagaaaaacctcccagcgctttctcaacatataacagagcacgagaatcgtccccccacacagctgtgtgccacatcgagggccaacagttggtgtggagaacacacgcgagagagcttatttcttcacacgcgccacgggagtgtctcacaaaagagaagaggctcacacagagaagaggacccctcttttcgaggcgaggttcacagaggagccacgacaccaccgagataaaacactttctttacacacaacctttgccaaagccacgccacactcactcgctgagtggtgtctctctcctcgctgggagaaaacactcgcgcgagacccttgttccaactctcccctctctctcgagtctctagtgagaatacacccagtgtgcacctctttcttctggccccccagacttttagtcgttctgcagataaagagagaactcgaggcatgcatttacaatctttgtttgcaatgttcacctccatggccattcagcattagtgaacaccagaattaatttctcacaatttctgcgtcgctgggggggggatcctatgggagtatgtaaaaaattttaaagagaaaatttcaaaaaaaagagaattttttccaaataacaattttcccgtcccttta

SEQ ID NO: 717062 - DNA, 161 bp, Homo sapiens
catgcacaagctatatgaaatgcatagctttgattcacctaaagatacagtttccttctttgtaacactccagatttaggatgctggcaaaggcagtgctggcacagtatttactgcaccatggccctgctattctactttcggcttccagaagtacgccc

SEQ ID NO: 717063 - DNA, 621 bp, Homo sapiens
atcgagctgcgaccctttccaacattcatttctcgagacgtgtctatataggcacaatattcaacataataataagatctataaaattacatacatatgagacatgtacaaacataattatgaaaataaacagtagatcaactttacaatcattataatagcatcacacaaattagtgttcacaagaaataaaactgtcaacatgattccctttcccctacttctcaaatgtcatctgaattactttttatgataacttgaaagaaaatactgtcatcttcctatacaattaaccaatttttataataactcataataaaatattttacttttttaactatagaaaagatacataattccacttatttaagtttatgattcctaaatcatacaattcgtatcaattcatcagttgagtgtaattaaaggtactgcagttactgaaggttaatttaacaaacctgagtcaaacattcattcaaatgccttttttaaaaacataaaacatgaacaagatgttttgatagaagcatatataatagactcaaggtaccctcccctaataaatacattataaataactcaatggttgggagtacagcacttcatatgaatccattt

SEQ ID NO: 717064 - DNA, 5580 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtca

SEQ ID NO: 717065 - DNA, 477 bp, Homo sapiens
gcaagagatgccagctatgtaacctgctacagaaggttacaagcagtcagtcaggctttggaacattcactgcggggcttaggaaccacaaagcttgtacagtgcttcatgagtacgttcaaagcaggcgaacttcagcgagggtgtatggtatctgtcgtcatccagagaggaggacaacgcccctgtagaaggcgttgaggccttctgccttatacatttggggagctgcgtccctcagagtgtgggcataacgctggatgggtgtgaatgcggaaccttagcggcttcgcagtaggagccagggcaatgtcggcaaagaattcagcgctggcagaggcagccaaatatagtgatgtgcgccagagataagtagttcgtcctctccaagcatgtggctatacaagactttagaagacttcataaaagccaaacttgcggagtccctgcagggagtagcgaaggaaagtcggagcc

SEQ ID NO: 717066 - DNA, 3289 bp, Homo sapiens
cgttcggatacaattatgactactcttatgcagtatgattttgagaaacagagaacttctttttcatactgaaaaacctgtaaagctgtacccaacttattgtaaattccttgggtacagttttaccctggatagtttctgattttagtttgtcctcaacattagggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtca

SEQ ID NO: 717067 - DNA, 265 bp, Homo sapiens
tcgttgctgtgtgggagacaacatctagggagaagtgctacaggtagaccagtgctgccgtgggagtgtataacggatcgtgtcgcaggagagcacagcccagcgttggggacgggagcgctggcgcccgacgtcggaagcatacaggtatactatgcaagtgtattctgccacaacaaccactgtctttgttaccttattttgaacaagaatatatccatcctgcctaaccctgaggtatatggagcaccgccagttgtcctgg

SEQ ID NO: 717068 - DNA, 6202 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaataaaagcctgcccagaccattaaaa

SEQ ID NO: 717069 - DNA, 1283 bp, Homo sapiens
agcggacacctagactcgaatcgtgactcggcaggaagatccattaccaatcatcacctgggctgctgctcttccggctcccgtccgccgacgctccggccctcgtctccgacctactggcctccggctgctgcatcttacacgagtcctgaatgctctgtgtagctgacttcctgaggctagtttcaccatgcgcacagtgagacaccgcgacgaaactagtttgaacctacacgaagctgacaccgtccagcaactgggatggaaggacccgatgaaacggaggctgtgaaggaagaggatgagttggtcgtcggcgtagtggacccgttggagcgtaatggactgtctagcttactctctttctccaagaccaggtagatcgaaaactgtatgccacgagctgaccgacagtcctgggaaagcttagataggcagcgctctcgtgtagtcatcattccgtgtgactgagagcctagcgacctaaacgtagctctgaggacaggtagcgatgcgtcgcgagtccatgaggcctagcgtatgagatcacgccatgtagagtgcaagagcgccaccatgcttgtggagagagacttccctggagatcccgtttttcgcattgtcagccgagcgcctgagcgattccgtgttcaggcagagcgccaaatgggcgatgttggtcgatttcctgtgtggctcaggaactacttaaacttcatcgagtgacacttattgcgttcctgggtggcaagcccaccggtgttaccccgtcgtgatctgggacatttgtccaccagcgcatttgtacggagtacccccctcattatagttgtgcgtcataagataccacgggcgaggccctagggtccttgcgtggtgcggttaataaaaccttcctttttgtagtacttcaaacactttgcccccaaaaacttgcgttggagaatggaatcaagcgggcaattttccttgggaatttcctcctacggggagaatcttccaataagccaagattttccaaaattctccacatgggttgcgttgggcctaacttggcgcggaaagcaggggcattttaatccttgacgacttcacgagtggaggtcactcaaccccgaaaagaccagccaagctcttaccctttgaatcccttggaaaccccacgcagaaacaatttaaattaccgcgctgcgttgacagggccttgaagtcgaattgccttgaagatggtgggccacagatttcacttcccggaactggccgtatttaaattagcaacccta

SEQ ID NO: 717070 - DNA, 187 bp, Homo sapiens
cgggcgggtggagggaagcgggcaggaacagccctggagaagtgttcaccagttgcactatcctcaccgcaacattccttatccaatcccttaccgtgacgagtagcacagcccctctatggtttagatggcagtgctgcaaagggaggcaacacgaggagcagtctgctcttgcaaatcctacacg

SEQ ID NO: 717071 - DNA, 213 bp, Homo sapiens
gactctagcggatccctgagagaccgtgttgactgaagctgaggaggctactcagtaggacagtcccaccctcacacgattctttacctttcacttcatcttacccttcattattgcagccctaagcaagcactccacctacctactcttgcacagaaacgggatcaacacaacccccgtaggaatcaccatcccattccggataaaatcacc

SEQ ID NO: 717072 - DNA, 672 bp, Homo sapiens
  misc_feature (275)..(275): n is a, c, g, or t
  misc_feature (380)..(380): n is a, c, g, or t
tcctgaggctgtgtcatgggtgcacaccctcaaccttggcaaaataaactttctaaattaactgagacttgtctcagattttctgggttcacatttgggtaaccacagggggattctgagtggagatacccctgaccttgtgacaaatatcctgtggtgctgtggtaccagcatgagctaactttatggttcaaaccaataggacaattgtgccgtgcaccccctccagagaatccctgagctccaaaaattggttgagatcaaaagtttatttngctgtacaactcctcttttgagggagttttactgtgcttccaacaggaaggcaggttttctttgcttccatgatgatggaaggcagacaactcctttatggagtntgagcttgcttccaacagggaagatgaggttttttttcccttcttctaggatggtagagagcggtctacagcctggacccatcaccagtctatgtgcaacagaggctactctgtggttttcaagaaagagtgtggctgcgcggtggtggcctcatgcctggtcatcccaacacttgtgggacaccgaggcggggaggaatcaccgaggtcaggaggtccaagaccagctgggcaacctggtggaaaccctcatctctactaaaaatacaaaatttaggtgggcatggtggtc

SEQ ID NO: 717073 - DNA, 5507 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaag

SEQ ID NO: 717074 - DNA, 6004 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtcagtggtttttgttttgtgaaattcctttgaccatattagatctatttcatttccaatagtgaaaaggagatgtggtggtatactttgtttgccatttgtttaaaagatacaacggataccttctatcatgtatgtactggcttataaatgaaaatctatctacaacattacccacaaaggcaacatgacaccaattatcactgcctctgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactataagattatataagttcatatagatgaatcagaaatatgtggtaatactattaagtcacaaacactaacaatttccaactatagaaataacagttcttatttggattttgggaatgctaccaataaaagcctgcccagaccattaaaa

SEQ ID NO: 717075 - DNA, 806 bp, Homo sapiens
agcggagtccgggtaggccttaggtgggttcgtgcgccttctacctcgctgtttcggttttcctggctcctcgagcccttattctcccctgtaagcagctgggagcggacgaagcgcgaagctgggatttttatactgtctcctgcaagaatttaacacaaacatgtgtatcatcagaccaaaatcgatacaatttcatatcaacactatgaatgacaaaattaaaaaggaagacttgacgagatccctcatatgccctgttttctcagatttgagtcactgtggttggacattgtggctttaaacgaccactgaacgactgaggtggtgcatgtgcctttgatcatcatttaacggaactctgggctcatccacacaatgcctctgagaccacgctacaacggatttccattttatggtaaaccaatgcgactacagtcatgcaagcaacagatctcggcatctcctatcacaagcaatgcgtggcaactctttcgctgccaacgcccacagcaacacagacacagcacaacacagccaacacctgtgggaccaggactggcaacaaggcacggaacaagaagacgcctggccaagtggaaactcgaacatttcacgcgtaataagccacaggcaacatgccaaaagacgaaattccgtcaggggtcgcctgaagttagccgttccaacaataatagtttaatgtccgttcatacacttaccagaaagacgactaagtggagatgatggtaatcacatggtggtttaagtcagaggccatggctatcaggaaggtacgtctgtga

SEQ ID NO: 717076 - DNA, 5309 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaag

SEQ ID NO: 717077 - DNA, 4602 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatctta

SEQ ID NO: 717078 - DNA, 284 bp, Homo sapiens
  misc_feature (3)..(3): n is a, c, g, or t
  misc_feature (15)..(15): n is a, c, g, or t
  misc_feature (27)..(27): n is a, c, g, or t
  misc_feature (42)..(42): n is a, c, g, or t
  misc_feature (58)..(58): n is a, c, g, or t
  misc_feature (60)..(60): n is a, c, g, or t
  misc_feature (64)..(64): n is a, c, g, or t
  misc_feature (73)..(75): n is a, c, g, or t
  misc_feature (83)..(83): n is a, c, g, or t
  misc_feature (106)..(106): n is a, c, g, or t
  misc_feature (113)..(114): n is a, c, g, or t
  misc_feature (136)..(136): n is a, c, g, or t
  misc_feature (166)..(167): n is a, c, g, or t
  misc_feature (172)..(172): n is a, c, g, or t
  misc_feature (212)..(212): n is a, c, g, or t
  misc_feature (214)..(214): n is a, c, g, or t
  misc_feature (225)..(225): n is a, c, g, or t
  misc_feature (240)..(240): n is a, c, g, or t
  misc_feature (247)..(247): n is a, c, g, or t
ggnaggggcaggganccaggtggccgnagggcacagggcctncgtgtaccacatgaancngggntggcatggnnngcctcctntgtggtgcgaagcccgttcagcncccggannaaggggggcacccagcgggttntgtggaacacagactcccccaccttccagnngggcncgtccttcatgatgatggcctcgtcccgaattcgacgagngnaattgtaaatncgttttatttataancctggcnctgtattcaataaacatttctgcagcctttcatctct

SEQ ID NO: 717079 - DNA, 164 bp, Homo sapiens
tgcaggcattctttgctgaagcaggccatacatggcccttctaaacgctactccaagcctcaccccactactaggcctgcttctagcagcagcagtcaaatcagcccgattaggtctacacccctgactcccctcgaccaaagaaacccttccgcctaccgagc

SEQ ID NO: 717080 - DNA, 4314 bp, Homo sapiens
  misc_feature (136)..(136): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaata

SEQ ID NO: 717081 - DNA, 118 bp, Homo sapiens
acgctatacgaccgggtgtgctctttacgcgtgtctacggttgctcgtcgggtttcgggggtctacgctttggctctccttgctgtctacggacgcgtaactcggggactcctctacg

SEQ ID NO: 717082 - DNA, 1794 bp, Homo sapiens
acctggcccaataaatgttggcattgatagctggccggggacagatacagacccaaagtcagcccatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaatagaaattagtgcccttttgtgacctctcattccaagattgtcaattaaaaatgagtttaaaatgtttaacttgtgatcgagacctacatgcatgtcttgatattgtgtaactataatagagactctttaaggagaatcttaaaaaaaaaaaaacgtttctcactgtcttaaatagaatttttaaatagtatatattcagtggcattttggagaacaaagtgaatttacttcgacttcttaaatttttgtaaaagactataagtttagacatctttctcattcaaatttaaagatatctttctcctcttgatcaatctatcaatattgatagaagtcacactagtatataccatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaggtgctatgcttctgttattattccaagactggagataggcagggctaaaaaggtattattatttttcctttaatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaatactttttttttcttaattgcatttgttggctctattttaatttttttcttttaaaataaacagctgggaccatcccaaaagacaagccatgcatacaactttggtcatgtatctctgcaaagcatcaaattaaatgcacgcttttgtcatgtca

SEQ ID NO: 717083 - DNA, 4128 bp, Homo sapiens
  misc_feature (136)..(136): n is a, c, g, or t
  misc_feature (4116)..(4117): n is a, c, g, or t
gacctcagggaattgatggagaaccaggtgttcctggtcaacctggtgctccaggacctcctggacatccgtcccacccaggacccgatggcttgagcaggccgttttcagctcaaatggctgggttggatgaaanatctggacttgggagtcaagtaggactaatgcctggctctgtgggtcctgttggcccaaggggaccacagggtttacaaggacagcaaggtggtgcaggacctacaggacctcctggtgaacctggtgatcctggaccaatgggtccgattggttcacgtggaccagagggccctcctggtaaacctggggaagatggtgaacctggcagaaatggaaatcctggtgaagtgggatttgcaggatctccgggagctcgtggatttcctggggctcctggtcttccaggtctgaagggtcaccgaggacacaaaggtcttgaaggccctaaaggtgaagttggagcacctggttccaagggtgaagctggccccactggtccaatgggtgccatgggtcctctgggtccgaggggaatgccaggagagagagggagacttgggccacagggtgctcctggacaacgaggtgcacatggtatgcctggaaaacctggaccaatgggtcctcttgggataccaggctcttctggttttccaggaaatcctggaatgaagggagaagcaggtcctacaggggcgcgaggccctgaaggtcctcaggggcagagaggtgaaactgggcccccaggtccagttggctctccaggtcttcctggtgcaataggaactgatggtactcctggtcccaaaggcccaacgggctctccgggtacctctggtcctcctggctcagcagggcctcctggatctccaggacctcagggtagcactggtcctcaggggaattcgggccttccgggtgatccaggtttcaaaggagaagctggcccaaaaggggaaccagggccacatggtattcagggtccgataggcccacccggtgaagaaggcaaaagaggtcccagaggtgacccaggaacacttggtcctccagggccagtgggagaaaggggtgctcctggcaatcgtggttttccaggctctgatggtttacctgggccaaagggtgctcaaggagaacggggtcctgtaggttcttcaggacccaaaggaagccagggggatccaggacgtccaggggaacctgggcttccaggtgctcggggtttgacaggaaatcctggtgttcaaggtcctgaaggaaaacttggacctttgggtgcgccaggggaagatggccgtccaggtcctccaggctccataggaatcaaagggcagcccgggaccatgggccttccaggccccaaaggtagcaatggtgaccctgggaaacctggagaagcaggaaatcctggagttcctgggcaaaggggagctcctggaaaagatggtaaagttggtccttatggtcctcctgggccgccgggtctacgtggtgaaagaggagaacaaggacctccagggcccacaggttttcaggggcatcctggtcctccaggtcctcctggagaaggtggaaaaccaggtgatcaaggtgttcctggaggtcccggagcagttggcccgttaggacctagaggagaacgaggaaatcctggggaaagaggagaacctgggataactggactccctggtgagaagggaatggctggaggacatggtcctgatggcccaaaaggcagtccaggtccatctgggacccctggagatacaggcccaccaggtcttcaaggtatgccgggagaaagaggaattgcaggaactcctggccccaagggtgacagaggtggcataggagaaaaaggtgctgaaggcacagctggaaatgatggtgcaggaggtcttccaggtcctttgggccctccaggtccggcaggcctactgggagaaaagggtgaacctggtcctcgaggtttagttggtcctcctggctcccggggcaatcctggttctcgaggtgaaaatgggccaactggagctgttggttttgccggaccccaggggtctgacggacagcctggagtaaaaggtgaacctggagagccaggacagaagggagatgctggttctcctggaccacaaggtttagcaggatcccctggccctcatggtcctaatggtgttcctggactaaaaggtggtcgaggaacccaaggtccgcctggtgctacaggatttcctggttctgcgggcagagttggacctccaggccctgctggagctccaggacctgcgggacccctaggggaacccgggaaggagggacctccaggtcctcgtggggaccctggctctcatgggcgtgtgggagatcgaggaccagctggcccccctggtggcccaggagacaaaggggacccaggagaagatgggcaacctggtccagatggcccccctggtccagctggaacgaccgggcagagaggaattgttggcatgcctgggcaacgtggagagagaggcatgcccggcctaccaggcccagcgggaacaccaggaaaagtaggaccaactggtgcaacaggagataaaggtccacctggacctgtggggcccccaggctccaatggtcctgtaggggaacctggaccagaaggtccagctggcaatgatggtaccccaggacgggatggtgctgttggagaacgtggtgatcgtggagaccctgggcctgcaggtctgccaggctctcagggtgcccctggaactcctggccctgtgggtgctccaggagatgcaggacaaagaggagatccgggttctcggggtcctataggacacctggtcgagctgggaaacgtggattacctggaccccaaggacctcgtggtgacaaaggtgatcatggagaccgaggcgacagaggtcagaagggccacagaggctttactggtcttcagggtcttcctggccctcctggtccaaatggtgaacaaggaagtgctggaatccctggaccatttggcccaagaggtcctccaggcccagttggtccttcaggtaaagaaggaaaccctgggccacttgggccaattggacctccaggtgtacgaggcagtgtaggagaagcaggacctgagggccctcctggtgagcctggcccacctggccctccgggtccccctggccaccttacagctgctcttggggatatcatggggcactatgatgaaagcatgccagatccacttcctgagtttactgaagatcaggcggctcctgatgacaaaaacaaaacggacccaggggttcatgctaccctgaagtcactcagtagtcagattgaaaccatgcgcagccccgatggctcgaaaaagcacccagcccgcacgtgtgatgacctaaagctttgccattccgcaaagcagagtggtgaatactggattgatcctaaccaaggatctgttgaagatgcaatcaaagtttactgcaacatggaaacaggagaaacatgtatttcagcaaacccatccagtgtaccacgtaaaacctggtgggccagtaaatctcctgacaataaacctgtttggtatggtcttgatatgaacagagggtctcagttcgcttatggagaccaccaatcacctaatacagccattactcagatgacttttttgcgccttttatcaaaagaagcctcccagaacatcacttacatctgtaaaaacagtgtaggatacatggacgatcaagctaagaacctcaaaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcgcccagcgnnggtaccgagct

SEQ ID NO: 717084 - DNA, 590 bp, Homo sapiens
gtcagaagcatcgagtgatctgagaatgtattatctccatgtgattgtggatcatattcatcatttcagtcttgtacttatacatttcttttcttttcttttattgagacagagtttcactactgtggcccaggtaggagtgcaatggtgcgatctcggctcactgcaacctccccctcccgggttcaagcgattctcccaaccagtctcccgcaatagctgggattacaggtgcacgacaccaggcccagctaatttttgtattttaagtagagacggggtttcaccatgcgggccaggatggtctccaactcctgaccttaagtgatcagcccgcctaggcctccctaagcactgggattacaggcgtgagccaatgtgcctggacaaaatatcctcttatttatagctgacttggcaacatctgatattcaggtgggatacgatagcaagctgtactagatctctcttgtgtgcactggctcaaacactcattacccgagttctgataccagtttctgtatcagctagaattgtgtagttgcaagcaaaagattattccctcttatgtcattacatcttcaagtcag

SEQ ID NO: 717085 - DNA, 458 bp, Homo sapiens
  misc_feature (1)..(1): n is a, c, g, or t
  misc_feature (40)..(40): n is a, c, g, or t
  misc_feature (42)..(43): n is a, c, g, or t
  misc_feature (47)..(50): n is a, c, g, or t
  misc_feature (56)..(57): n is a, c, g, or t
  misc_feature (338)..(338): n is a, c, g, or t
  misc_feature (427)..(427): n is a, c, g, or t
  misc_feature (429)..(429): n is a, c, g, or t
  misc_feature (437)..(442): n is a, c, g, or t
  misc_feature (444)..(444): n is a, c, g, or t
  misc_feature (447)..(447): n is a, c, g, or t
  misc_feature (449)..(449): n is a, c, g, or t
nccgacctctgccctctaaatcagcatctatcacagtagntnncctnnnnaaagcnnttaaacatcattgggaaaacttagagcaaatcaaaccaatgtttttcaatacatggaaggaaagatgtgtgtgcttggttttgttttttgctgagacccaaacattgttagtgcaagcccccgccaggggtgcaggtggagtcaaagctgaatgaagagctcgtcttcaatgtagctctccaagctttcagagcaagacaaccatggaccatcctcttcttcagactggcctgtcttcttcttgaacaatgtcactttgctcctcactgctgtcatcttgnagatcctggaatccatttcccatctgttctatgttcccattcaccaaggcggtcactctgtgaatgtggtcctgcttaggtatttcttntngcaactcnnnnnncncangngctcccatg

SEQ ID NO: 717086 - DNA, 364 bp, Homo sapiens
  misc_feature (1)..(1): n is a, c, g, or t
  misc_feature (40)..(40): n is a, c, g, or t
  misc_feature (42)..(43): n is a, c, g, or t
  misc_feature (47)..(50): n is a, c, g, or t
  misc_feature (56)..(57): n is a, c, g, or t
nccgacctctgccctctaaatcagcatctatcacagtagntnncctnnnnaaagcnnttaaacatcattgggaaaacttagagcaaatcaaaccaatgtttttcaatacatggaaggaaagatgtgtgtgcttggttttgttttttgctgagacccaaacattgttagtgcaagcccccgccaggggtgcaggtggagtcaaagctgaatgaagagctcgtcttcaatgtagctctccaagctttcagagcaagacaaccatggaccatcctcttcttcagactggcctgtcttcttcttgaacaatgtcactttgctcctcactgctgtcatctgtatggggggaaataaacccaatgctttg

SEQ ID NO: 717087 - DNA, 308 bp, Homo sapiens
tgcagtacagcggcacgggccagcagcgcccagagcgggcatcgctgcagttcctgcgaaatctacacggccctggccagtgtcccgtgaatgaccatggacttttatcaacgaacgccaccgacgtcaacgaatgccctgggctatgatgaacccgcttctaccgcgaaggcctcgttctggcgctgccaagaaagaaggctgctgctcttctcagaatggcaactcgcagggcgccacgccgctgccatcgaagaaaggccgtgcaggaagcccagcgggcaggcatcgagaatcttcgtggtggt

SEQ ID NO: 717088 - DNA, 132 bp, Homo sapiens
gatgcttacgatagccgaaggcaggtgtgggatattagacttctcttccggtcagagcaagggtcgtcgaaatcaaaaatacctcttcccttcatctcgccccggatacaaagtctgtcgggctactcgggg

SEQ ID NO: 717089 - DNA, 151 bp, Homo sapiens
cgctctctcgtgtggggcagacacttctcaggctcatgggtggggttaggcccaggacacctctcggtcccctcctctctacatccggcctccttgtcctccttcggtttttcctttggtctgtgtttcaggtcccggggaatggtggagg

SEQ ID NO: 717090 - DNA, 168 bp, Homo sapiens
cgcgatgggcttgtagcatagtgtggtcaaaaagcctggatcacggaacggtttggacggcaccagcctcttgaagccagtgcaggcagcgcagggcaaaagccagtgagcagtgtacgtccagtgagcctggtagccatatgccacttagtgttagcttgtcctaca

SEQ ID NO: 717091 - DNA, 294 bp, Homo sapiens
ggagataggaggcccaggtggcaggtagcaggaggcccagatcacccatcctcccctggggtacaggagaggccgagccccaggccactgttcactctttgttgggaggggacggggagtgaggttggccagtttggtggatggtcacccaggaaggtttgaccagggaaggaggcagctagtctttagatggaggatggccctgggtttcgcacaccgctgggttctgcccaggtgctccctggtatacaagtcccttcccctttttgtcccaagttttcctttttcctcaac

SEQ ID NO: 717092 - DNA, 457 bp, Homo sapiens
cagtggaagggtgccatgataacagcataagcagggcctataaaatcacagaaatggggcaaccaaccatggaggtatcagtctagagagacataaagcaatgtcatatattccatcattattcagttaaaaaagttattttttaataaaattcttagaccgggtaccagatcttcaggtgcacagtttatcagggctaaatcaccttggttgtcaaagcctttttgataatccggcgaatttgttgtcttcatcgcgttaggcctatacaatgattttggaaatagatctagtggccaggtaactctgcctaatatttccctcctcagtgtagcattgggccattcaaccaattgctttattcctgcagctagggaggctgaggtgggaggatcacttgagccccagaggcagaggttgcgggagctgatatagtgccactgtcctcaagctgagt

SEQ ID NO: 717093 - DNA, 83 bp, Homo sapiens
gactcagtatgctttccctgaggaatgaaaaagggattcaggagtcgcctgacttctgggtgggtggggtacaggcagttagg

SEQ ID NO: 717094 - DNA, 298 bp, Homo sapiens
  misc_feature (107)..(107): n is a, c, g, or t
  misc_feature (131)..(131): n is a, c, g, or t
  misc_feature (144)..(145): n is a, c, g, or t
  misc_feature (151)..(152): n is a, c, g, or t
tgtggtggcttatgtctgtaattctagcactttgggaggctgaggtgggtggatcacttgaggtcacgggatttcaatggacccatgccccttggccccaaatccantgtgccttggacaacatcttcccnccattccctctannctaacnnaattacataacacactttaagccctttggggcaacttgcttggcgcttgggtcaacggttgccctacagtcccagctacttgggaggctggggcagaagaatcacttgaacgccagaagtggaggttgcagtgagccaagattgca

SEQ ID NO: 717095 - DNA, 217 bp, Homo sapiens
  misc_feature (70)..(70): n is a, c, g, or t
  misc_feature (164)..(165): n is a, c, g, or t
  misc_feature (189)..(189): n is a, c, g, or t
gtgactagaggatccgcgcctagcacttccagttcatctgtgccaggctgtctcgaacttctgagctcanagcaatcctcccacctcagcctccctaaacatattaggttcttaaatgttttgattggtgaatgaattaattgatagttgacccaggactttcnnttaactggatagcagatggaaacnttggggggaagtagaagggaaggaacag

SEQ ID NO: 717096 - DNA, 451 bp, Homo sapiens
  misc_feature (342)..(342): n is a, c, g, or t
  misc_feature (420)..(420): n is a, c, g, or t
  misc_feature (443)..(443): n is a, c, g, or t
  misc_feature (448)..(448): n is a, c, g, or t
ggcacgaggtttggctgagtgtccccacccaaatctcatgttgaactataattcccagtgttgagggaaggacctggtgggaggtgattggatcatggggatggatttctcccttgctgttctcatgatagtgagttcttatgagatctggttgtttaaaagtgtgccttctctctcccgtcgccatgtgaagatgtgcctggttccccttcaccttctgccatgattggaagtttcctgaggcctccccacccatgggagaactgtgagtcaattaaacctcttttcttcataaacaagccagtctcaggtagttctttatggcaatgtgagaacggactnaattacaaatatcttgcccattttagacaaaactggggtttgtgttcttcccggaatattgagatttcttccagatanttctagggtacaagtccctttantcatnata

SEQ ID NO: 717097 - DNA, 249 bp, Homo sapiens
agcagcacaaaggggatgtgtgacatggactgcaactagtaacggttcaactttgatggtggagagtggtgtgacccctgaaatcaccaatgtcactcagacttgctttgaccccgactctccacacagagcctacttggatgtataatgagctgaagaacattcttaaattggatggatcaacacatctcaatattttctttgcaaaatcctcagagaaggagtaggaagccatgcgtggattgccag

SEQ ID NO: 717098 - DNA, 150 bp, Homo sapiens
  misc_feature (6)..(6): n is a, c, g, or t
gagggntcccaggtgtacccagtgagaccatatgaccattttggtttgaccaattggttagagacagctattcacaaacaacctgcgggcacaattgaccctctttccacacgttagcacccttcagcaggacccttttaaagctctctc

SEQ ID NO: 717099 - DNA, 360 bp, Homo sapiens
agtagaagagctggattcattgagcatagctgtattttaccagattatccccgaacttactatgtattctataaaaaggagaagtgaggtgtgcccagtatacaactctcacaactacttatgaggacttgaccaacatctctgggatttgactggggatagtataccaataaacagtactaaaaaggattacatttaccaagtatctcttctctgctccccttgaccactgaagcctcctctttggcaccttgaagttagctgcttaaagttggaaatgcagacagcaggtaatcatgctgcaagtactttctggacctatggcaaagggagtggtcaatgacagacatcgaaaccttg

SEQ ID NO: 717100 - DNA, 118 bp, Homo sapiens
ttctaatgatgggctttaaaataaatgttacaataatttctcattttttcagtgctatattatccaattttggcttatatatattctatcttctatacttctccaatacttgtcttag

SEQ ID NO: 717101 - DNA, 162 bp, Homo sapiens
ggcaccagaaagacgcatgcgggcatgcttcacagctctttgagtgaagcccagctgccgtggctcaaacaatgagaaccccacacatgcgtgctgtcgcagcgtgaaacatgctgctcaagaattgagtggctccgctctcgctgacaaccccgatgaacc

SEQ ID NO: 717102 - DNA, 109 bp, Homo sapiens
tcgggcgaggctatattacggatcatttctctactcagaaactgaaacatcggcctcgcccgatgtgtaggaagaggcagataaagaatattgaggcgccattggcgtg

SEQ ID NO: 717103 - DNA, 237 bp, Homo sapiens
gctcaccggaggggtggcctgagatcttgatcacttccctaggcggttgcaataggaaaccggggcttccttgacgaactctagcgtctcaaacagagggagggccatgatgactgggcttggtttaaaaggaacatggcctttaactttcccggcaggcccgggcaggggacaagggagccagtcctcaatggttaaatgatatccactttactgggtgggttggtcttttttttt

SEQ ID NO: 717104 - DNA, 560 bp, Homo sapiens
accccacagcacctgagtcccatattgggaaggatgaagaaattccagatagttctaagattagtctgggctgtaaaaaaacaggttctaagaagaaatcctcacaatctgaaggcatctttcttggttcagaatctgatgaagattctgtacgcacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggaaaagatctcactctaggtctgagagaggctctagaactaatttatcctattccaggtcagaacgatctcattattatgactctgatcgtcgctaccataggagctccccttatcgagagaggacgcgctattctcggacatacacagataacagagcacgagagagttctgactcaggtggtgtg

SEQ ID NO: 717105 - DNA, 519 bp, Homo sapiens
  misc_feature (29)..(29): n is a, c, g, or t
  misc_feature (65)..(65): n is a, c, g, or t
  misc_feature (67)..(67): n is a, c, g, or t
  misc_feature (69)..(69): n is a, c, g, or t
  misc_feature (76)..(76): n is a, c, g, or t
  misc_feature (78)..(80): n is a, c, g, or t
  misc_feature (107)..(107): n is a, c, g, or t
  misc_feature (173)..(173): n is a, c, g, or t
  misc_feature (211)..(211): n is a, c, g, or t
  misc_feature (238)..(238): n is a, c, g, or t
  misc_feature (243)..(243): n is a, c, g, or t
  misc_feature (247)..(247): n is a, c, g, or t
  misc_feature (293)..(293): n is a, c, g, or t
  misc_feature (324)..(324): n is a, c, g, or t
  misc_feature (333)..(333): n is a, c, g, or t
  misc_feature (339)..(339): n is a, c, g, or t
  misc_feature (348)..(348): n is a, c, g, or t
  misc_feature (361)..(361): n is a, c, g, or t
  misc_feature (504)..(504): n is a, c, g, or t
tcaggaaaattacaatcatgttagaaggngaaggagaagcaggcacatcttatatggccagagcnangngggaganannngggaggcaccacacactttgaagcaancagattgttttgaggtttctattatcaggagaacagcactgagcgggtggtgctaaaccgtttgtnaggactctgccccataatcccatcgggcgtcgcgaccngggggcttacatttcaacatgagattnggtgngganacagatccaaaccacatcaatagtgcatttcatgcttttgattatnttttgtaactatgttattgaactataatttntataccatnctattnaccaacgtnaagtgtgtaattnaatggtcttaagcatattcagagattgtgtgaccatcgctacagtcaattttaggacatttttatcaatgcaaaagaaagacctcaatcttcccattcctcccatcccggagcaaccactaatctacttcctctatatggagntttgcttattctgga

SEQ ID NO: 717106 - DNA, 630 bp, Homo sapiens
  misc_feature (609)..(609): n is a, c, g, or t
cctcatccgactcctggatcggcgaagctgctccgccgcgcgcctcctccgccggcgcggactccggcagctttatacgccagagtccctgaaactctgcgctttcttatttaatgcccctgcatcggatcaccgggtgccccaccatgtgagacgcagccgtagacaccagctccgaaatcaccacaaggacgttacaggcagaagaaggaagtgtggaagaggcagaaaatggaagagacgcccctgctaacgggaatgctaatgaggacaaatggggagcaggaggctgacaatgaggtagacgcacgaagaggacgaaggtggggcaggaagaggcaggaggaagaagaaggtgatggtgcaggaagaggatggctgatgaagatgaggaagctgagtcagctacggggcaagcggggctagctgaagatgatgaggatgacgatgtcgatgccaagaagcagaagaccgacgaggagtgacctagacgagcaccgaaaggtacaagttacacactagacaaagaagggggccgccgtgtgacctattcaacccgtcctattttcccggtcttccagaagatcgtaaagacgggggggtccacgntttccggagatagaaggaggg

SEQ ID NO: 717107 - DNA, 388 bp, Homo sapiens
agttgaaggctccctctggcaccccagcctgagccacagacgttgaggtgcaatgaagatggggatactggacacaactcctttcgcacatgtcaaagggaagacactgagagtcagacaaaggccaagtgcccagggtgcacaaagaaccagttaacaagataaaacatattatgggagcaccacctccatttcccacagcccaatttttcactatttacaacatgaagcacattagacaatgatgatatcaaaaatctcaaacaatattttcatagccccatggtcggggatgtggacaggcaagtggtatccctgtgatccagacaatcaacaccctagaatccagggactccagtacttccatcctctgacgctgccccagatg

SEQ ID NO: 717108 - DNA, 182 bp, Homo sapiens
atcgcactcgcgctggtccccattcggccggggccaggctccggcatcacttggcgcctctccccatgcaactctgccaccgctgggggcctcccacctggggctcccagtggcaccctgctttccctcatggtttggcttccacttgccccgggccgccttggggctcctctcacatcgca

SEQ ID NO: 717109 - DNA, 341 bp, Homo sapiens
cagagaatgacccagtccatagaagaactatgggataagcttcaaagctaagtgtgtactattgccatgattatacagtagactcagagtaccatatattataaagctgctgtgaagctgtagcactcaggaatgaaaattcttagccgggaaagaattcagagcgtgaagcaaagcattgacttcatggctgacttggagaaaactcgaaagcagaaagatggaacagacacctcacagagtggggaggacggaggctgctggcagagagagagagaggactctggagatgccgaagcacacgccttcaagagtcccagcaaagaaaataaaaagaaaga

SEQ ID NO: 717110 - DNA, 250 bp, Homo sapiens
tgcagggtgtatcgacggactcaaggtgatcaagaatctctaatagttggtggtggctcacgccttgtaatcccagcacttggggaggctgaggcaggcggatggcctgaggagttggagaccagtctggcctcgacggcgaaaccccatctccattaaatatataaaaaaattagctaggtgtggtggtgtgcacctgtaatcccagctactggggaggctgaagcaggggaatggcttgaaccaggga

SEQ ID NO: 717111 - DNA, 303 bp, Homo sapiens
atgcgctcatcagtgtatgccctcatccagtggcatgccctctatcagtggcataccctcatctcatgccctcatccagtgtcatgccctcatccagtggcatgccctcatccagtggcatgccctcatccagtggcatgccctcatccagtggcatgccctcatccagtggcatgccctcatccagtggcatgccctcgtccagtgcggatgccctcttcgcatgcccttcacatagtggtatgcactcatcccatgccctcatccagtggctgagggcatgggatgagggcatgctactgg

SEQ ID NO: 717112 - DNA, 244 bp, Homo sapiens
gctgtggggcttggtgcgtccccaccaaatttatcttgatgtagttcccataatccccatgtgtcgtgggagggacccggtaggaggtaatcgaatcatgggggcaggtttttcccatacatgttctcgtgatagtgaatacatctcacgtaaatctgatggttttataaagggcagtttccctgcacgtgctctcttgcctgctgccatggaagacatacctttttgctccttctttgccttc

SEQ ID NO: 717113 - DNA, 210 bp, Homo sapiens
acaaggcacagacagaggaatgttcagcggtccaatccgttctggaagcgccagagcttgctagagacgtaacgtacagctgattagatatttccttgttacaatcatctctgtgagcaggagtttcagaatttaaatcaatcgtgctcaggatgcactgttagctgaacacacatccttatttggctttatgtctcttaagctggtggc

SEQ ID NO: 717114 - DNA, 584 bp, Homo sapiens
atgactttccaaaagaagagacttatgatagagtcaaggtttcttaattacagaattcattttaagtggtttgtggaactttaaagtttttaagtaacatgcatgggttccctcttcactaaatggttttcaagcaaattagggcaacaaaagttggaagaaagcttatggttggggacgacttttgctctgtccaattgtgcgcacagggctctcaggggcgcgcaattcacattttatcgtcgaattcgaacgtaaggggcaatttaattcaggaaacagaacaacaatttgggcaaacctttgtggactcccttggggggtgccccccaaaatcaacgcataagtgggtttttagaagcgcgcccatatggcggccgccacgaaaagtgtatttccttgccattttccgccgtaagtgccaagaacccctctttgggggagggatttaaagccccacgaacgtggtggattataaatggggtttccaaaccccttgtggggggcttcttcgggggggacacaaacatgctagtgtcatacgtctacagcccacctactattcgtacgtaacatgtgtatag

SEQ ID NO: 717115 - DNA, 345 bp, Homo sapiens
tcagagaatccgatacaacaaaaccccgtatgactgtaatgcatgtactgcacgctatcaccgtcgtcactccttccttattacacatcagagaattcatgctggagaaaagctctatgaatgtgatgaatgtggtacagttttcacttgggatgcatcccttattcaacatacgaagagtcacactggagagaaaccctatgtatgcagtgaatgtgccaaagagtacattgggacaagcatgctccttgtacatcagcgaactcatactggggagaacacttatatatgcaaagaatgtggcaagggctacaccatgaagagtactctcagtatccatcagca

SEQ ID NO: 717116 - DNA, 978 bp, Homo sapiens
gcacaagactgagtataagtttaacgatgcagaatagaaagagcggttctttatcggtatttattgacttgtgggaacacctaattaacagcacgaagaagaacaatgtacctctgaaactaactgtaaatttattgaagacaggctccatctctgactaccacatcttcttccactattatagcgcacaggttcacatataggtgagtattcagttaagattgaagagcaattgcacgtttcactgtacatctcggtcgtaaggggtgcactgacataatcgagctgctatagacgacaaagctgccggtcagtgctgtggacaattgtgaataaaggaagatgacatttcataaatataggacaagaggagaaccttgcgtagcgattcggataccttgctacgtttacgacatgtaaaatggtacttccccccgtcgctcgagtggagtgaaagtggctatggccgagtaatagggtgatgcgaggagatgggaagcaggatggactgataaatctgataattgtcatttcaatcacgactgagttaggcgactcgcgagttgttatgcaacaaattattagtgagtatagtggggtaattcgaggatgtgtgagttactcgagcgcaagtttctattctcatgtgttaaaatgatatgagatagattgcgcatactcttattcgaaatatgatgaagagacgtgtactgctactactactatgacggagatatgtgatgaagcacacacaggacaaagagtaatgccaaatgaagaagaagacgagacagcggcatcttgtcaaggatctgttgacattgcgcagtgagaggagtgggtgagtaagtggtcggttctaattctattgcgtgttgttacccacaaatatatctcattacgatagtatcaatgtgtaagatgatggctggattataagtacacatgctagtatttatagatgtgtatagtgtgtag

SEQ ID NO: 717117 - DNA, 819 bp, Homo sapiens
  misc_feature (128)..(128): n is a, c, g, or t
  misc_feature (292)..(292): n is a, c, g, or t
ggtgtaacgacgtttataacgcattgccgggatctggaactttccaaaagttgcttgaaaaagctcacaaatgttggttggactgaaattatgagggctgattccccatgaggctttaaacttcatangaacacttttggctattacactccatgaggcatctgaaacggcaacagctaggtctcttacagtgctttcatatgtcatgacaagtctcagcatcagcacgtcagagtagtcagaatgactttcgtgcatattcatgcatgaacatgctcagatagacatcctntgcgtcagcatagcatgtgcatacatcatgacgatcaccaagatcagcaactaatagagccgattcagcaggcatctcatcattggtctcgtcgacaatgcagtgggtttttactacagtggttcgtcacagcattcgttcatgtaactgtagctcgaatcttgattatcacagatatacttggcaaggtacatcctgtcatcagtcatttcaagcagatctccatgacagcgctccgtgtggactgtggtaagatctgtcactaactaggaaacgtctgcatactcagctttgcgaaatctctggctcaggcgagctactgcccatgctttaacagctctttctccaaatttatggagactggcacacttgagtctatgtttggcagacgcagccttcccttcatccagaagttcatcgagctttgccagcaggcaggcagctttatcaccaactcggcggcattctgtcaaagcagctttataccttttagcaaagaaaaggagttacggggcataatagctggt

SEQ ID NO: 717118 - DNA, 450 bp, Homo sapiens
ggtgtggccagacctgctattctagattagatcagtgcccataccaatggtaaaaattttaggatatcattcttaaatgtatacataccacatatgtatggtaatatttacgtgtgctatattagaaagtatttattctgttaaatatatatatgtgtgtatatttttaagtcttccgacagacttctttgacatgttatgtcttcaggaagccataggctctcatgggaaattggtgtctggaattatcactgcattaatgtaataatatatatttactagaacagtggtttgacatatgaaaatcttaatttatacaccaagcatacttgaatgtagacttttccttctctatagaccagaaaccatggcatttatttggaattgcttgatgtcactttaaattgagacattcaatccattcctcttttgaatatgaaaaactttttc

SEQ ID NO: 717119 - DNA, 622 bp, Homo sapiens
  misc_feature (223)..(223): n is a, c, g, or t
acaaacacaggccgatgctatagattatgatgtgacttcgcttgagattaggatcagttccacatatattcgactcattcaacgcagtaacaagactgaggctgaagatgtagtatagaagggcgacttgatttggcaacaagtttataggtatgctagcgttgcttcgttagcgacacattaagtcagattatatgtgacatatcgtatcggcgcgcctttntcgactcttataatcatatcaattgtcttgtcgtgtcatcgcaaccaacgatagagtgggtggtgcggttggcatatcatattaccttcatacaacaaatatagttcggtgacatccctaagcaggcaagaaaggtacaaattaaatacatagtggtttggtttaagttagttccagtggtgggtagggtgttgttacaaaccctgttgggtggtatttccagcaacgaatgtgggtgggtgatatcctgctgcaggtgggttttgggggggcttactttgggggaaaaagagatccagtggtgggattttttaagcgaacaaaatttgttcccctgttggacgttgtcccacttcttgttttaactctgtgtcaaccgggtggggcgtggtcgccctc

SEQ ID NO: 717120 - DNA, 1003 bp, Homo sapiens
  misc_feature (665)..(665): n is a, c, g, or t
gtttccgtctggttccacagttgggggcggtgtgttgtgtgcaacgggcggtgatgtttggtgtagcgaaggcgtcgcccctggtgtgtcttgctcacgcggggtgtttgcgggggtgttgtgtgtggggccgcagcttgttttcagctgcccgccggggaggccgccgttgtgccactgttgtgtgcttgacgctcccgcccttgggggggccgcagcccgacgggggttgcgccccgccggcgtggtcttggggtgggcgccatcttggtcaggtggtgttagtgtgtgtccgagcggctcgggtgtttgtgttgggaggggggggtgtgtgccgccctgttcgcccctcctcccagtcggtggtatgcttgtcgcggggggtggccccttcttcgtggcacagtggtccccgccgcggggtggcgcgacgcacacttgtctgtcgctcggcgcgcagttgctctgtgagggcccccttccccccttgtttgtccccacgggagggcacgctcccggagatattgggttcacacggcctcttttcttctggccccacgcttctcggggaaggaaaacactcggaggtgggtgtctccacagaatgtcgcctctccacgtgaccacacttgagagtgtgagaatgaccacactatgaggcttgngcgcacaggcctcttcacgctatgggctctccacgacccgcagagggccaagatgtccccccacgaggcgcctcttcacagccatattcttcctcaaaaaggaggccctccccgatatgttgtttcttgtgatgtcttcgttcaccactccttctttgtttccttctttttcacccacgcctaaggccctggctgacaccacggagagcccaccgttataacttgcacggtccaccgtgaacatagaccacccccaagagccaccttgctctgtgtattcccccccctcatgatcccccttttattttcataataaagagtgacgttaccccttgtta

SEQ ID NO: 717121 - DNA, 305 bp, Homo sapiens
gtggagaccaggacgccatccccattgatgacatcctgggacgagtccagggtgaacaggccgctgatgaagcgggtcgccgcgttggacaagcgggtgttgttgttcagcgtgacctcggtctcccggtccggcggatagacgaggtggaaatccgaggcgaagttctggatggtgccgaggaggacttctcctgaggtcagcttgatcttggcgcgaacggtcattggtctccctacatcggtgctctcagagagcgtgtatctctgattattctacaacatcggtggtcaccgagtcgagaa

SEQ ID NO: 717122 - DNA, 451 bp, Homo sapiens
aagcaatagtggctatagacaacggatcaacaaatgagcctggtcatgtaatcataaaacttatacagactctgatattttcatgagtcgtgaaatgtaattcttcaacagactttatttttcaaccatttaaaaacataaaaacccctttaatacatgagtgtgggccaggtttggtctgcaggctgccagcctatgctttaggggattgggtgccacgtgcctggaggggtggacttcgaaggcttctgagatgctggtaaaattctgtcctgctgtttacatgagtgtgtcttttataaaactgctttgagctgtacacttgtaatttacatatcttcctgtatgtgtatttcaatacaaaatgttttttgaaagtgcttttaaaaaagaaaacaatttaaaaattaaaacaaaatttgtctacaaaaacctaatataggtgaccaac

SEQ ID NO: 717123 - DNA, 1040 bp, Homo sapiens
gtctgcagggctggtcgtggacgtcgctcgtgctctggctggctccctccccacagcgcgctggtgtgctcggcggacatctggctcgtgggggagggcgttcgggacgcgctgctgaggcgcccctcgtcgtagacgggcggcttcgggcctttcttcttagggtcgcgctctcgattggagtcattcggggtcctaaatactcggactcggtgggacggtcgacgtgacagaagcgcgcgagagggtcgtcgggcgccgacgcgaccaccatccaaagtgcgtgttccctaagatgtgcgcgtcatcccatcctcttcgggaaggcaggggtccctcaagcgtgatgtttggtcgtctgaataatgtgtcgaatcaacaggagtttccaaggaaacattgaaggggttgggatagaggtccttcagaacgacgcggaagggacgcggctggcgtaagggcggcaagggatatcgagcgagatggttctttcttgccatgagatgatgcaacagagaaaggaagacaatctaaatcccgtgggaagggggaagaagggcgcagggacggcattcactggcggtttgggtgcgaattctttaggggcgacagagcattcatggtcttcgataagtaaagccgcggtaatggccaggcgcttttttgtcaagacatgactctgcctttgtccatcgactacaaagggaacctcgccgggttattggcgcccgtactaatttaaagttggacacacgcttaaatttgacttagcccaaactgaaggaaggacaaaccgaacgtggaaggtgactccttcgggggtaattaagtcggtgccttgggggcccctctgaggttctagcctgggcccctataatagaaagaaaaacaattggatttttacttgcccagcgactccggaagtgagtaactgccctatcacaataagaaaggaaaaggcgcttgaaccttcggggtacttcaagtcgcaattaccttttttgcaggtcaaaagtgactaccatggaaggtcaagggac

SEQ ID NO: 717124 - DNA, 917 bp, Homo sapiens
gatcagacgtgcgtaacgcgtagcaaggtatgtcgatggggtccctcggcgtggttgagtcgaggaagatggggcgtcgttgtgattgctcctgtggtatatattcctggtgcagacgagattcaggcggtgtcaacggaattgcataagtccacgatgctctatcttgctcaagaatgcgattgctcttccaaggaacgcacttggtgcacagtagtcgtcaattatgacttgcatcgtttgaactgacgtttgagtacctgctatagagagacgcgagacggcacgacaaaggaaaaggggggtctgctccgatagttgcttagtaatccattaatttccttgtcgagtggttcatagagtctcaagactcgacatggtcgtaagttatcctctgctagtgcacagcatgcagacggatcttcattcgttagtaacacgaaggcgcattaccatgtgcgtatggtcatcggttctcaaggtacatcttattactgatgggtcttctgatagatgcagagatcagtatagttattacgtgaggtaatattggtacagtcggtagatttacaggaacatagtaagagcgtaatcgcaaacgaactgttatggggtggcataggaataggggggtcaggagggtttttcctccatggcgaggggattggacggtatgagtagtccatccggaaggtggggctataagtacagttgtcctagggagttgggaacggctccacggaggttcctactacgaggtcgctgacgtgcccaggcgtgcagttatcaagagtccgcagttctcagatgatcagacgtagattgcgccggctctcctggaacttcgacggttccaaggacgtcgtttccggcgaaacctcttggccaactctgttctgagattccgggccagacca

SEQ ID NO: 717125 - DNA, 514 bp, Homo sapiens
aattcggcactgaggggaagctccggctgcaacttcagttctgaccagaggttctgtgaaccttcaggatttagcaggtttccaggaccggtgggtgaatctacccggggaagttttggtggacaagagctgctcgccagctgtcggagtgggagaggccagcgtgctgcgtccatccacttcacctaacacctctgaagtgtctgccctgcagtgtggcaagcgtggtgctgagcgcttctaaatccgtcgctttaaagatcattagtacaatgttgtgagagggttagctccatttgaaaattattttcccgtgattacaaaagaagcgatgctgactgcagaagttagaactgggagaagactcatcacccccatgatcatgtcaacaactgccctccttcagttttggtttgttttgtgtgtactctgtcatctttccattgaggaaactcaggctagaagaaggataaaaacaaaacagaaaacaaaacaaaacaaaagtgccctgtag

SEQ ID NO: 717126 - DNA, 240 bp, Homo sapiens
cctcctctcgttccctcactgatcgtcctttcttcattatcagcagacaccattacgcaccaattcatggcagcctttcacatgttcactcctaatctcagcgcacagctatcccatatttcccccctgcatttttacgggcacttctcctacgtgggttatcaggcaccctaatccttggcggttccgggaacagtcctatacagcaccatgcacattgcattctaatcaaggattgaa

SEQ ID NO: 717127 - DNA, 259 bp, Homo sapiens
tttttatgccccacccccccaagttggggagtgtttttgggggtccaaagccctcccccagccaggaaaaaacctcccggaggggttttttgtggggccctgtgtcccctgctcgggagtaagggtggttttggggtcctccctgcacggacccccctgggcctgccgagtgttgtgtttttcctcagtttgggtgtgggcaggagcggcctgcccagtttcccccagggtgagggcaaaataaaaacggggagtgtta

SEQ ID NO: 717128 - DNA, 498 bp, Homo sapiens
cacgaggtctttttgccatcaaaagtcctttttggggtttattttcatccccacttcacactgcatgcaggatttgaaaggctaagtgtagacactaaacaggtgtctgaaataacaattcacctctctctcccccgagggaaatcaggtgtcgccacaatgttctaactcagacttaaactatctgaagatcagtgcatgcatctcttctgggaacagcataacgttccatctcagctggtgggagatgaatggagctcagatggtgagctttggggtgaaatttcccaactttcaggttatccctacctaccaacgcactacaatctgggtaggacccagcagggcgtggagccaggcaacgcattgtgtaggaatcccagccaggcagcagctcccggagtctggcagcccctcctcgtgccctcagcttccccaaggatgccttcggatgcccagctcagaagcacacagcctcatcactagcctcatcactaa

SEQ ID NO: 717129 - DNA, 446 bp, Homo sapiens
tggccttatgcagcaggcccaggtcgtcattaaggagtgacccctttcctgtaacctgcactttgggatggtagaagtttctttacctgctgacaggtttggtggcactgctgttacccctgggccctgatggagctaaaatcacatttggtaccagcagcacatatcccaagtgtgatccttcatcccaacactacctcttggagctgttacactgggtagagctagcatgccagcagattctgcaggctccaaacacaggccagaagccagactccagcatgctgcctgaatctgcattccctatttccggtttccctaaaccaacaatggtttttccaggccttctagggacccttcacctaagtaggcatttactttattggtcttacctatgcactttagcttataaagccatttaaaaacgatgattagagaaaaaaaaa

SEQ ID NO: 717130 - DNA, 534 bp, Homo sapiens
ctcacgactgggtttcaagactagttcgaggctgaggctggatgtcccttcccatactgccaccttggcactagagggggccctagggaaaatgcctacttgtattgaggaggctgtgctatgaatgagctgggcacaagacggtaggctcactgtgcatgcccaacaaggcagggtgctatattgctggccaggcgctttctcttccgctgcccacacccccacaccctggcccagcacatggtctggcaccagcacctggctcggctcatcatcagagctggttctttagtggatgaagggaaggaggacatacctgagggagcaggatgcagctcagagccatttaattttaacatgcaaagaaatgtgagcttaattagtactcccccaccctgatgggtgtgagatagaatttattgttcacagatttattcagtaagctgatgagaagctctttaaaggggcaaaaaaaaaccgttagcggagccaacatgagctcatcaaaagccagtcttgcgaaaacaaactcat

SEQ ID NO: 717131 - DNA, 331 bp, Homo sapiens
  misc_feature (62)..(62): n is a, c, g, or t
agccaagtggggcaccggggcccaatggggcagcaaggcatcctgggcatctctggcccccngggtcccatgggccagccaggcaaggttgccccctttgtttcccttgattgttttggcccatcccaatggagcaccagtccccccccccataaacccatgaagggcccttttggttgaaattccccccccccctttggatgaaaaacccctttgggaaaaaagggccaaagcttaaaggcctttgtgccaggttgggaaggtttttttttttgtggtggtggtttttaatggcggttaaaattttttaaaaaataaagaacccaaccta

SEQ ID NO: 717132 - DNA, 298 bp, Homo sapiens
  misc_feature (50)..(50): n is a, c, g, or t
tggctcctcttcagcaagctatctgtaaaaccagctcaggtgggcatagncctgaactccagggttgaatcagtccctactgtaccctcattttatgctggagttttggctttcaatggccttcatcgtcagaaatcccttggaattcacaaggctcattcccttcaccgggtgtctccaggtagctttgcttaatgttcttccgtattcagggcatattcatttcaatcttccttcccacggtggactggctcatattggtaaagtcccctcccattttcactaagattagtgggta

SEQ ID NO: 717133 - DNA, 361 bp, Homo sapiens
  misc_feature (40)..(40): n is a, c, g, or t
ctgatccggagcgccggatgctgattgaggcgctgggtcnctctgcgggtgccgaatgatattgaaggcatccttgcgcggcggcgcggcccaccttggcgcgcatctgctcaaggcagagaacgaacatgtcgaactgcatgaagtccggggcttcatggccggtgacgtgaagggcgcgatgaaagaggcgcaggccgtcgcccaagggacgcgctgcaagcagttcctgttttcggtgtcactcaacccgccggaacaagaaccggtgtccgtcgaaaccttcgaacgggccatcgagaaaatcgaagaacgcaccggcctcaagggtcagccgcgcatcgtcatcttccacgaaaag

SEQ ID NO: 717134 - DNA, 113 bp, Homo sapiens
ctgaaactggggcttcacatgctgacagaacagctacaaaatctggggtatcccatcctacacgttcggtcatttagctagcataggtacaccagaactacaggaaaagatgg

SEQ ID NO: 717135 - DNA, 725 bp, Homo sapiens
  misc_feature (8)..(8): n is a, c, g, or t
  misc_feature (87)..(87): n is a, c, g, or t
  misc_feature (99)..(100): n is a, c, g, or t
  misc_feature (118)..(118): n is a, c, g, or t
  misc_feature (126)..(129): n is a, c, g, or t
  misc_feature (131)..(131): n is a, c, g, or t
  misc_feature (141)..(141): n is a, c, g, or t
  misc_feature (146)..(146): n is a, c, g, or t
  misc_feature (176)..(176): n is a, c, g, or t
  misc_feature (180)..(180): n is a, c, g, or t
  misc_feature (197)..(197): n is a, c, g, or t
  misc_feature (199)..(199): n is a, c, g, or t
  misc_feature (225)..(225): n is a, c, g, or t
  misc_feature (230)..(230): n is a, c, g, or t
  misc_feature (251)..(251): n is a, c, g, or t
  misc_feature (259)..(259): n is a, c, g, or t
  misc_feature (268)..(268): n is a, c, g, or t
  misc_feature (377)..(377): n is a, c, g, or t
  misc_feature (379)..(379): n is a, c, g, or t
  misc_feature (383)..(383): n is a, c, g, or t
  misc_feature (397)..(397): n is a, c, g, or t
  misc_feature (471)..(471): n is a, c, g, or t
  misc_feature (490)..(490): n is a, c, g, or t
  misc_feature (502)..(502): n is a, c, g, or t
  misc_feature (513)..(514): n is a, c, g, or t
  misc_feature (517)..(517): n is a, c, g, or t
  misc_feature (530)..(530): n is a, c, g, or t
  misc_feature (545)..(545): n is a, c, g, or t
  misc_feature (623)..(623): n is a, c, g, or t
  misc_feature (644)..(644): n is a, c, g, or t
  misc_feature (650)..(650): n is a, c, g, or t
  misc_feature (664)..(664): n is a, c, g, or t
  misc_feature (724)..(724): n is a, c, g, or t
tgcgagancgccacctgagcctcaccgcttagttcataaaacagccctgtgtcctttctacaaagccaggtcgtgttttctacccanagttcaggactnnagcgtagacagcaaacanaaaacttnnnnantttttgaaanaaaanagtcttagtagaagcaaaacaaacaaccanaatntaaaccagccgcgaggnanaatttcctagctggaaaggagaatangtcanaagaaaaaaaaaaaaaaaaanatgggaanatgcctgtnccacacccttgaatgtggtccacagattcaccagctccaaggcagcatctctttccaaagcacctgcagcaggaggctgtgtggggcaacaaagtcactcctgatacananaatncccccccgcccgcngccatccaaatggctccatgcacagctggcccctccgcttctcaactgtgcgctcatgtggctttgttagagtnttgggggtgaaaggtgtgngttataggtggnagcgtggctcnngtngggccatttagtngggcggccgggtgtngggggccttctcctggacttcatcatactgcggtggaggagtcaaaggctctatcggggggggagggacgtttttttntgggaggttgatcctaaaatntttgangtgaagcttttcanatttaatccttcgaactttcagtggtttcagtcgtttggccaacttagagttctgcctgng

SEQ ID NO: 717136 - DNA, 297 bp, Homo sapiens
tgaaagcacacccccaggtgccggacggggtggaagtgcgcggcaagcaggtcgcggcttatacctgggatgaccgccaaggcaaaaacctgctggtactcgccgagcaagtcggtgagcgcgatgacgatggtacccaatcggcctttgtctacgcggcgcaatacgtgctgggtggcgagcgccccaagcgcgtttggatgctgtacgacgatgtgcagcactgcgaattcgacgccgggctgcgctttgaccgggctgccaccaaggtcaccgacctgctgggcgacggcaata

SEQ ID NO: 717137 - DNA, 266 bp, Homo sapiens
gccgacagtatctccgaatactttaatacttgggttgaaaaggaagcatgcactgtttcccacgtgttgtcccagtactttagtgttatgatctcatttgggttttggtaaaagcaggcttcctacaagcctagtaaaggaaattctttctttctcatttggccaaatgtagcatttaattgattttttttttttttttttttttttttttttttttttttttttttttttttttttttttatgtgggggggagagagaggggcga

SEQ ID NO: 717138 - DNA, 830 bp, Homo sapiens
gagaacctcaacgggaaggagtctacacagtcttcgtctcccacatatgaaggccttccgagccctgtcaccaagagaacggagcagactcttggtgagatgccaaggaacttgccaactatcctgaaataccacattggtgatgaaatcctggttagcggaggcatcggggccctgcgtgcggctaaagtctcatccgaaaggtgacaacgctggtagagtcagcttgtaataaacgagagtgtggtgagtgtcaacgaatggagcctgttgtccgagcctgactatcatggccacaaagtggcggtggtccgatgtcaatctaccaatgtttctgcagcctccagccaagcaagacctcaggaagagaggggatgagacttgctagactctgtcgcttgtaggatcttcaggacaagcagtcagcgcttttgccaggggcttcccagaggtctgtgcgacgtaggcccctgtctagtcaaaagttagttagagaggatgaagcattagctgtgaagcactacaggaggaatgcatgccacggtagctctccgccaatttctctcagatttccgcagagactgtctgaagtgtttgtcaaaagccaagtatcacactttaatgtacatgggtcgcaccataatgagatgtgagcctcggtgcatgtgcggggaggaccgagagagaatgtactttgtcccatcatgttcccctaagacatggtgtgaacccactgatgcaggaaacttgggatgtcactgctgacgattcacttacagagaggacctatccaaatgtggaattgggggctatgccaagtcctggaaagc

SEQ ID NO: 717139 - DNA, 265 bp, Homo sapiens
ctgtttttttttgtgtgagcaataaagctgtttatttcacctgggtgcaggtgagctgagtccgaaaagagagtcagcgaagggagatacgggtggggcccttttataggatttgggaaggtaaaggaaaattacagtcaaagggggttgttctctggtgggcaggggcgggggtcacaaggtgctcagtgggagagcttctgagccaggggaaggaaattcacagggttaatcactcagttaaggtggggcaggaacgtcgacg

SEQ ID NO: 717140 - DNA, 640 bp, Homo sapiens
ggtaaaacgggagatgcgccaatcttgaagtttggtgagtgcccacctgtgatatgggtcccgcaaaccccagtgtgttgagaaacttttctagacttatcacaccctttgggtctcctttctgtttttgtgattatgtagacccagaacagttgtcggtggggggtctatctctcaacacagtgggcacaatagaaaggcttgctgggaactgggctcaaggtctaccccagtctctgctccccagataagacgtccaggataggcgcttataatggattattatctcccttatacactgcgccacccccacattttaataccagatggtgggtagaaacaggtttctcagaaacatggtttgttgttctctattggctcattttagatgtttaggttagttaaagaactggggtttatagagtaccaatagctgatctgtgaaaccctgctcagaagagaataaggaggaatgtttgttgtgggcccctcttgggttttttttttgcgtgtggcccattttaagagtatattagatttttataataccagaaacattttttaatgggaaccacttggaccccaaaatggtcaccagaaaatgtggagacccccattaaaaaggtttaatggaggaaaa

SEQ ID NO: 717141 - DNA, 219 bp, Homo sapiens
gctcgaccaacctaataaattccttatttacacctggtaagacagcccatttcttttgtttttgttttgttttgtttttgagacaaagtctcgctctgttgccaggctggagtacactggtgcaatcttggctcactgcaacctccacctccagggttcaagtgattctcctgcctcagcctcccgagtagctgggactacacacatacgccgtcgacg

SEQ ID NO: 717142 - DNA, 120 bp, Homo sapiens
  misc_feature (4)..(4): n is a, c, g, or t
caanctctcctgtttccctgtctctactaaaaatacacaaaattagccaggtgtggtggcgtgcacgtctgtagtcccatgctactctgtggagggctaatgacaaggagaaatcaactt

SEQ ID NO: 717143 - DNA, 828 bp, Homo sapiens
gcatcatgttgcccaggctggtctcaaacttcaggattcaagtgatcctcccccagcactttgggaggctgaggcgggtgggtcacgaggtcaggagatcgagaccatcctggctaacatggtgaaacccgtctctactaaaaatacaaaaaattagccgggcgtggtggtgggcacctgtggtcccggctacttgggaggctgaggcaggagaatggcgtgaacccgggaggcagagcttgcagtgagctgagatcgcaccactgcactccagcctgggcgacagcgagactccgtctcaaaaaaaaaaaaaaaggggccattcaccttccaccattgcccagttcacattgtcctgggttctctgggccttctcttcctccctcaagggaagtcctactcccctctgcggggtgactggttggtgcccccacccatctcttccccaagcactcacctgggctgggaccaggtctcacgtctcagtggggccgctccccggggaccacccaagcccttccctctttcccaggactccacccctggtgactggtgctcacgttgggtgcatccctcgtccggtctccctgccaaggcctgtgggctctgcagaaggtgcccattgaaagctggtcctgtgccctctaacctcagaggggttcagagccaagctccgaggaccccctgcgtgtcaaacagtgtcccctgggaacacgttgcgggaacagtcctgcaagcaggggactgttggccctgtttcggaacagctttctggagaagccagtgaaggcccagaagttggcgtgaacaattaaatattcttaaaaa

SEQ ID NO: 717144 - DNA, 916 bp, Homo sapiens
  misc_feature (114)..(114): n is a, c, g, or t
  misc_feature (144)..(144): n is a, c, g, or t
  misc_feature (150)..(150): n is a, c, g, or t
  misc_feature (164)..(164): n is a, c, g, or t
  misc_feature (204)..(204): n is a, c, g, or t
  misc_feature (207)..(207): n is a, c, g, or t
  misc_feature (230)..(230): n is a, c, g, or t
  misc_feature (310)..(310): n is a, c, g, or t
  misc_feature (336)..(336): n is a, c, g, or t
  misc_feature (342)..(342): n is a, c, g, or t
  misc_feature (387)..(387): n is a, c, g, or t
  misc_feature (403)..(403): n is a, c, g, or t
  misc_feature (429)..(429): n is a, c, g, or t
  misc_feature (457)..(457): n is a, c, g, or t
  misc_feature (459)..(459): n is a, c, g, or t
  misc_feature (572)..(572): n is a, c, g, or t
  misc_feature (579)..(579): n is a, c, g, or t
  misc_feature (597)..(597): n is a, c, g, or t
  misc_feature (691)..(691): n is a, c, g, or t
  misc_feature (711)..(711): n is a, c, g, or t
  misc_feature (720)..(720): n is a, c, g, or t
  misc_feature (766)..(766): n is a, c, g, or t
  misc_feature (803)..(803): n is a, c, g, or t
  misc_feature (835)..(835): n is a, c, g, or t
  misc_feature (884)..(884): n is a, c, g, or t
ctcacagatctcctgaaaggtcctgggaccctttggacaaagaactgctgtctacagaaatacttgtatacaaagattctcactgaagcaatattttgggctggttggtttttnttttttttttttttttttaagacagtgtcnggcccngtgtcccaggctanagtacagtggggggatcttggcttcccgcaacccccgccntcngggcccaaacgatcttcccaccncagcctcccaagtagctgagactctaggcacacgtcaccacacctgcctaattttttttttttttttgtagagaaggggnttttgccatgttgcccaggctagtcncaaacncctgagcccaagcaatccacctgcctcccaaagtgctgggattanaggcatgagccacagnggccaacctgaagcagtgtttttaanagcaagttatgagaaacaatataattgncnagctgataacttttttcactggatgttgagatttagcaagcccaccaccccccagggcacccattcatgtgaattatcttctttcttgtgtatgtagaatggcactagtttanatcatcngggggaatttttaaaaanagtcattcaaataaatttttgttatgtggttcagatgaggaacctcagttgaaagaaactgttaaggaatggtaaattggggtacatttttctncagcagttaaagagaataanacaaatctntcatgaaatgaaaaaatattcatgacagtaagtgaaaagttgaggncaaaatatatagtatgatcctattttgtcttaaaaanaaatcccaaagcagaactgtagctgggaattncatgtgtaaatttacagacagaggcctagaagtttctcattaaaactcntaactggctacatctgctaagtcaagtagggg

SEQ ID NO: 717145 - DNA, 742 bp, Homo sapiens
  misc_feature (91)..(91): n is a, c, g, or t
  misc_feature (140)..(140): n is a, c, g, or t
  misc_feature (155)..(155): n is a, c, g, or t
  misc_feature (171)..(171): n is a, c, g, or t
  misc_feature (176)..(176): n is a, c, g, or t
  misc_feature (190)..(190): n is a, c, g, or t
  misc_feature (202)..(202): n is a, c, g, or t
  misc_feature (206)..(206): n is a, c, g, or t
  misc_feature (210)..(210): n is a, c, g, or t
  misc_feature (217)..(217): n is a, c, g, or t
  misc_feature (249)..(249): n is a, c, g, or t
  misc_feature (258)..(258): n is a, c, g, or t
  misc_feature (261)..(261): n is a, c, g, or t
  misc_feature (286)..(286): n is a, c, g, or t
  misc_feature (300)..(300): n is a, c, g, or t
  misc_feature (310)..(310): n is a, c, g, or t
ggccgagcccgcgccccccagaccccgagagctcgcagctccggcccggcggcgatggcgcggagcgtgcgcgtgctggtggacatggacnggcgtcctggccgacttcgaggccggcctccatgcggggcttccgccgncgcttccctgaggangccgcacgtgcctgcntggangcagctgcacgcanggcttcctggcnccgncgangcagtanccgcgtcccctgcggaccctgacctggcggantaaagtggncangtgtgtacgaagcccctgggctttntcctggacctggangcccatcccngggagccttggacgctgtgcgggagatgaacgacctaccggacacgcaggtcttcatctgcaccagccccctgctgaagtaccaccactgtgtgggtgagaagtaccgctgggtggagcagcacctggggccccagttcgtagaacgaataatcctgacacagggacaagacggtggtcttgggggacctgctcattgactgacaaggacacagttcgaggccaggaggagaccccaagctgggagcacatcttgttcaccttgtgccacaatcggcacctggtcctgcccccgacacggagacggctgctctcctggagtgacaactggagggagaatcttaggatagcaagcgcggagctgcgcaggcgggaatgagcggggatgccggggcagcagctgaaagctaacgggaggggcaggccaccaggg

SEQ ID NO: 717146 - DNA, 760 bp, Homo sapiens
  misc_feature (609)..(609): n is a, c, g, or t
ctcttgagaagggaagttgcagagtcttgggcgtcatttacagcagtatttcaacctgttgtaatgtatgccagataacggtgtggcagagaagacacagcttctgaatattgagtgtaccgtgctacttggtatgctctgtgtcttgtgcatgaatggtccaggtcctccagatcaaataccagtatgctgaattaggcaaattatactcagtagtgtcagagcctgtatctcgcgtggtgtgacatactgtcatcattgcagagtagactgcagttctgtcaattcaaatggtaaatcctgccatcgtatcccaactcctgttatggctgaatcctcaacttgtatctaacaaccctagtatagtggtcgcatatctacaagtcgagtagagtgtagggcatggagctacttttgattatgtagaagaacgagaagatatattgatgagaggcaacatatcatatgagagtccttgctggtaaattgcagtacggaaaacgcggtacaagattcgctctcgatcttttctcgctggctgaggagtaatcctcgagttctcaatctactgatcctcagatgaagctactctggacaggttgacagtanttcctaataaccctatgaacgtgcggaccctagtttggagtcgtggcctttgtgcagaaatcattactagatctgaggaactcctgggtcaaaacctcgaagaaattcataacctgcactgaaagggaattcgcagatgaccgagagtggg

SEQ ID NO: 717147 - DNA, 785 bp, Homo sapiens
  misc_feature (380)..(380): n is a, c, g, or t
aagaaatgtgcagatcctgatatgaatgctgtcctttataccaagccggtcaggagctcagtactatctgggcaattttctgtgctgctctcaatagatgtgacagcttgcgcagatagctaaatacacctggccacacgtcaatagcaataataagtaggtgccttatgccatactgagaagctgaaacactttgccgaggccgtgaactggtgtgatgagggactgcacatatatgccaaaagataagaagcttctggaaattgacgtggctaaatgcatcacaagctgtaagcgcaatatgacacaagagcggcatgtgaggcaacaatgccaacattgaaacaagaacacgaacgtgagaggaatcacaatgaagncttgtactccaggtccatcaaggagctatggaatatcagcgctctcaaagatgctgcctgtgaggatgcaagatatcacgcactcgatgaaggggtctagagtgagacttattcctggtatggcagctcgatgcactagagaaccccgcatggagccaggctgagtctagatggccagggcaggactggagctgggctgtgctctttctgtacccagagtagtgcccatgtcggagttcatctctgtctttgtcatgaggactccaggcttgtattgatcatctaatggtgatgtttggtgaaacagcctcgttgatcacctagagcaaaaatattgcccggactaagtttggcggtctactgtgaggatgaggaccggcccaatactccggggagctgcccaat

SEQ ID NO: 717148 - DNA, 187 bp, Homo sapiens
  misc_feature (157)..(157): n is a, c, g, or t
atgggagtggttctcctttgaaggtttgaaggttctccaaacctgtatataacaacagagttaccacaaggctgagggggtagctttgcgatttggctccacatgtgtgcttaactgggtcagtggcaaagaggcagtcatggcgtccacgcagatnatagtaagattaatcctagtaatgacgaag

SEQ ID NO: 717149 - DNA, 248 bp, Homo sapiens
agaagcttgtatttatagcacacattgccacaaagacctaggttaggatgatagaattttccacggctgtgaattcctgccctaccatcaatacctgccactctgtacatcacaaagttgaaatccatgctgctttctcatatttcctcgtccactcacgaatagaagactatcattaaaacttctgtatctcctcaacgtttctgtgaagaacacaacctcataccaatggcacaacaacacaaaac

SEQ ID NO: 717150 - DNA, 793 bp, Homo sapiens
catggtggcttacacataatctagcacatttggaggccaaggtgggcggatcgctttgagctcaggagttcgagaccagcctaggcaacatgatagaacccagtctctgataaaaacaaaaaaaaaaaacacaaaaattggccgggggccacgggccgtgtagtaccaactacctcaggaggcgtgaggcgggagaatcgcttggaacccagaaaggcagaggtgtgcagtgagccgagatcgcaccactgggactccagccggggcaacagagtgagacctccgtccccccaaaaaaggttaatacttctatattggggaaaagaacaagatatgctctaaaagacaagccaagacctggggaaaaacaatctaattacttataaccaaagggggattagtacgtacgaatttaaaaagaactccaaagaatcaattaccaaaaagataacccaatttttaaaagggccaattggataccaagaaagctatggattggggaccaccccaactacctaataatactacccttttgtgcatatttataccatccccatatacattttagaccttcactagtaactcctagtacaacgacctaaagtacccgggtcttctggcctcatttttccctagctagaaaaacatttatctcaccaagaaccacgccctggcatgcgcgtgggacaacacagaactcatgccgtgggggattttgaaacggcatttggcagccctggcgctcctcgtcaccttggggcacactgttcctaagcccatccttcggggagcc

SEQ ID NO: 717151 - DNA, 204 bp, Homo sapiens
gcggccgcctactactactactgctcgaattcaagcttctaacgatgtacggggacatgatggcatacacctgtagtcccagctactccagagactgaggcaagagaatcgcttgaacctaagaggcggaggctgcagtgagctgaaatcgcagcgccactgctctctagcctgggtgacaaagcaagactccatctcaaaaaa

SEQ ID NO: 717152 - DNA, 279 bp, Homo sapiens
  misc_feature (275)..(275): n is a, c, g, or t
tttttttgatttttttaaaaaataaaatgtgtaatcctgtttctaaaagaaacacatgtaattacatttaagtattgtaggcatagcgttcagatgtgactggcgcaggcgttcctcggacaagcttgcattccccgtgatcacgcccacctcaagcccatgggggtgcagcccagccagcagatgaattgtacttttgctttcagaaccacttagtccttttgtatcaaagaaaaaaaaatgtttcgtacaatgtcaataaaaaattctttgtntgga

SEQ ID NO: 717153 - DNA, 208 bp, Homo sapiens
tgggaggctcaccaacatatatatgagcatttactttgtacacttcaccagatcctaaatgcttcacgtgcatcctctagtttaatcctcagaacaatcaggtaaggaaagtattcttatgatcctctactttcccactacagacaacgggacatgcctgagaagttaaataacgtcgcctataggcccataatttaacgaagaagca

SEQ ID NO: 717154 - DNA, 223 bp, Homo sapiens
caacgcacgcgtgtgcttggatggggtgccctagccagttttatggtatgagaaggacactgttgtggtccaggatttgggcccatcttcactcgtcctgccactcaatgcggatgtggcatcaggcactgctgcgctcaggggataaagtgcgcattgaccccccctgtcaccaacacaacagctgcttccacctacctcaacaacccgtacggtgcgttgg

SEQ ID NO: 717155 - DNA, 370 bp, Homo sapiens
tatacatcagaatcacgcttctccggctggtgtagactttctcgtgacctttcagcctgcaaggttttctggggtgggagagtctcctctgggcttggggctccttctcaggtgaggaagtgctctaggtgggacctgtcacttggctgcacctcaggctccgatgccaggtgcccgccatcctccgctggcttccgggccctgctcagctacctgcttgcctccagccggctgaccctgttcgccctcctcaagcactgctcttgcgggctccagtggcttccctctccttctcttctgccttctgctttctccgagatcatctggctgaagctcttgcgctgcaggtgctgaggagggcggacagggt

SEQ ID NO: 717156 - DNA, 378 bp, Homo sapiens
cagtcactctgggaggtggtggatggtattactgggcccgtttttcattggggaaactgaggctccaacactgaaataattcacttcacctggagttgagccaagattctctttactccaaagccagcactccttctgagaacaggactttgatttggatggacggatgttgctgggggcctcagcacagggtctttgggctcacagctggacatgcagctgttcagcggcagctgcggtctgtccacccaggcggagactggatgcaacagtttcaggcggggttcctccctccccaggtgcctgcccacctctcccttacatgggatgtctctcttcttcctccttgcctggtccctaaagcacttgagtttgtgg

SEQ ID NO: 717157 - DNA, 919 bp, Homo sapiens
  misc_feature (726)..(726): n is a, c, g, or t
gcccggcgcggtggtcacgccgtgtaatcccagctctcagggaggctaagaaggggaaggatagtggagcccatggagttcgagaccgtgcctggcaatatacgcagagacccgtgtttctccaagaaaaggtgacacaaatcaacaaagccaaagacggggccaaaaaaagaagtaaggggggaaagttccctcctaatggggaatctccaaacctcgcgggggtgtttcccaaggggggatttcccgggtgattagaaggccccccaaaaggggggagggcggacacaccacggtgggggtctgtggctctcaaccaagttcggcgcgcgcgaccaagggttttgtgtgcgacattgtgcaaaaggtccagcaacacgaggggagtagttaccaccccacatgtgttgttgggcgacccagagcgggggtggggactgctagtgacgaaccctccgtggggtgacccactaagaggaattggtaccccccaccgcacaaagcttgtgggcccccaccaccaaaagagcgggcccagagagtgagaccacacacgagtctctttgtgtgcacccccaccaccgggtgggttctttgcagcgcaggtggcccaaaaacaacattttttttaaggtgaggaagaccgaaaacagttttttagtgtgttttcaaagaaaaaagcgagtggtcttcaacaatagactgtttgtgaccgcatgggtgganaaaccagcaaaagagtgggtggtctcaacacaccctgtggtgatacactcacgagaaggcaccgggtgggagagaacgcactggaggggcacaatctacttgggtcgcgagtggaacaataaagagcagtgctggtgtcaagacgcttcacagagagttgtctctagtatgaagacaacaaatattagcggcg

SEQ ID NO: 717158 - DNA, 93 bp, Homo sapiens
actcgcgagcagcggcggccccgccggcggccgaattgggggaatgcggcggcgctcgcggatctgctctgcttcgccttcctgtgggtgctg

SEQ ID NO: 717159 - DNA, 527 bp, Homo sapiens
tgggatgggagtgatgcccctggaggggcagggctgagggttggattcccatagaggacagaggagtgtttcagggcccactttggaacccacactgagcctctggtccagtgtcccagcctggctcatccctgccctcctcaggtctctctgttgggaggtaacctagaggccgctgaacccttagccagatcgttcccgaacctagtggcatttttaccttctacctggaagaatgtattttatacctttactcccattaattatatagaactcaatgggtattcctttattattattattaatttggaagggagagatttatttctcatcaggggttacagcctgcatagacattcttttttatttttaatttcttatttatttatttttttttttaagagatggagtcttggccgggcgccggtgcgctcacgcctggtaatcaccagccacatcgtgcgagtacagccgcataggggcacggtgcgatcgatctgaggtcaggagtttgagaccagcctgcg

SEQ ID NO: 717160 - DNA, 129 bp, Homo sapiens
ctgggccgcgacacacactacgacgacccctgcgccagactccggaggcacaccaatgcagcgctcgacgactttgcgtctctgtactgggcacccagcctctagggacccctcctccctttttccttg

SEQ ID NO: 717161 - DNA, 1229 bp, Homo sapiens
gggatgggaggcagaggaggcggaggcagaggcagaggcagagcccgggtgccgagagcaagcgagatgaccggcggggctgggcctcgcaaagccggctcgaggagctctacacctgaacccgagccggggaggaaaagcagcgaatcctcgctcgcatccccgggagcctgactccagactggaccggtagtcatggggctcagtgagcagatcccgatggcaggcgtattgcgtcagcctccgacgatgggctggccctttggaatggctgccttcaacagcctggaccatgacattgccaccaatgaactgagaattccactgtcctgcccatgcgtgacaaagaccaagctgggccaatgggctccaagaagtccacagaccagcaccaagtattcagacatgatcgtggcttgccatccaggccgagaatgaacctgcgctgggtcctcgcgccacgtccattcaagaaagtatatcaagagaccactaccaacggctgggtggagacactgctcactcggcagatacaagtatgtccatcccaagccgcctggtcacacaaccggatgtcctccaagcagcacccacaggggtgggggagcccggaggtcccaaccgggctatgccaagagcccgagcgaaccccaatgaaagtcaagtgggccttcaatgaagaaccaagaaggggagatcaacggaagcgtagccaactgcccaacgcacaggcgattctaggcccaaggaagtggttggcgtccaaatgctccgaagccaaggagacactagaggcacccccgggtctgaagaaagtggccaaaggaaaggacagtcttggctggcagacgcgccgaagggaacagccgcaagaacacccgcaagaacatgctcagaagaccaagtggcggttccaaggggatttcagaagtagactacagagaaggtggcgcaaacaccatgtttgaaagtagcccaaaacagtcacaaagattcactttggcgcaatgaaagtgtcggttgccgtcaggaaccgtagaagtttgatcagagttgaaaagtagtatattatatatgtgcgtgatgaacagactgccattacgtggtgtgttagcgtatcaattatcttttgctgaaaagactaagcttttgctactgtctcataactccacccactcacttctggatgcttgtatacagcagacccggacccttatttggccccccct

SEQ ID NO: 717162 - DNA, 170 bp, Homo sapiens
cgtctgatgctgcggtatgttgtgctcagtattgaacagatgttgtctatcgacctcaaataacccattgctcgatatgctgatttatcgttgccgtggcaccatttataaagcacaaatcgaccatgatgatatgcgtggtttaattcgtcaccttaaagatggcgatg

SEQ ID NO: 717163 - DNA, 218 bp, Homo sapiens
  misc_feature (92)..(92): n is a, c, g, or t
  misc_feature (192)..(192): n is a, c, g, or t
gcaaaaatttccctgcccgagcacctcgggccgcccttttcattccggtttcctttgacccatttttgggtgagcgccagtgttttaaaaangggagtaaaggccaggttttaaaatggctttcccccccccccctgagatcaggtttggaatgttaaaagggcattttgtacatcccctgggaataaattnccttgcccttgggggcttcctttgca

SEQ ID NO: 717164 - DNA, 1390 bp, Homo sapiens
  misc_feature (1390)..(1390): n is a, c, g, or t
gatcaacatcctgctggagcggctccgtcctgcgtgggcagacacaaggtttgacacctactcgataggtcacttcggccgcaagctgccatgcgaccgatgacgcgttcgctcgacagcgggcaggacggaccccgtcccatcggacggtgcgggtgtgcggttggtgcgagtacgatgcgggacggtgcctagcaagcagcccgaggagcggggcatcggctcgctacgttcacgtgcaggaacttacagcggactcctggcctcaggtgccgtcagagtgccatggagctttatcatacggacgccaagcgacgttcaacagagtgcccatggtgcgtagttgttgagcccgcgcattcatagcgcgcgagggtcctcgatcttgggcgctttgcgcatacgcacatgatgggctggcctgcttcatatcgtcgaggaatggcaaaccgtcggcgacgtggccggcgcaactgcccccagacttgctcagttcggacgcagatgggccgagtgctagggacacggcgccaggtgaggccaagggcttttcgaacgactcgttcagtggggctccgggatcgtgggcgtccccgccacacggttgaaaatagaagcgccgcagcaattcctggcgctcccctcgggttctacactagggccaaggcgacggggccctgcacgttcaccggaacaggtttggggccactcatcgtggccgcatggaggccgcagcgcatgggttttcgcggttggttccgcccaagggcgtaccgcgagggcccctttggttcccgggcggggggtgggttcgttttcccaggccaaaggaatccaacgcttccttcccatgcgaaagggggttggggctcgccttggggggcattaagatcgcacaagcaaccttggcaatcagggcaccgggatcgaccccaaacaaccctcatttgattccctttcgcagcaaacacgcgcattcccccctacaaacgtccaattccaatcttaaaaaaccacggaacgttaaacacatctggttttgaacttgcacaggaactttttttctcacgcgaatgcacaaaaccacgtggaaattttccgcctattgagagttttggcctctctgctaacacgcgggcggcaagaggcggctttggggcagaccgcgcccagggggacccggcaaaagttggcgttcgagattgccctctggggttttattgggtgccaaaagggggttcccctccgcccgggggggcgcaatccaaagggccccccttgtgctgttgtgtgggagttttagcgcactttgaggcggcagagggggtcccctccttctttgtggggctgctaccatcgccgcctgatgtgagcgccaccagcgtggcgn

SEQ ID NO: 717165 - DNA, 154 bp, Homo sapiens
  misc_feature (147)..(147): n is a, c, g, or t
agccactgcccctcttgtctacgtattcccaaaattaaactttgatgcctgactttttgcagtcagttttaagtgagctccctgaggtgccaaggccatggtgtccccctgctgcgtctgttcgtcagctgagttcttgtgaatctntgtttag

SEQ ID NO: 717166 - DNA, 163 bp, Homo sapiens
agaagtataacagcaatttcatagagacattttaaggactgcacattaaaagaccaggccagatggtttacagggaattaacttaattatcaaggaaccatttagttccaatgctacataaattatttcaacaaaataataattggaggaaatttccaacctc

SEQ ID NO: 717167 - DNA, 380 bp, Homo sapiens
tcctttgggtcccgtttgcactctagcttaaccaataggctcagagacagcaaatacccttctgagaccacacgttggattgtggtcaggaactccactctctggccaccacacttcgtcctggtcacatctcactctaaccctcgctggagtcagaatgataagtttacaggccagtctggtgtgactttgtaagaactacctctctggaggccaagtttaggtccctgaccattaactctgaaaacccattaccccttcctcctctgctctcctccatcccgctccccgcaatggccgatggaccccctgtgggcatgatagatccatccctcctaagggaccgatcctgtctatctccctgtcccaggtactttaag

SEQ ID NO: 717168 - DNA, 228 bp, Homo sapiens
  misc_feature (66)..(67): n is a, c, g, or t
actccacctaactacaagcgaaccttagccaagccatttacccaattaaggattagaccgttagannttgaaacctggcgcattagatatagaaccgcacgggaaagatgaaaatatattacccaggcatattatagcaaggcctaacccctatacctcctgcatattgaattaacctagatatacctctgccaaggggacccaaagctaagacccccgaaaccagac

SEQ ID NO: 717169 - DNA, 221 bp, Homo sapiens
  misc_feature (42)..(42): n is a, c, g, or t
ccggtacccgcggtatgtcttacggaatagaatgtggtaggncagaggatagaacaatggcaaaaaaaccatctcctctgtttttttctagggtgaccagaaacatgtgttttcttggactcatccaaatttattcctgttatgctgatgctaattatgaactcaactacttccactattataagaattccttttaggatgatcgtaagacataaccgcgg

SEQ ID NO: 717170 - DNA, 342 bp, Homo sapiens
  misc_feature (4)..(4): n is a, c, g, or t
  misc_feature (66)..(66): n is a, c, g, or t
  misc_feature (68)..(68): n is a, c, g, or t
  misc_feature (75)..(75): n is a, c, g, or t
  misc_feature (91)..(91): n is a, c, g, or t
  misc_feature (98)..(98): n is a, c, g, or t
  misc_feature (119)..(119): n is a, c, g, or t
  misc_feature (140)..(140): n is a, c, g, or t
  misc_feature (142)..(142): n is a, c, g, or t
  misc_feature (159)..(159): n is a, c, g, or t
  misc_feature (166)..(166): n is a, c, g, or t
  misc_feature (170)..(170): n is a, c, g, or t
  misc_feature (172)..(172): n is a, c, g, or t
  misc_feature (184)..(184): n is a, c, g, or t
  misc_feature (187)..(187): n is a, c, g, or t
  misc_feature (189)..(189): n is a, c, g, or t
  misc_feature (197)..(197): n is a, c, g, or t
  misc_feature (208)..(208): n is a, c, g, or t
  misc_feature (237)..(238): n is a, c, g, or t
  misc_feature (243)..(243): n is a, c, g, or t
  misc_feature (249)..(249): n is a, c, g, or t
  misc_feature (270)..(270): n is a, c, g, or t
  misc_feature (281)..(281): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (314)..(314): n is a, c, g, or t
  misc_feature (321)..(322): n is a, c, g, or t
  misc_feature (328)..(328): n is a, c, g, or t
atantattacaagaactcatgtaataaatggctaccaatttgtctctcccctgcttccccccaccntnggggacnaccccctgggcaaccncccttangcggcttctctagggcgttcnccctccagctttggtccagcncntgaggctgagtgtcatngtccctngacncnctttcaaagcgngcncngctgcggngaggagagccnctgggatctggaggttactaggttagggnnatggnttcgtnttttttttttttttttggganaagagccggcncctggngcnagngccnacccccaagcaaagggngtcttcnntgttcncggttccttctttt

SEQ ID NO: 717171 - DNA, 287 bp, Homo sapiens
atatttaccagcaatgaaatactgaaacatggtacaacattgatgaaccttgaaaaaaataggctaagtgaaagaaaccagacaacacaaaatatcacatagtactgggcacccataatattagaaaatgtccagaaatagtgcaatttgtagaccaacagtagatcagtggtttcctgcagctgaagcaagctaacatgactaacacccataattacatccaacctcctccccctaggaggcctgcacacgataaccggctttttgccccaatgggacaatatcga

SEQ ID NO: 717172 - DNA, 248 bp, Homo sapiens
tgtagtatcgccggaccagcgcacgtgttaggacccggaaagatggtgaactatgcctgggcgcgctatgccgaagggaaactctggtggaggtccgtagcggtccgtgacgtgcaaatcggtcgtccgacctggtctataggggcgaaagacttgtcgatccatctagtagctggttccctccgaagtttccctcatgatagctggtgctctcgcataccctacgcacccccgcccacgcattttta

SEQ ID NO: 717173 - DNA, 101 bp, Homo sapiens
  misc_feature (47)..(47): n is a, c, g, or t
  misc_feature (49)..(49): n is a, c, g, or t
  misc_feature (58)..(58): n is a, c, g, or t
ttgaagagtggcagaggctactataaaaagcaaccttttcattttcncnaagagtttnaaagctattgtattattaaaaagtctttacaatgcttgtttca

SEQ ID NO: 717174 - DNA, 555 bp, Homo sapiens
  misc_feature (4)..(4): n is a, c, g, or t
ggcngacgcaaagcagaaaaaggcagagaaagaagaggccagaaatgactcagggagcagagtagtgggaaaaacagaagtgagaagggaaaagagggaaggatgggcccccagatggattaaaaacttccaacgaagggcactttaaaggatcctttatcagaaaaggcaaaattggccagatcctcagcttctccctgcacccacttcctcacgtggctgcccctagatcccttctgtagccagctctgggacccatccctcccttacctgcagcctggcaggaaggtacacacagctcaggccctgacatatatctggactcaagtctgcctcggaaaggacaggaaagttccggtaaaggaggaggatcagcatgttggggccgtccaaggccattcggggccagccaaggggcaggctacattctgaagctctttgtaagaaaatcctcactaactgatcccactaattcagaatccctgtcagtttggatgttggcaatgctaaagttgcctttatactaaccatgaaataaagagtataaaagcaaaa

SEQ ID NO: 717175 - DNA, 415 bp, Homo sapiens
  misc_feature (17)..(17): n is a, c, g, or t
  misc_feature (347)..(348): n is a, c, g, or t
  misc_feature (395)..(395): n is a, c, g, or t
gggaagcatacatagtnaattccttgcatacagctttgcctgatgtgtgttttaactctcctgctaggttgaaagctccctgaggcctcagatgcctctgtatgcctgcaagcctggcacaatgcttggcataaggactaggggcagacaagtctgtgctggcatggtcccaacagctgtaaccagggctcccgcagtgcatttgctgagcaggcataaaatgggaaaggcatggccttggagtggtgtttcctctgatcactggcatcagaaacaccttagggaggatttttgtttgctcattttatataatgcagcttcttagactccacccccagagatttttnnttcaacagtttttgttcaacaagttgaggttaggccaaggggttccnccatttcttaaaccaagtta

SEQ ID NO: 717176 - DNA, 119 bp, Homo sapiens
tactgtctccccaggtgctgcttgcactcagctgtcacactgaacagtttcaatgcagctcttaatgctcctgcgttccgaagcctgcccaatgtcttttttctgggctctgttttttt

SEQ ID NO: 717177 - DNA, 456 bp, Homo sapiens
tcccagccccggtcaccggaccctgcagccgcaaagatgtggatgcctaaaaaaaaccggatggccattataggaaacctcctttttaaaggagggagtctcagtgggtggccaagaaaggagtgtctccacatgtgccttaagcacccgggagcgtggcagaacaaaaagtggtgcccaaccttctcagtgttctgtaaaggccagtgcgagctctctctctcagagtctcccgagagggctcagcgtgtgaagaggaaacgagtgtgtgtgcctgtggagagacacattttcttagcgtggtgtcaccttatcaccaatgtgagagggtttctcccgagattactctctcgcggtgagattatcaccttctacatctgctgtggcacccgcggagagaaagtgtgtgtgtcgccgtggcccacccctatagcgcgcgcgtgatagccccgcgtg

SEQ ID NO: 717178 - DNA, 564 bp, Homo sapiens
  misc_feature (13)..(13): n is a, c, g, or t
  misc_feature (38)..(38): n is a, c, g, or t
  misc_feature (49)..(49): n is a, c, g, or t
  misc_feature (240)..(240): n is a, c, g, or t
  misc_feature (418)..(418): n is a, c, g, or t
  misc_feature (444)..(444): n is a, c, g, or t
  misc_feature (517)..(517): n is a, c, g, or t
cccccccccgcgnggggttgttattgtctattcatttnctcttttctgntaatatagcagttatacttttttgggggcatagggtctgactctgtccctcaggctggagtacagtggcacaaccatggctcactgtagcctcaacctcccaggctcaagagattctcctgccttagcctcttaagtagctgggactacaagcctgcaacaccatgcctggctaattttcaaaattttttngtagagacagggtctcactatgttgtcccagttgctctcaaactcctggattcaagtgatcctcctgtcttggcttcccaaagtgctgggattacaggcgtgagcactttgggaggcagacggactacttgagctcaggagatcgagaccagcctgggcaacatggcggaaaggccgnctttactaaaaatacaaaaaattagncgggcatggtagcacacgcctgtaattccaactactggggaggctgaggcacgagaatcgcttggaacccggnaagcgaggttgcagtgggcaagattgcaccactggacccagtctggg

SEQ ID NO: 717179 - DNA, 170 bp, Homo sapiens
atctcttgctatactaacatcaactcaagatggggttaaagacttacacatgaggcatgacacctataacatcactattaatgcaggagacaattggggacacactttaggcacattggtctaggacagcattttatggatagcactcacacacacagacacacacacac

SEQ ID NO: 717180 - DNA, 848 bp, Homo sapiens
agagtattatttcttcagtgttattgttttcagagccacatttgttgcatatttgctagtactaatcagtcaaagggcaccattcttttttttttttggaaaccaaagcgtgtctcagaaaagggccaatttaactttacagtaacaatagacagcacaacacaaactctctcaatacagataaactcacacatacgggagaatatatatataatagatttttataaaattatttcaaaggcatggtaggtgtaatatttatgcatactatacggtataacagtgttattcaaagagggatggccatttctggagacacagtaacaaaaaaagtgaggaaattatctggcttcctaatttaataggccctttgggtccaaaggtctcaaagggacttttaagtggcttggcaaaagtgggttccacgtttggctataaagtgctctcactcacagtcactttcaaaatagtgactctaaacaaagaagaaagcagcacggtcatcagatgcttgataaaccaaattttgaaattggggaactggtttaattaacctagtaatggggggggtaaagtacattgggtgaattccatatggggataccagggacaggtaaggtatggtccagattacctggcttatagccttaaaaagccttttacaaatcttacacacaaattcagatgtgcctacaggttttaacgaagtggaatcatccaaggggaattcctctttctgggaggtttgggactttcgcagctagtaagggatatggagcctggtacagcagtcctaaaattgctgactttaggggccaggccacgcgtactcatagactggatgtgac

SEQ ID NO: 717181 - DNA, 340 bp, Homo sapiens
tttttttttgagatggagtctcgctctgtcacccaggctggagtacagtggtgtgatctcagctccctgcaaactctgcctcccgggttcaagtgattcttctgcctcagcctcccgagtagctgagccctgctgcctgttgctttttgagtcactttctcaagcatcacctcatctgcttccctgaacagtccagtggggttggcaaggcagatcaggttttatccattttagagatgaagactctggggtctagacagggggagcaacttccccaagcttccttcaccagggccatgctggttacctggccccacaattgggagtgggaagacagaga

SEQ ID NO: 717182 - DNA, 334 bp, Homo sapiens
cagactcctgagtagctgggattgcaggcacatgccaccaagcctggctaatttatagtatggcagtagagacagggttgcaccaatgtaggacatgcatggtcttgaactcctggtctcaagtgatccgcccacctcagcttcgcgccaagtgctgagattacagtcctgagctactgctcccagccttacagaatcgtttcattctggggcattcagaagtctgacataaaaattaacttgagactaccatgtacattctttttatcttccagtttctttccttccttgctttaaaaataccttggacttattttctgccctcgatacagcg

SEQ ID NO: 717183 - DNA, 794 bp, Homo sapiens
ggtacgcgtggtacaaataaaaaattataacaaaccctgagaatcacaatgaacgacaatctgttcgcttcagttcattgacgccccacgaatgcctaggcctacccgccgcagtactgatcattctatttccccctctagttgatcccctacctcacaaatatctcatctaacaaaccgtatctaattcaccacccaactaatgactaatcacatactaagcctcaaaatcaacatgtataagccatacacaacagctatacatgtgacgaacctgcatctctatatactagtatccttaatcatttttatatgccacaactaaccttccatcggactcctgcctcactcatttacaccaaccacccaaatatctataaacctagtccagtggccatgcccccttatgagcgggcgcagtgagttataggactttcgcttctaaggattaaaagatgccgctagcccacattcttaccagcaaggcacacctaggacacccgttatccccatagtagttatatatcgaaaccatcagcctactcattcaaccaatagccctggccgtacgcctaaccgcgtaacattactgcaggccactactcatgcacctaagttggaagcgccacacctagcaatatcaaccattaaccttccctctacacttatccatcttcacaattctaattctactgactatcctaaaaatcgctgtcgccttatccaagcctacgttttcacacttctagtaagcctctactgacgacaacacataaaaacaaaaacaatccacg

SEQ ID NO: 717184 - DNA, 252 bp, Homo sapiens
tggtccgtctattggtgtactaaaagtgtcttaaaaaatagtctttttaaagagacaggtcttgctcctgttgcccaggctagagttcaatagcacaatcacagctcactgtggcctcaacctcccaggttcaagggatcctcctgcctctacctccagagtagctaggactataggcacacgccaccatgcctggctaatttaaaattttttgtacaaacagggtctcaccacgttgcccaggctggtctc

SEQ ID NO: 717185 - DNA, 300 bp, Homo sapiens
gcgtgtatataacccaatggtgttgcaatacaaaatgagtttctttttctttaagccaaatttgaatttgctccaatagcttaaacagacacccatagcggcgagtccctgtgggatactccttgattgtccccatgaccgatattaacggatctctgctacagtagggttttattgagcccaacgtttagcaaagagcctagattactctgaccctacttaaacttcccgtgattctttaaagggtgtaatatatagatacgaccattgtgacttagggtaccgacgctcgacattcgt

SEQ ID NO: 717186 - DNA, 108 bp, Homo sapiens
caaattttttttcattgtttaaaaaaacggaagtgttccaaaataattttttcctggactggaagggtaggattttaaagaattgattataaaatattttccatccca

SEQ ID NO: 717187 - DNA, 1060 bp, Homo sapiens
ccatcgcgtcgcggacggcgtgggatagcgaggtcgggcttgggaagggtcatgcgggaggcctgagtgcgccgtggcgctgttggcaggcggtgcccggggtccagccgagagggtccgggcgccaggcaacgcgattctgcgcgggggtgaaccctgtgggaggcgggcctgtgctcccctgttctggggacctttccggtgctgtccctgagcgctgaacacctgcccgcgctcggggggctttggggagcctcgtggggccgcgaggctgtgttgggaaagcaaagtcctccttgtggcgtggggtggccggacgggacgacagggacagcgacgggtcgcggcgggaccagacgccccagtccccggcctggccgcgacctactgaagggcgctgcccggccttgaaccttggaacacggggcacattgtgttaccagagcttcccacctgggacctgtggccggcgcccaacaaggaccattgcctcctgggagctgcctgacttcccaagctggttgagcgggccgtctccctttgcggcaggggcgtgccggccctgcccttggcgccccggtcctcttgggagttgcctgggacagacccggagtacttgcgtggtgcccccttttacacagacacaatcggcccgggcccgggacccaaggggtgacgggtgcacggccctcttcttcccccttaccggccaaggagcggggtgaccccatagaccttggggacggccttggcacacgtgacgcaacttggcttgggggccccccccgacggaggacacggacattgcttccgtcatatagaagacacccacccccgttggggtccagtaaggcgcctttggaggccttacaaacgggtgtgtacccggcattgactgtaggcctttggcccccagatcacgcctggcgcaatattacccggggacaaaccccggccacgggggtgaaacatggtgtgaggccatcgcaactccggctatacaatctccattaacaccgaaacgtggtatcccggctacccataacccgcagaaattaag

SEQ ID NO: 717188 - DNA, 728 bp, Homo sapiens
tggcacgagggcgtggtggcacatgcctgtagtcccagctgcttgggagactgagacaggagaattgcttgaacctggaaggcggaggttgcagtgagctgagattgcaacattgtactccagcctgggcaacaagagggaaactccatctcaaaaaaaaaaaaaaagttgtaactgaggctgggcatggtggctcatacctgtaatcccagcactttgaaaagccgaggcaggtagatcacttgagctcagaagttcgagactagcctgggcaacatgacaaaaccccatctctacaaaaaatacgaaaaattagctgggcgtggtggcatgcacctgtagtcctagctacctgggaggctgaggtgggaagattacttgaagctgcagtgagccatggttgtgccactgccctccagtctgggcaacaaagtgagaccctgtctcaaaaaaacaaaaaaaaattataactgatgtaaactggcagtttaggctgggtgtggtggctcaagcctgtaatcctagcactttgggaggccaaggcaggtggatcacctgagttcaggagttcgagaccagcgtggccaacatggtgaaaccttgtctctattaaaaataccaaaattagcaagatgtggtggtgggtgcctataattccagctactcaggaggctgaggcaggaggatcgctggagccagggaggcaaaggttacagtaagcaaagatc

SEQ ID NO: 717189 - DNA, 516 bp, Homo sapiens
  misc_feature (445)..(445): n is a, c, g, or t
aaatgtcgaggctggtgaggtggtatcttatgcctgtaatcccagcactttgggaggcagaggtaggtggatcacttgaggtcagcagttcgagaccagcctggccaacatagtgaaacctcatctctactaaaaatacaaaaattagccaggtgtggtggcacacacctgtaatcacagctactcaggaggctgaggcaggagaatcgcttgaacccaggaggcagaggtggcagtgagctgagatcgtgccactgcactccagcctgggtgacagagcaagacttcgtctcaccaaaaaaaaaaaaaaaaagggggggggcaaacaatttttcctttgtcttttacccctggaacatataggggcaatctgcctattgagaggtaactcatgtaggtcatgcctaagactatttggttaaggtgatagcgagtgtggcctatnacaacagccatttccctaattctcctccccaggtcctaatttcattcagtaatctaccctcctcaatatat

SEQ ID NO: 717190 - DNA, 299 bp, Homo sapiens
tcctacgtatctagtgacttggacacatgggagtagggggagggcaaccccctcgtgcagttgaaaatctgtgtataacttttgacttccctgaaacttacctactaatagcctacgttcaccagaagttttattaataatgtaaatagtcagttaacacatatttcttctatgtattatatactgtattcttacaatagagtgagctagaaaaaagaaaatgttattaagaaaatgataagggtgggacacagtgactcatgcctttaatcccaacaccttaggatacagtagggaga

SEQ ID NO: 717191 - DNA, 311 bp, Homo sapiens
gaatgtagaaacccccccagaacaaagttaaaaccccccgagaccaatgttttaagcgcccgagagcacccttttaacagcgggagctaatttactagaacaaggccaaacctgaactgttatttgaggcgaatccacaggggtttaagcttcaaatccagccaggaatttggttccaatctctttcagctttgcatttgatggttctgagatctttccatcagcctggatagtgcccaacaggtctgggtgctggctgacgacatgagacaggaaagcattctcaaactttgtaatcttgctgcgctcaa

SEQ ID NO: 717192 - DNA, 805 bp, Homo sapiens
aaccccgacatcattaccgggttttcctcttaaaaaaaaaaaaaaaaaaaaaaaaaaaaaaaaaaaaaaaaaaaaaaaaaaaaaaaaaaaaaaaaaaaaaaaaaaaaaaaagggggggggcgaaaattccccgcgggggggcccaaacacccccccacttttgttttgtaaaagagggggcctcctactataataggctgtacttattatttatcaaggtccagtgtcccatgtcggcccgtatcataataaaaccaccgcgcgtagtccagagaacaacacgtcccgatctgtgagccgtctcctctgctggcagagagaacacccccaatattctggtgggggaggacgcaaacacaagttgtgggcacaaaatcatcctcgcacttgagtaatatataagcaagactccagtgaaggcagaaatatatatcactctttccaagcgagtcttatatgcgggtggtcaacacacgccggcgcacatctaattttccggctgccgatagtaccaatagtcttgtcggcccctcgtaggagttctattatttatttagacagaaatttttattcacacgcggggggttttttgtaatatataatcctccgccaagccagataagcctagctactgccagtccacagcagcagccgatccgactacctcgcacccttaactgaactacgtaacgacgagtcgctacacttcacgtcatcgaacgactcgctgagacgacctaaccgcagcgacgtccgactccacagcgttgcggctgcgcagccgctcgctactctactgcctcct

SEQ ID NO: 717193 - DNA, 528 bp, Homo sapiens
agcgccggcggagaatggatccagcgccatccacttgatgggcaccttggcccccatctgcatgatactctgatctcgatcaagtgtccagtcagccgatggcagcccgaagtctgtaattttgacatggttgggactcttgaccaggacgttccgagcggccaagtccctgtgtacgagccgcacatcctccaggtagctcatccccttggcaatctgcatacaccagttcagcaggtcctgggagcccaggcgtccgcggttttcccggacatggtctaagaggcagccatagggcataagctgtgtcaccagctgcaccgtggatgtcaggcagatgcccagaaggcgggagacatatggggagcccacaccagccatcacgtatgcttcgtctaggatttctttgttggctttgggggatgtgttttccctcaacactttgatggccactggaattttcacattctccccatcagggatccagatgccattgtagactgtgccaaaagcgccagatccaagcac

SEQ ID NO: 717194 - DNA, 308 bp, Homo sapiens
  misc_feature (202)..(202): n is a, c, g, or t
acacgagcactggggctggacacaaggtcggtggcccatataaagagtgctgaagttcctgctgcagcatgctttaaaacgcagagagtaatgctgaactttatggtttatgatttagattctctggctcattgaggcctagtccgagtcaacaaagcacctaagtatgcgccgccggtacctacatgagctcatggtcggnattcacccatacatgagctctccctgccacattgagtatatcctctatggacaacgaacagacttgttcctaaaccagaacacgaggttgcccactgctccagagt

SEQ ID NO: 717195 - DNA, 201 bp, Homo sapiens
gaaaacagcaggaccacaattttagtttctttcttgaattgtttgtgataagccacccttttctatcaatttaagatgatgatcatgcccaccagctcctcctaaccatttagtatctacagaggggactgaggatattagaggccattcgacgtaaacaccagggcctagaggacacccatgagtctgttttccaagagt

SEQ ID NO: 717196 - DNA, 527 bp, Homo sapiens
acttgttttctattttttttcttaataaaatggaatccactgtgttgaagactcttgatatcatgtgctcgtctacccattttttgttttataaattagaataaaatatagttgtgataatggtcatcgaatggatttgtttggaaagctacatcttatttgtgaaatgttttttaaatcagagtaactatcaactgattcagctttttgttgttttgttcttggctataacacttgtgactcatgaagaattattgttgacaaacagagataaattcccacatgcatctttattctcccacgtgatgttgatataaactctctatttcttgtgtgaagcgtgtgtactgtctaaactcacatgttcacacttctttaatatcatcttctttgcagaagagaatgttccagattctgaacatgtgtactcattctcccttcacaaagtgaaggggacaggtgcctctagcttaaaataaaaggcattgcaggattatctatatatatagaaaataaataaaacaata

SEQ ID NO: 717197 - DNA, 872 bp, Homo sapiens
ggttcatgttacaaactccaattgacagctaagtctatgtatagtgaagtgggggattaacactctgtgtaccatacataagttatcataggtaagaaccatgcttctgtcacttttatttacatgtaagactagatataagttaaggtagtacgcctgttaatacctagtctgccatctctattataggtttacgatggtggttagagagtaggttgactatagtagtaaggtttgatgctgagctcttagtgtgtatctgctttgcaagtggattgaaatacttttcgcgtgtcgtcatgatggtaatgactcctcttttcagttccatgatagcatggactcccttgaggcgtttcttgtaagacaaaaagctcaggtattggtcaggatggtcagtacttacccaagtaaatctatagattcagtgaaatcacaattgagacatatcagaaaggttcccgaggtctcgagaaatctacaattctaacattttatgtagagaaagatattgatgcactatccacaatttttaaaaggccttttagtaaattgaggtggtttcccataggagtttacactaggagatcattactttattgttcaatggagggggaagaagactatgagatagtattattaagccaaaataattgttcatattattaattatgtcttaagcattgacttgtaagttaggtggtggcctgttggatattatgcccagaagggttaagttcggataacttagtacgggggggagacaaggttgcttttgttttgatagagattttttgggttttaaggtcttaaagcaatcagggttggacaacggacaagtgaaagagttgtggtcttcgtgacaagaatgc

SEQ ID NO: 717198 - DNA, 194 bp, Homo sapiens
aagccacacgccaccagggcccacggggtgtccatgtgtgcccaatgtgttcgcgacaggaccaagcgtgctttccttatcgagccccccaaaatcgttgtgaaagtgttaaaaacacaagcacagagtcagaaagctaaataaaaaaatgaaacttttttgagtaataaaaatgaaaagacgctgtaaaaaaa

SEQ ID NO: 717199 - DNA, 580 bp, Homo sapiens
ccccttggaaaaagggttttttcccccccccttttttccccgcccttagggcccaattcccggggccccacccaaggggccccctcccggaaaaaaaaaaaaaagctcccccaccccccgggccgggggaaaaaaggggcaaagggggttcccgggggaaaatgggggcccccccccatgggtgggggccctttttttttttggcccccggttttcccccaaaaccccccgggattttcccaccgggaaaccccgttaaacccctccccggggggaccggccaaaaaaaccccccccgattttttgggtttagcccccccccctggcaaataaaacccaagcccccctggggtttctttaggggcccccaaaaagggggggggaaacaggggcaaaggggtgtcccggggggaaatggttccccgcccacattcccacccaaaaacgcgccgggggaaaaaaggggaaaccccgcgggcgcgcctaaggggggcgccactccccattttgtgggggcgcccaccccgcccgcctttacgggggggaaactctggggcccccgttgttttaaaaaccgccg

SEQ ID NO: 717200 - DNA, 549 bp, Homo sapiens
  misc_feature (9)..(9): n is a, c, g, or t
  misc_feature (134)..(134): n is a, c, g, or t
  misc_feature (458)..(458): n is a, c, g, or t
  misc_feature (476)..(476): n is a, c, g, or t
  misc_feature (491)..(491): n is a, c, g, or t
  misc_feature (516)..(516): n is a, c, g, or t
  misc_feature (522)..(522): n is a, c, g, or t
  misc_feature (542)..(542): n is a, c, g, or t
attcggcanagaaaataaccgcagatggggctcagggacctgctaggcccactgagacagacctgagctaaaactccattgatcacttgacttcataagcccctactctgactgctggaccacagcgaagtttnggtcccctagaattagtgttagttcagaagccagtgtctagtaatccccaaaaaatcattgtttccccttctgcaaggcaaatagccataggtccctttggggaagggtaggagaaagataaacaggaaagtctcctcaagaggacacagcttcccttttcattaaggagattctgggtctgtaaactagcttcatttctggggaattgcttaaggggccatgactctcttcaggtgatttcaaattatacttctgttttaccagacctggattcttctggttatacagatcaagtaagagttagtaggatggcccatctattntctttttaggggacaccnggttcaaccacccantgctatagggtctcaggcagtcagnctatcnggttactggtttgggttcantattttt

SEQ ID NO: 717201 - DNA, 885 bp, Homo sapiens
  misc_feature (536)..(536): n is a, c, g, or t
  misc_feature (654)..(654): n is a, c, g, or t
  misc_feature (697)..(697): n is a, c, g, or t
ctggcccatcaggctttattttcataatgctagctcttaacacaaaaataaatgctatactatgtacttaagacagtgtggtagcttgcgtcaaaacagcccatcgcaactaactactacgcttccagatctaccttgagggtcggcctgtggccttataaatgggagaatcttgcttaacagcataccacacaacatattaacgtaataatgtttacccataaaagcaggaactttctatataatactttgggacttagacaacaaatatcctttgttacatctgtctgagttcaagtgtctcatcttgatgagtttacattccaagttaaagatatggtcttcttttgaaatgatcattaagtataacgtcttttttataaacagagtgttcatacactaagtcaacttaaaaccaaattcagaggttggggacttaaattagaatatggatctttgcaaaggcggccacaagtgggaaaactggtaataagagcacttctgtattccttgggactagagttcattgtacattntaacagcagctggtgtagaagaatactcctgaggcactgaagaagtaatctggatgaatgaataaaatgtggggataatgcagaaagtgaagactggtcctttcttttctaaactatntgcattaaagcttggttgcaatgaatcctatcttgtacagaanagattcctttgcacatgttccaagtcttgttaaagaatcacagaaagagaccctctttggacattttccttgccacaggtacttgtgctcaatgggcaaagtacctcttacctatggtaaaagatggattttcatctggctgcggtactgatcgcctccattgcatttacttttgttttctggccaag

SEQ ID NO: 717202 - DNA, 381 bp, Homo sapiens
atggcaaaaaactcagaccttttcccactttccaaatgttgcattggtcagcatcaggagtgggatgggaaggaaagccccatacccaaaaaattgaaaaatgggaaattagtggtggagtgtgtcatgacccatgtcccccgtcctcggatctatgaaaaagtaaaataaaaattccctcctccctttggcccggagtttattaaaagaatggcccagctccgttcaatgagcaaatcccccaactgtttctttcttttttttttccatactgtgttccattatctttatcataaaccttttacatgcagctatttcaaagtgtgttggattaattaggatcccccccttggttaataaataaatgtgtttgtgctaata

SEQ ID NO: 717203 - DNA, 897 bp, Homo sapiens
attttggggaccaaaaagtttttctgtgcaaaccccgtcgcgaggtgacccttatcattgcacggttgagcacgtgggtgtaaaacccaaaagcgttaggttctcctggattttctggcgatgtccccctctgccctcacagcgatttttcccggggtcgcacgagtctctcgttttaagcttctaaagtccttctgggggtgaccacagagttcggccacaagccaccacgcacttgggtgggtgccaccaatacataagctatagaaagttctctccaggcgccaccacgccgtgatattattggtgcatcagagagacagtttgtggagtaatagaagaagcaggggcccccataacgcacttggtggagtggagaaaacgcacggagggacaataaggtgcgcttcccccgcaacaaaggccctggcaggccccacaattaatcggtggacaatagacgtaccaacgcgaaaggcgagcctggtgcagtggcgtgccacacccccaccaccccgaggtgaggggtaaaggccaaaccgacggcgcccactccgcacgctccgctcgcacgcacacactcgccgcacctccggtgggtggagggtcgccctccacaagaggggcgtgcacatataggtgctgttagactatgtagaccgggagccacgaaatatctttatccgaagaaagcgatgatacatgagtaagcctccttgactactaaagaattaaaatacctccgccacacacagtgtttttataagtggcggcgcgcgctccccgcccctatttctagctggtggggagagacgatgctgcccgcccagcacaccctcaggctcgccccccctgacaattgaaaacatcaatttccggggcgacccacatagacaa

SEQ ID NO: 717204 - DNA, 158 bp, Homo sapiens
  misc_feature (121)..(121): n is a, c, g, or t
gcagggcaaggcgtgtcgtgtgcggtgcagtcgccttcaaagggcccggggacaggtggtggcccgagccagagtggcgtagtgtgcgtagagggcaaagaggttggagcttcgtatcgtnaggaaaatcaaggcccgcaaaggcaaataaatccgtt

SEQ ID NO: 717205 - DNA, 1668 bp, Homo sapiens
gcaggcagggggttcgtgacgccggctgggtctgggggctgtgggccagccgagccgacccgggcttctgggggaccgcgggggccgtgagcactcagagggtgcatcccaggcccctccgggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtttctgccaacaccatgtttgagatggagtggcgtggccggcgggtagcactcaaagccagcaacgggcgctacgtgtgcatgaagaagaatgggcagctggcggctatcagcgattttgtcggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgc

SEQ ID NO: 717206 - DNA, 1046 bp, Homo sapiens
ttgaacacctaccgtttatcaatgaatattttcagacggttaaaaaaaaaaaaaaaaaagaaaaaaaaagaaaaaaaaaaaaaaaaaaaaaaaaaaaaaaaaaaaaaaaaaaaaaaaaaaaaagaaaaaaaaaaagggggggggggcgacgcactaataagaagaaccggagggacgcgacacaagacaagcaggcgaacactgtagaacgatgggcccacaacgaacaggactacgccgagagcagcaccagacaccaacagcgccgagacaacacacaacaacaacaaccaaaagcaaaacaacacaccacagacgagaagaaagagaagggcagaaaaaacacaacaggaaaaagaagcaacacacgaacaaaagcaagagacgagagaaaaacaccaatcccagacacgaaacaactaagaacaaaagagaacaacaacacagcacatgacaaaaacgagaaacggagaacaacataagacaaaaagagagaacaaaacaacaagagcaaagcaagaaacacgacagaagaagcagaaaccaaccacaaacaaagaagaaagaagaaaagacaaactcagagggagcaaatcaaagaaagaaccgaactacagaggaaaagagaaacagaaacaacacagaagccgaaccaacagcagccagcaaggaacacataacacacacacaagcaagcagtacagaagatagagacagcaacagaagaaacggagaggacgaagaggacgagcgacaaaaaacaagcgaacacaaatcaaaagaaaaaagacacagacaaaacaagagaagagagaaagccgcaagacacgcagcacacacaaacgaggacacaccagaaacaggaaaagaaacaacaccaacacaaaaggaagaggcaacagaagacaacgaaacaagagaaaggcagaagacgtaatggagtcacgagcgaacaaacagaaaaggaatagagagacaataatgaacagaaaggaaaagagacacgagcacgaccacagacacacgcacaaacaacccaaccaaca

SEQ ID NO: 717207 - DNA, 456 bp, Homo sapiens
ctagtttagaagttcatagcaatttattgctagtctcgggggtcttgctaagtctgtgcctgctattgacacggcgtattctccctgcttctctgggtgtccgggttttgcaagttctgtttcagattatgggcagcttcattaataaatcctttccataacccggtaatctaggttccccccttatgtacaattataaagcaattcattcacaactgtgatttaataattattggtgcaattctttcttaatgcccatgttctattctatactttaagtgtgacgatatcctggcccagcacataggaggtacgcaacaaaatatgatgaatgactgaaagttgtcttcaacctccatggagcacagacttaaagtataaggcagtgtgatgtagttgatagcaggtggatctcgggctgctattgaaacttctaaaactaggggggatcctcta

SEQ ID NO: 717208 - DNA, 1740 bp, Homo sapiens
gcaggcagggggttcgtgacgccggctgggtctgggggctgtgggccagccgagccgacccgggcttctgggggaccgcgggggccgtgagcactcagagggtgcatcccaggcccctccgggacccggccagcctgaagatgccgacgaacggcctgcaccaggtgctgaagatccagtttggcctcgtcaacgacactgaccgctacctgacagctgagagcttcggcttcaaggtcaatgcctcggcacccagcctcaagaggaagcagacctgggtgctggaacccgacccaggacaaggcacggctgtgctgctccgcagcagccacctgggccgctacctgtcggcagaagaggacgggcgcgtggcctgtgaggcagagcagccgggccgtgactgccgcttcctggtcctgccgcagccagatgggcgctgggtgctgcggtccgagccgcacggccgcttcttcggaggcaccgaggaccagctgtcctgcttcgccacagccgtttccccggccgagctgtggaccgtgcacctggccatccacccgcaggcccacctgctgagcgtgagccggcggcgctacgtgcacctgtgcccgcgggaggacgagatggccgcagacggagacaagccctggggcgtggacgccctcctcaccctcatcttccggagccgacggtactgcctcaagtcctgtgacagccgctacctgcgcagcgacggccgtctggtctgggagcctgagccccgtgcctgctacacgctggagttcaaggcgggcaagctggccttcaaggactgcgacggccactacctggcacccgtggggcccgcaggcaccctcaaggccggccgaaacacgcgacctggcaaggatgagctctttgatctggaggagagtcacccacaggtggtgctggtggctgccaaccaccgctacgtctctgtgcggcaaggggtcaacgtctcagccaatcaggatgatgaactagaccacgagaccttcctgatgcaaattgaccaggagacaaagaagtgcaccttctattccagcactgggggctactggaccctggtcacccatgggggcattcacgccacagccacacaagtttctgccaacaccatgtttgagatggagtggcgtggccggcgggtagcactcaaagccagcaacgggcgctacgtgtgcatgaagaagaatgggcagctggcggctatcagcgattttgtcgggcccccaccccgcccggcctggacagggaaggtggcgggaggggcagcgcagcagacgctctccccgccaggcaaggacgaagagttcaccctcaagctcatcaaccggcccatcctggtgctgcgcggcctggacggcttcgtctgccaccaccgcggctccaaccagctggacaccaaccgctccgtctacgacgtcttccacctgagcttcagcgacggcgcctaccggatccgaggccgcgacggagggttctggtacacgggcagccacggcagcgtgtgcagcgacggcgaacgcgccgaggacttcgtcttcgagttccgtgagcgcggccgcctggccatccgcgcccggagcggcaagtacctgcgcggcggcgcctcgggcctgctgcgggccgatgccgacgccccggccgggaccgcgctttgggagtactgaggccgcgcccagaccagcctgtcgcgcattaaaaccgtgtctctcccgc

SEQ ID NO: 717209 - DNA, 404 bp, Homo sapiens
cagaaatctaattgacgagagcacttgaagaagtgaagaaattattggtacctgctgccgaaggagaatacagcctgaagatgatgcagctgatggagcttgcgattctgaatgtggcctacagagatgccaacattaaatcaccagcccttgccttgtctcttgcagtaacagcccacgctgtttcaaggatcattactgggcctgcgccgggtcttccaccagctgtcctgcgtactcctacgccagctggccctaccataatgcctttgagcagacaaatacagaccgctgtcatgcccggaactcctcacccaactgctgcaatagttgctccatggcccgaagctggtttaatctatacacacctatgagtacccgtacacattggcaccagctacttt

SEQ ID NO: 717210 - DNA, 324 bp, Homo sapiens
gacaggaaatgagctacttgcttgcattacagggactcgatgtctcctgaaaaatatacaacaaataaattgtttaaccttggagatatcgatttgtctgcaaagagccaggcttgcagtaatgaagaaatggtgataaaaagaaaattctaaacaaaacaaaacctttccaggcaggtctgtgagcatgggcaggctgactcttagacaccaataggccttggctttctagttccatcatttgtgatgagtgacggctttgtgtatgtatcaattccaaggatttatttctaacagaggtatttccagcataaaaatgtgccg

SEQ ID NO: 717211 - DNA, 224 bp, Homo sapiens
catggacaacacatggtggggaattcggcttccagacagcatcccgggtcgctgtaccacggtgtgtggatgctgaagacatggagtcatagatggcagggtcctgcacctggagagtcaaccagtgccccatcggtgcttgggtccggagcccaccgcgcatgcagcaccaagggccattctgaggatctgctcccccgggaccccggcccggagcgcggccg

SEQ ID NO: 717212 - DNA, 353 bp, Homo sapiens
attttcatttgcttcaaccaaaatagcacattgtggctgggcggggcggctcacgcctgtaatcccagcactttgggagaccgaggtgggcagatcacttgaggtcaggagttcgaaaccagcctggccaacatggtgaaaccttgtctctcctaaatgtacagaagttggccgggcgtggtggcatgcacctgtaatcccagctacttggaaggctacttgggaggctgaggcaggataattgcttgaacccaggaggcagatgtcgtggcgagccaagaccgtgccactgtattccagcctgggcgacagagcaagactacgtctccaaaataaacaaacacataaagcta

SEQ ID NO: 717213 - DNA, 128 bp, Homo sapiens
gggcgtcacaaatataagtgcaagaggaactgctggccacgtagtacgcgggtgtggccatgaatcctagtggatgcatccgttttggcaggttgcaaacagcatgcacactcggcaagcccttccac

SEQ ID NO: 717214 - DNA, 230 bp, Homo sapiens
ggaccgtcacagctgcaggtggctgtacatactatagattgtcatcgcagtaggtcgggctgctagtcagggcgaattagtaggtccagggcgggccccctattcctgttccaggcacaatagtagtaccgggtgcgatgtctttgtgggtaggtgagtataggcaacgatttacgaacataggtaaaatggctgagtaagcattagactgtaaatctaaagacagaggt

SEQ ID NO: 717215 - DNA, 206 bp, Homo sapiens
  misc_feature (147)..(147): n is a, c, g, or t
ggcggttgctcagaggatccctcacgcttatactttctcaacgcatacttcctcaacgctttatacttcctcaacgctttatactttctcaacgctttatacttcctcaacgctttatactttctcaacgctttatacttccgtatngaattcaagtataatattaagtatgcatggaagtataaagcgttgaggggtaccgagct

SEQ ID NO: 717216 - DNA, 165 bp, Homo sapiens
aaaaaaagggggtttcccccttttgggcgggggtttttttaacccccccccccgggggttccccccccccccccccccccaaggtttgggtttttgggggggggcccccccccccgcccctttttttttccctttttaaaataaggggttcctttttttgggcca

SEQ ID NO: 717217 - DNA, 104 bp, Homo sapiens
gctgcggacgctccggcccccttacgttgtggcatgtgctgagtgatgctgctggggaagatgtgcgcgccgatggtacccctccgggggcacctgggaggcca

SEQ ID NO: 717218 - DNA, 239 bp, Homo sapiens
taaacacagctagatgctcttttgttgacttataagcatgtgttatgtgctaaatttttgtgttttcatactttgtttataattcatttttcattactaaatgaagtattgcattatttacaaactgtctaagaataattggtgttttttaagatcattaagaatgagtaaataaatgattaaaaaactatataaatgaacatttatacatttactattcaggcacccactgagggcta

SEQ ID NO: 717219 - DNA, 195 bp, Homo sapiens
taatgcgtgggtgactgtgcagtgagtgtctggggtgagtgcgatgctagtcactgtcccagtatcttctcattactttatttgtgagtggttggtcagtggcagcttgcagatcaggctagtttttgagccacatcctccctctgagtggtgctcatttgaattgagccacaggcccacgggcatagggtgggg

SEQ ID NO: 717220 - DNA, 352 bp, Homo sapiens
  misc_feature (280)..(280): n is a, c, g, or t
  misc_feature (348)..(348): n is a, c, g, or t
agggaggccaaggcaggaggattgtttgagctcaggagtttgcagaccagcctgagcaaaacatacaaacctagtctatacaaaaaatatgaaaattagaaaggcgtggtggtgcacacgtgtagtatcagccactcagggggctgaagtgggaggattgcttcagcctgggaaataaaggctgcagtgaactgtgatcatgctactgcactccagcctgggcaacaagagcgaaattccatctcaaaaaaaaaaaggtgggtaaagggccatgagccanaaccactaggttgttcaccttttcatctggaaaatgctttactctggactatgtgctattgggttttntttc

SEQ ID NO: 717221 - DNA, 281 bp, Homo sapiens
ggtacgctcagtctcatgtcatgcagacggctgtctgtaggtgggtggaccttagagaggttgggatgtgccacatcctggcagtactctgataccgtggaaggtagaagccaagaccctctagatgtagctgaaaaggtttaggtgtgggatggtcttctagtttcttctatttgcatgatgaagctaagcatgcatatttatctcccattctctgcatcaaattagggagaggatatgttacaaatatggtactcacattcaagctgcaccctctgata

SEQ ID NO: 717222 - DNA, 900 bp, Homo sapiens
tcgccgctgggagaagtagaattttctggctctgacactgagaaacattaggtggtctctccagtagaattggcttatccaagtgaccagattatgcaaaaagttctcatgatgtaaaagaggaacatatcaggaacattcaagggacacatgaacacagaagcagaaaagatggacatcatattccatgcccatcagcatgaatttcagcggagatatgcaacaatgttctggagcttgaacagctgaacaaggacctaaacaaagtttgcataaagtgcaacagtattgctatgagcttgctccagaccagggctccagcctgcagatcaggcaacagatatgagacgctggtgtgaggaagaagcacaggagatgtccggcatgcaaattcctcaacaggacagccctgcggtgaaaatgaagaatctgacagacttaatttccaggcttacaggtatttgttacaaatcaagtgtctagcagaaggaggagacctgaattccttgaattcagatcacttacggactcattaaatgactctccagagtacaatcagacgctccaaatatcagtcgtttcagaatactgtcagaaatccatgtggcacataattcagagtggcccgaggcagatgggaacgtaacttggcttggcgcaaatacaccgacagggacgagttaagattcattattacaacgccggacagggttgggaagcttaccttatatggctcaacgcaataactagcgggacagggacttgctccaaagggcttatggagcggcacacacggcctcactatacacaccgcagggcgctgcaagtacacgaaaaacaaacaggacacacaggcaacgccaaacggaaacacgagaaagcacagccttttctagcggc

SEQ ID NO: 717223 - DNA, 286 bp, Homo sapiens
gctgagctcccgttctcgctgatacggctggacgtttggattggtgtctcccggcgcgacatacgaatgagacattctaggccgagctattaagcagaatgaaggagcacctgggcttccagcatgcctgtggacctgaagggtggcacagctctcggaacaggaagagccatcttccaggacacctgtccctggtcagcctggacgcacgcactgctggagccacactgcagtcaggggtcgtcattaagtccctcagaacatacaccatatatacctcatcagc

SEQ ID NO: 717224 - DNA, 350 bp, Homo sapiens
aattgggttcctccaaatcccatgttgaaatttgatccccagtgttggtgggggatttaatagcaggtgtttgggtcatgggaacaggtccctcatgaatgaattaatgccctcactgggaggaggggataagtaagctttcactcatttagttcccaagacagctggttgtttaaaagagccaagggccaacttttttctggcttcctttcttgcggggtgattttggcacaagccagctcccctttgccttttaccatgagtggaagcagcctgaggctttcacctcatgcccagttttccagccaccagaattgtaagccaaataaacattttttttttataaatta

SEQ ID NO: 717225 - DNA, 380 bp, Homo sapiens
gcgtcgactagaccagcaacagctccagccccaggttctggttgatcgcctgatgcagctgcagcaggtcgccgctctccagtgactggtgaaagctctgcaccagcagttgcgggccgtagcggtcgatcgtcaggccgccagcgccttcctggctgccgtggaacaggcgatacacatcggtaccttgtgcatgcagctcagcgagcaggtcctggcgatgatcgagggcggcgccacgtgattcaaggaagacatagtgcgcgccttggagagtaattggggcgcgggagtttaacagttatggctccagcaggcccattcgcctgtgggcccgttgcaccgaaccattgcgcatggcccaacgcaacaacggcgcg

SEQ ID NO: 717226 - DNA, 140 bp, Homo sapiens
gctcggtaccaacttgggcgagctgcttcccagcggggactcgcctactgaaccagaggatgacggagaacctgctggccagcctgtcggagcatgaacgcgcagccatcctcagtgtacccgcagctcgcccctgagtt

SEQ ID NO: 717227 - DNA, 1479 bp, Homo sapiens
  misc_feature (647)..(647): n is a, c, g, or t
tggaaaaagggtctcactctgtcacccaggctggtgtgtaggggtgtgattccaccactctcacgtgcagtcttttgaccctcctgtgggcctcaggtgtgatactctcccaccctcagccctcttcaagttagcgtgggacgtgcaggtgtggtgttgccaccagtgccgtggcctcttatattatattttttttttgtttttgtgtgagagataagaaacacagagcggacacctcttgtgtgttcacacccagagaggcgtggtctctgtgagagagtctcccgtgctggccctcaagaggagaactcaactctccacctctctcaatatatctctctaaacgcagagtgtgtgtgtgaaaccccacacacaaagtgcgccgcgtgtgcgcgtcttttaaattatatatattatattattatatattatatatagagagagagagagagaaggagggctccccacccacagcaggggcgtgtgaagaagaagagagagaaggagcgagaaagagacacacaggagcgcgcccacaagtgtggagagacactctcatcacacactctctctctgagagagcaccagagagagagagacatcacctctcacacacacactcatacacaccactcgcgcgagagagnacagagcgcggagagacacaaaagagagaaccacacacagcccacacacacagagcgcgcgcgaggaatataataaaacacagatgagacatatatatatctatataagaccaggacgtgtgtatcatatatatataatatatgatctatctctcatcatctctcatcatcttatataatatattattactataagaaacacagaagagggcgactcaacacactctctgtgtgttgcgccacaagaataaacagagagagcgggggcccgcgctgatagagacaacacaaaaacaaatctcaaccgagagtggacaggacaaataatacaaacaccaaccccccaagcgaagagacacaacaaagaggaaaaacctccacactacaaaaacacactaacaaacgactctcccccaaaaaagaatacacaggggggcgacccacaaaaaaaagagagaaaatatagggaggcccccaccacagaagatgagtgggggaacaacaaactatatgacaaaaacaagctctagagtggagacgagaaaaacaagagagaagagcaccccaaataggtggtgacgaacacaaaatcggaccccaacaaaacacggcggagagcaaaacaagaaaagaggacacacacacagaagacaaaaaaagcaacaccccacaagaggggcgcggagggaagagaaaaacaaaacaaaaacacatataaaaaaaaaaagaggaggaaaactcaataacaacacacaccattattataaaaacccgccgcgacggagagatggaaagaagaaaccaccgtattattataaacacaaggaccact

SEQ ID NO: 717228 - DNA, 159 bp, Homo sapiens
ggggggggggaaaaattttttttttttggcccggggggtccccccccccctccccccttaaaaaaagggggggggggggggggggggccccccccccccctttttttttcccggggggcccccaaaaccctttttcccctttggggggggcccccccca

SEQ ID NO: 717229 - DNA, 121 bp, Homo sapiens
cggtcctcctgttctgccgcttctgctctgcttgcttctgcttcgctcctggtttctgcttctgcttgtttctgcttctgccggttcctgcttctgctggtttctgcttctgcccagggtc

SEQ ID NO: 717230 - DNA, 760 bp, Homo sapiens
atatactgcacgtcagattcctacttacccacgttactacagtccctccatggttactcctattcttgggtgacgctgctaggtctacggggggtgacacagccatgccctacttaacttcttatggacagctgagcaacggagagccccacttcctaccagatgcaatgtttgggcaaccaggagccctaggtagtcatccatttcttggtcagcctggcttttaactttactttcccagtgggatagacttctcagacatggggaaataacagattctcagggacagtctactcagagactctggatatagtagcaattcatgctctatgcacctaggctccttaggtgtgagccatgattgatggacacgtcagcttctgccaatgagaccctcaatcacggctcctggcatgaatactatagaccaagggatggcagcactgacagtgggtagcaccgcagttgcaccgcgatgttccacacagtcgtacggttctgctgttggtagcgggtccccttactagtacacatcgtggcttccaaatagtctggctcccagccacacattgcatcctcctacaacacgatcttgggctgatatagctagcaatcgcctgccaaacacgccacctacactgaggaccacgaatggctttgccacggcccagtccttcgacacccccgactaaagcataatcatgcactctggacactggcataacaccgcgtccgttgttacagccctcacggctacgtc

SEQ ID NO: 717231 - DNA, 172 bp, Homo sapiens
gagacagggtttccctgcattgcattgcccaggctcatctcaaactcctgggctcaagtgatccttgatctgcctcggcctcccaaagtgctgagattataggcatgagccaccacacccagcctacaaactttatttcttgaattttaagccacccttctgtcgtcttctc

SEQ ID NO: 717232 - DNA, 111 bp, Homo sapiens
cttagaggtatccccccttgcaccattcctccctctccctgcggatgctcttcgccaatttgccttagactcgatgcgtcaccgacaatgtaatgggtaccgaggctcgat

SEQ ID NO: 717233 - DNA, 373 bp, Homo sapiens
taaggggtctcctgcgttacttaagctgcgaaagatgatattacagcacaagatggctgtatccgtggatccgtttgtcaacgctgttgcgagatagtgataagcttagaatggtccatgtcgtgactacaagttgtgtgtgatggccatctcgatctcgtctgacatcaattatcatgctattgaactatgtatgggttggacagacttagcacatgtgcttcccaagttcactccctctcagctttggcccatgtgaagctgctctgaggttcctgacacgctgtcctgagaggcgtgtatacctccagcaccacagatcctttgagcaccaccccgtccccgccatcctccatcaacagtagctgttgta

SEQ ID NO: 717234 - DNA, 1159 bp, Homo sapiens
  misc_feature (240)..(240): n is a, c, g, or t
  misc_feature (266)..(266): n is a, c, g, or t
  misc_feature (281)..(281): n is a, c, g, or t
  misc_feature (318)..(318): n is a, c, g, or t
gctgtcgggtacagtccggtaccctaacgcagcacccgttgattctgtccatggctaggacacccgtgagtgaatcagattgtgggatgtcgtctccagcaagtggcctgacaagagggaatcgtcatcgtgcgagtggtagactcgcgagtgatgcagctctgcaccgcagcgagaggataggcagtcacacttgcactcgtccatgtgctcgctcgcggagcgactatgtagtgcgtncgctcctgcggtggctgcacttgggngcggcaacactcgtnctcacgtacgcgtgctgccatttaacctgtacacgcnagtacataccaccattgcaccatttcgcgcgcaggcgtgtgctatgccaggggtaaccttcgcttcgactacgccccttgtgtcctacgtcttgtgcatattcgcactgagccttgtgtgtcgcacgtgcacatcgtcaccttcctcagagcacacgcggagaacatattgagacaccaagagttagcgtaagggaaggttgagagcactctaccatgcgcatagccacatgtgaaggctatcgcaggataacgtgctgtaaaacagagcggcacacattaggcctctctatcgtagcatccccatatattgctcacctaacgctggtgcgcttggttaggagtggagattcgctcgcgtactaccatcttcgcccgcgtatgtatgacatggacagggcgtctgtagacacgagtggtggacgcgtggtttagtcatatacgaatccgttgtcacctctcacggtcctacacatctagatggtaggctgaggccgccaagaagaaagcggtggggcttgcgaggtgctgcaaaggccaggcggtccgtttcgcgtgcggggtagaggcctgaatgtgtgcccctgtaggttacgccttgaacctgggttaggggccgatctcctagcgccagggagccctgggggcgttcctcccggacttattcctttcccctgctatggtccgggccgggcgggctctggcctgttcggcctgtgccggttcaggattggcatggcccccggtgggggctcccctgttagtggggggaaccctccctgccgggacgaaggcgaggctttcgcccccggcctttcccttttcgacaggggcgatttcct

SEQ ID NO: 717235 - DNA, 707 bp, Homo sapiens
cgcaccatctgttgccatcccggcctggacgaggccattgcagattttggaagatgtgcacagttcatagacaccctgtgatccagagacaacccctcaggctggaggtccctgtgcggttccctgagcatgtttctgtggatatgccctaccatgcctgttcatgcaaatgtgatgatctgtgctatgtgaaatgtgttagcatgacttgtgacagtgatgccacaataccagatgatacagatgtgtatcagcaaattaatgtcactccttctcatgcttttgtgtgtgttgtgaatgatcatatattgctttatatctccgatagacgagatgtgactgagaatgctacgccttaccaggacttgtgtgtgataacaagcggcagccacagcgacgaaagaacggtgccatagcccaggcgggacatacggagatagaagaacttttggccccatgaagggacaccatcactgcaatgcaggagcacaaaggactctgtactgaggacacattgtattgacatggttacaagaccgtggcatgaatcactggccgtacagaagtagtccagaactaggaacatgatgcagacgtaactgctatatcgacatgctaggatagacaggttccatgcaaacaaatctttggagtgttatggcatgcaaactgtgagatcatgaaaatcaacatgaaaaacacctgag

SEQ ID NO: 717236 - DNA, 580 bp, Homo sapiens
  misc_feature (563)..(563): n is a, c, g, or t
  misc_feature (567)..(568): n is a, c, g, or t
  misc_feature (571)..(571): n is a, c, g, or t
aggctacttagaggatccggtattgagtggcatgtagagggaagcacaagagcttgggtgcctgcagcaggtgatgggagagacttgtgagctgaggagagagtgtgcagacccaggccggtgcctctgggcagaggcaggtgcggagacagaacccacacctaggtggcctgagagttggtgtggacccggtgggggagagtgagtgttcagaggcccgtggatgcagatggttagggctttgttttccctggccagcaggcttgagctggatccctgagccctgggggacccgtttggagcccatctagtcataggagtgacacaatgggaggctcttgaggaccacatggaagacatttgggccagcagagcctgggagacagacgaggctgtcagtcagagcccagcctggcctcagctattaattcaccaggccattgcccagacattctcccatgtttccgtgactggcacagatgtgttctgcatggacagccagttactatttccttgttacttactgatgtgtgcctttaaaataaaaaaccaaaccaaaccantatnnaantaaacaaaa

SEQ ID NO: 717237 - DNA, 276 bp, Homo sapiens
atggtcctgagtgaatgagggtgtctgtcactttctctagtggccctgcttggaatatagcatccctgtctctattggtcttgcatgaaaagtagtgagcttatgtgcactagacctggtggcagtgcgattagcctctacatactcatcaactgctttattataagctcaggagggacgctgaccagcagagaagtaaggaacacaggtgaaagtatcaggcgagtgtctgcatgtgtgagaggaaaagagagcacaacctctgaccatcactat

SEQ ID NO: 717238 - DNA, 912 bp, Homo sapiens
cacccattgtcagaagcagttttcaggaaacttgtaaccgatcaaaacatctcagagaattggacgggtagacagcgcggcaacttcccgggtatgagatagggaaccccccctgactaccgagaggcagagactgcatgaaagaggcacgggggttcccatgatgccacgattgtccgtgcagattaccacaagaagatttctggcacattttgattatatactatgtactggactgaaagcaatcctgagagatttgaagtagacaaaagtaatcaacgttaaacacctgcaagagctacacattgaacctacttgtggagctactgatccacaagaaacaagcttattattgacagatcccctcttcatgggaactgactcgtgactttgacgacggtgtaccaagcagtgtgtcaggtgctgcagagcgttcttggagaagtgccactgaggcaggttcgtgccctgctgcggacagcctgactagaacccaccctgaggtccttgcatttctcagtcggtgtgtaatcacgttccagggcccaaagcccagctctttgttcagttgacttactgttttcttaccttacaaagtacttgtagatgtgaatcaagttgtgtatggcaggagaatcaattatcttttgagtccgacagcttatggggtatcttaagcattcttagactagttgaacatcttactttggccagcttacaacattgtagaacaagcaccctcaaccatgcaggaaacctccttgagtgccagtcactcttagccggtgagctcgatatcgataactctagaaggcggtgatgccgaggcagtccttgtcccggtacttcttcaaggccagcgatgaccccgtgacccgcactggtatccacccatgcgttttacagggcctg

SEQ ID NO: 717239 - DNA, 106 bp, Homo sapiens
ggatcccctgcctctggcaggcagctcgtgcgcccgcgccagtaccaggccgatcaccttcgcgtccaggcgttcccagtcctcatcggtcgcgccggccatgaag

SEQ ID NO: 717240 - DNA, 295 bp, Homo sapiens
ggagttagacagtgggggtcatctacctcttagtattatcctaggctgtgctttgcctacggtctttatatgctctctgagataatattgtctctagtactatgtaattagtacgtttcaaacctatatcagtgctcgtgcaagtaaaattaatcagtctctttatccgggcgtcgatccatccatccgtctatctatctttcgacctatcaatccttccctccaattgtctggtaattgtctctacttgcgtgatccccaggcactctgtactctacatgtctaaatgcagtca

SEQ ID NO: 717241 - DNA, 264 bp, Homo sapiens
cacttattcgtgttgcaccaccactactggtgataattttgtttttgtttttaatttgtagagatggggttcaccatgttgcctagagtggtctcgaattcctcagagcaagtgatctgcctgccttggcctcccggagtgctgggattacaggagtgagccactgcgcccaaatctcagaactttgttgattatatgttggcagattgcttccagggagaaagtatttaaggtctcccttaaattgaatataccctggtggac

SEQ ID NO: 717242 - DNA, 247 bp, Homo sapiens
ctggccgtcgtttttacactgtccgtcgtttttacactgtcctgttgttttacatcttggcctgtttttattcctcatggttcgtatgttttttaatctttttccttatttgtttctactttttctttctcttttttattttcttctttgattatttttctttttctttcttttctgattttttttttttttcttttttctgttttacttattttctcttgttatttgttgttctgcttcttcttcc

SEQ ID NO: 717243 - DNA, 112 bp, Homo sapiens
gttgggtttttttttgggttcccccccagccccctgtggccccccgcttggggggggtgccttaagattaggggaaataaaaatgtccttccccttttgtccttttccgtta

SEQ ID NO: 717244 - DNA, 187 bp, Homo sapiens
  misc_feature (39)..(39): n is a, c, g, or t
  misc_feature (63)..(63): n is a, c, g, or t
  misc_feature (114)..(114): n is a, c, g, or t
  misc_feature (124)..(124): n is a, c, g, or t
  misc_feature (155)..(155): n is a, c, g, or t
gtaacagttggagaaagctatcggtctcgttcaaccctnggacactccagatctcattggagncagggttcaagttctcatgcaagtcggccacaggagccacggaaccgcagnaggatttctnctgttatacagcccttgaggcagaatgcagnagaagttgtggaccttaccgttgatgaagatg

SEQ ID NO: 717245 - DNA, 379 bp, Homo sapiens
  misc_feature (344)..(344): n is a, c, g, or t
  misc_feature (362)..(362): n is a, c, g, or t
gctgcggatatgcactcggaccgctattaaaagatgaggccgggcgcagtggttcacgcctgtaatcccagcactttgacaggccgaggcaggtgatcacctgaggtcaggagttcaagaccagcctgacacacatggaaaattgccatcgtctactacaaatacaaaagatcgtctgcccggggctcgcgccgtgttgtatcgagatagctcgcaggaccgcactggacgcctcgcggcgcccatctccgccactccggattcggtgatctgaacccgactccctttcgatcggccgagggcaacggaggccatcgcccgcccctttttaacagcggcttgcncatctctcaggactcggnagccgtggggtaccgag

SEQ ID NO: 717246 - DNA, 546 bp, Homo sapiens
agcgggttttctcccccctggggggggggagcaccccctttttgtttggggccccccccaccaaaaaatttggtttttgccggaaaaaaaaaaccccccttttctccataactggggcgaggagggggggcccccttttttccccccactattttcccaaaggcactataaaataaggggtggtgggttcccctccaggcattcttcccacggcaaaaacaaaatggggggggggggttttttttcataagaacaaaaccttccccctcccttttttttttgccgggccccccccacattgtggttttcccccctgggggcgccccaaaaaaacacggggatgtttttttttttagggggccctgggaaaacaaattgggccgctggtaaaaggggccccaagcccccccccttaaaaaattggggtccccggtttgagcacaaagaaaaaaaacaaagaaagccacaccaagaggggatgttggagtaattccggaacgacagaggccccggtaaaataagcgcacaccagtgcactgcagcctg

SEQ ID NO: 717247 - DNA, 455 bp, Homo sapiens
gctttaaaccctgcgtggcaatccctgacgcaccgccgtgatgcccaggtaagacagggcgacctggaagtccaacatagcttccttaagatcatccaaactattggatgattatccgaaatgtttcattgtgggagcagacaatgtgggctccaagcagatgcagcagatccgcatgtcccttcgcgggaaggctgtggtgctgatgggcaagaacacgcatgatgcgcaagggcatccgagggcacctggaaaacaagccagctctgcgagaaagacttgcatggccgtcattattccgggaggcagatgtggtgctatggatgtttcaccgaagcgaggagcctcatctgagatcagggacatgttgctggccaagtaaggtgccagctgctgcccgtgctggtgccattgcccatgtgaagtcactgtgccagcccagaacagtggtctcg

SEQ ID NO: 717248 - DNA, 113 bp, Homo sapiens
gtcacacaaaacacagatctagtcatgcaaggtgactcgctatcgtcgggccattcaacgcctccgcggagcgtgaatggccaccccgctgagagggccagcatctgcaaagc

SEQ ID NO: 717249 - DNA, 407 bp, Homo sapiens
ttagaagaaaccgcaacaatccatctctcaagtagtgtatcacagtagtagccctcccaggtttccttaagggacaacatccttaagttcaaaagagagaagaggcacccactaaaagatcgcagtttgccctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggcaggagaatcgtttgaacccgggaggcagaggttgcagtgtggtgagatcatgccactacactccagcctggcgacagagcaaaacttggtttc

SEQ ID NO: 717250 - DNA, 117 bp, Homo sapiens
gcacgagaacgtgatattccttgaagtagatgtggatgactgtcaggatgttgcttcagagtgtgaagtcaaatgcatgccaacattccagttttttaagaagggacaaaaggtggg

SEQ ID NO: 717251 - DNA, 141 bp, Homo sapiens
cgaaactccgtctccaaaaaataaaaaattgaggaacaggtccaaagagggtaagggcggttctccctttaaaaaacagttaaagaccttggggggcgctgctccttgtaattgtcacctacttccgggggaaagaacgcg

SEQ ID NO: 717252 - DNA, 170 bp, Homo sapiens
tcataggttcgcaggggacaaggactcggtccgacttctggctctgccacaaagacgctataaccttcaataagtcacactcacattgtgttccacgttttgtctattataatcactgagctggggctgcgcacagtggatcatgcctgctaacctatcagggtacctga

SEQ ID NO: 717253 - DNA, 3064 bp, Homo sapiens
  misc_feature (1012)..(1012): n is a, c, g, or t
tcagtagcaactccatatctcagacgatattcaactttaccctttgtcttacagtagataataagcagcactatcgtaactccacctcctattcattgaacgattacttcatcctctggcctatcgtggattctctagaagtcactcctgtcgcgcattccaagcttgttactgagctgtcatcagacactggcagctcgaagacacgacgtccatttgtcgaaagaacaggagagccgcctacccactactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacngaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtga

SEQ ID NO: 717254 - DNA, 306 bp, Homo sapiens
cttttggggtctttgctactgttgattcgctatggtgcccggactgcacttaaactcctagtctcaagcaaccctcctgtctcagcctcccaaacaggtaggactacagctgcacgcgaccacactcagctaatcgttttatttttattttatttttattgtggaggcagaatcttgctatgttgctcagcctgtgcttgaactactggtctcaggcattcctcctatctcgtgctcgcacagagttgagatctcagacaagcggcaccatagctggctgatctggcttcactcataccttaacac

SEQ ID NO: 717255 - DNA, 2158 bp, Homo sapiens
gagatggagttttgctcttgttgcccaggctggagtgcaatggcgtgatctcggctccagcctggcgacagagtgagactctctccaaaaaaaaagaatcatgacacaagtatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtga

SEQ ID NO: 717256 - DNA, 698 bp, Homo sapiens
gagtttcgctcttgttgcccagcctggagtgcaatgatgcgatcttggcttactgcatcctccacctcccaggttcaagcgattctcctgcttcagtctcctgagtagctgggattacaggcgcatgccaccatgcctggctaatcttttgtatttttagtagaaatggggtttcaccttgttagccaggctggtctcaaactcctgacctcaggtgatctgcccgcttcagcctcccaaagtgctgagattacaggcgtgagccactgtgcccgggctatttagcctttttaatttgagcaattctagtgggtaagtagtggtatcttactgtagtttttatttgcatttccctaaatactaatgatattgtgcatcttttcatgtgcttatttgctatccaaataacaacttcttccccttccccttcctcctcctccccctcccacctccccctcttcctcttcctcttcctctccttctccttctccttctccttcttcttttcttcttcttcttcttcttctacttcttcttcttcttcttcttcttcttcttcttcttcttcttcttcttcttcttcttcttcttctacttctacttctccttctccttctccttctcctccttctccttctcctttccttctccttctactttttcttctccttctccttctccttcttcttcttccttcg

SEQ ID NO: 717257 - DNA, 3683 bp, Homo sapiens
  misc_feature (1012)..(1012): n is a, c, g, or t
  misc_feature (3302)..(3302): n is a, c, g, or t
tcagtagcaactccatatctcagacgatattcaactttaccctttgtcttacagtagataataagcagcactatcgtaactccacctcctattcattgaacgattacttcatcctctggcctatcgtggattctctagaagtcactcctgtcgcgcattccaagcttgttactgagctgtcatcagacactggcagctcgaagacacgacgtccatttgtcgaaagaacaggagagccgcctacccactactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacngaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccaggtttggttgttctgttaaagtggtgtcagatgtttcaagcagatttaactcctgcaagccctgatttcatgctgacaaggatgtatgtgactgccaatttaagagaacaaagctccacagatggagatgaaagtcagtgtccagacctctggttcagggctcgggctgcattaacacagagccaaatgtagtcagactgcagactgaagtgccccacgccacgnctcaggctggcagtcaaggaattcctacatgtcctcagcatgggcagaaatgcaggttgaaattaaaattggagaattactgagggcggaaagtgaggaaagcatgtaagcagtatagcccacttcaaatagcttgtctgtggccagaagaaacaggtggcccaggtgtctttaacatctttataaactcttaaaacatgaccatgcttttaatagaaagtgttggtaaaagcaaccaactgttttcctctaatatcactttgcaaatccctgtggttctgttctcctgaatttaggatagtaccggcatctgtgcccctgagcatattttgaacaatcattgatgtatagctagacatcccatctgaacactgagcaaac

SEQ ID NO: 717258 - DNA, 3135 bp, Homo sapiens
  misc_feature (1012)..(1012): n is a, c, g, or t
  misc_feature (2399)..(2399): n is a, c, g, or t
tcagtagcaactccatatctcagacgatattcaactttaccctttgtcttacagtagataataagcagcactatcgtaactccacctcctattcattgaacgattacttcatcctctggcctatcgtggattctctagaagtcactcctgtcgcgcattccaagcttgttactgagctgtcatcagacactggcagctcgaagacacgacgtccatttgtcgaaagaacaggagagccgcctacccactactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacngaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccagggnttccctaaagcagtgcagcaccggcccaggcatcactagaggtgctataggaaacatagatccagccagggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtga

SEQ ID NO: 717259 - DNA, 165 bp, Homo sapiens
aaactggcagacggggctggcgaaagaacaagggcctgcaagtgacccgtgcagatcaggggccccccagagtcaccggtcgcaggagtccttctggtctggccctccggcggcgcagaacatgctggggtggtacagcgggtcatagagcttactggagacctc

SEQ ID NO: 717260 - DNA, 696 bp, Homo sapiens
ttttttttgaatatggctgacccagctagggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtga

SEQ ID NO: 717261 - DNA, 1017 bp, Homo sapiens
accacgcctgtcggaatagatacgcttgggggtgaggaagttggttaggtgggtgaagttgtagagagaggctgttgcgttaggcccttacctgggataggggtttgggtgagttggggagctggttgatgacctcgagctcatatgactagaatagttagcgatctgtgggattcgggcgactggcgatggtgggcgacccgtggagtctcggtgagcgcgtgcgcggcggaggcaaggctcgccaatgatcctggattagacaggggggtggggtgatgaagtgttgatcggctccttttctcggctgcctgcctgccttctggatgttggcgctctctgcctgggtctcaatcggcacatcgcgcgtgacggcggggacccagcgtgcccctaggccgtcactggcaccccacatggtccactcccgggcccgatgcgcgtgcgcatggcacgtctaccggacatgctgtgagagtgggaggccccaggggcggagacccccagcctggtacacatgggtctcgctggcgcttggccagagcccaatcactgggttgggtgcttcacagccgcagccccggagctccgcgggaggtgcccctcgtgcttacggcttgacaattccttcgatgattcagagtattgtggcctgtggctgtggctcatgatacattggctccttgtaaaaggagccagtttcgcggtcgggaacagcgtggtgcgacgtcatctaccaatggggcagcttggtaggtgagcgacggccagaaccctgggtggcctttatcgtgccctccagatggtttttgcactggcacggtgttcccgagacgttggtgcccgaatcccctgccgtcgggtccgggcctggccctccggttggggatcgtgctgggggggccctggtgtcctgctggttggtgggtctcggttgccgacaattcgggctcttccggggccttggggggttcgcctctccccgctgtgtacccgtccggagggaggccattttgg

SEQ ID NO: 717262 - DNA, 362 bp, Homo sapiens
gcatgtgttacatagaaatctcatttatttagctaccatcgcagacgccaacacaagcagtctcacaaaggcagtggagtagttttccagaaggctgtaatgaggactgattggaacccatctcctgggaatcagagagctgctcagaacatgggcaaaaagtcccattcattttagactgtgaagaaactcgctaccaactctactgtattctgactataaatatttattaataaaacagatcccacggtagaacctgaggacctgcgaggacctgaggtgtatgacagcggtgtcattgtcaacaatagtgattatctgatgacatgtaataaatgatacacgtccgtcaaaaaaaaaaa

SEQ ID NO: 717263 - DNA, 731 bp, Homo sapiens
tccccgcactgttgaagtttccgcccaccactcctcttgtgtgtggggcccaccctggattgtttgataaaggggcggcctccctcggaccgtacaccacaaccactcacggggtgtgaaagaaccaccggctcgttcctgttgtacgaacgcaagtaagttgtgagtcgagcagactcgcgaggatattcgcccccacactcgtgtagagcatatggtgagtgtcttgggatgctgtctctttcgcccggcagcactttcattatgaatcgtcgcgcgctgcctcggtcccgctcgcacatatgggggtgtgcacccagacgtgtatgtattctgtgtgctacaccgaaagaacgtagttctattgtttctgttctgtgcagcacgctcgctcgctcgctttgttctaaaatatcatagaagatgtcctccactcgcgcgtctctctcccacacatagtgctgcgtgatgctacacacgcgcggcaaggtggccacaccgcggcttaccgctgcgccccgcacaactgggggcctatatagaagtattatacaaggtagaaacacctgtctacaacggcgactaactgttatctacgtagaaaaaacaataaatacggcgaatatactctctctatgggacaccagatggttctgcggcgccacataagtgttttgtggagttttgctcctcgcctaaccaccccggcccgacaaatagaccaacacaaa

SEQ ID NO: 717264 - DNA, 299 bp, Homo sapiens
  misc_feature (233)..(233): n is a, c, g, or t
tgcagctgcatgaaacggttccagcgttcttctttaacttcttccggaacctggtcaggcagggcattggcgtctgcaccttcaaccgggctgtatttaaagcagccaacgcgatccagacgcgcttctttcaggaagtcgagtagcatctggaaatcttcttctgtctcgccagggaagccgacaataaaggttgagcgtagggtcagttccgggcagatttcgcgccactntttgatgcgcgccagttggcgactcacagaacccggacgcttcatcagtttgagaatgcgcgggct

SEQ ID NO: 717265 - DNA, 141 bp, Homo sapiens
ggttcaggccgggggaaagaggagaacgggagaggaaggaatgtcctactccactgaacacagacaaaagcaacatgaccctcactaggatccaatgacaccggggccagctggcagtctgtggtggccgtcgacgcggcc

SEQ ID NO: 717266 - DNA, 891 bp, Homo sapiens
  misc_feature (37)..(37): n is a, c, g, or t
  misc_feature (84)..(87): n is a, c, g, or t
  misc_feature (94)..(94): n is a, c, g, or t
  misc_feature (144)..(144): n is a, c, g, or t
  misc_feature (153)..(153): n is a, c, g, or t
  misc_feature (156)..(156): n is a, c, g, or t
  misc_feature (165)..(165): n is a, c, g, or t
  misc_feature (174)..(175): n is a, c, g, or t
  misc_feature (177)..(177): n is a, c, g, or t
  misc_feature (182)..(182): n is a, c, g, or t
  misc_feature (186)..(186): n is a, c, g, or t
  misc_feature (189)..(189): n is a, c, g, or t
  misc_feature (196)..(197): n is a, c, g, or t
  misc_feature (208)..(208): n is a, c, g, or t
  misc_feature (211)..(211): n is a, c, g, or t
  misc_feature (214)..(214): n is a, c, g, or t
  misc_feature (219)..(220): n is a, c, g, or t
  misc_feature (235)..(235): n is a, c, g, or t
  misc_feature (242)..(242): n is a, c, g, or t
  misc_feature (249)..(249): n is a, c, g, or t
  misc_feature (256)..(256): n is a, c, g, or t
  misc_feature (304)..(304): n is a, c, g, or t
  misc_feature (310)..(310): n is a, c, g, or t
  misc_feature (314)..(314): n is a, c, g, or t
  misc_feature (351)..(351): n is a, c, g, or t
  misc_feature (393)..(393): n is a, c, g, or t
  misc_feature (411)..(411): n is a, c, g, or t
  misc_feature (440)..(440): n is a, c, g, or t
  misc_feature (480)..(480): n is a, c, g, or t
  misc_feature (503)..(503): n is a, c, g, or t
  misc_feature (526)..(526): n is a, c, g, or t
  misc_feature (539)..(539): n is a, c, g, or t
  misc_feature (585)..(585): n is a, c, g, or t
  misc_feature (828)..(828): n is a, c, g, or t
  misc_feature (877)..(877): n is a, c, g, or t
gggagacagagtaggttcaacaagacaaattccctgntgcaaaccaccatgatccactctgactttggtccaaactctgctaannnnaattctntacgttcattgttcccaagggtcattttaaagggtggtggccaccacccnttagaagcnggngggagggtnggggggggnntnggtgntgtnggnggcgagnngtttcttgttnttnttnttttnnttttttttttgcagnttggttnttgtcanttagggnttggtcacaggcagggtttggttcagtatcttgttaggggcaagagcnaagctntttnggagggttgggggatgcaggaaggatgtgtgggaatnaccaggccattgctgcatttggggtgacaggctgagtttgcnaagctggagggagctttnaggtttcatcttcactgggggtttttttnttggaagagtgctgaatgttaactcccaggcctcctcttncagcattaaggaagctatgtttnagaggggaagggcaagatgtgcnctcagcttcactnaatgagctccacgtagttggcagggaacatgccaaaatggccatcnggcccatagccacgccaccagctttcgtcgatcacctcgatgcccgtgatgaggttctcggggtcaaaggagatctctgtgtcgtcggctgcctggtagtcgtacagggcacgggcacagagcccttgcccactgagcccctggccctgaatgtggtggtcaatgtgctcagagccagcaccttgctgctgcaccagtgggggctgctcgtagaaggtctcctgctctggaggttcctcatanacagcctcctcttctgcctgcaccagacatggaggagtgctgggcgccngctcctcagcaggg

SEQ ID NO: 717267 - DNA, 480 bp, Homo sapiens
  misc_feature (239)..(239): n is a, c, g, or t
  misc_feature (243)..(245): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (259)..(259): n is a, c, g, or t
  misc_feature (357)..(358): n is a, c, g, or t
  misc_feature (360)..(360): n is a, c, g, or t
gtgttttagatgaaagtagaaatgagttgagggtggaagaaagggaaaaaaatcttattttttcaaaaggaaaaattggtaagcttaacattccttaaatatcttagaatttttccaaataagtatcttaaaaataacaaacctcccatcagtttttcctagatttgattttgcagcatctggggcctgccctgtgatctgcctgtggacatcgctcttaggggcggctcaccagcgtncacnnngtgnanantttggncctggctcgtccgggggacaccacactgcaggacactccaggctggccggcttctcagagcttcagatcctcatttttcatatgaagctcctaatgcnncncttatgggggactctgaagggttaatgggaggaatcatacagtgactgacccctgagaagtgtccagtgaagacagggcttagctaggattgctgttttgcctaatgctctgcgggatta

SEQ ID NO: 717268 - DNA, 1310 bp, Homo sapiens
  misc_feature (319)..(319): n is a, c, g, or t
  misc_feature (518)..(518): n is a, c, g, or t
  misc_feature (759)..(759): n is a, c, g, or t
ggtcagacagtgaggaggaggcggagacgctggctcaggtgaagcgttcagagggaggagccaccagatcagaggtgccttgcgctccgtgaccgaaggaagtcccccgatgaaaggggctagctcctaacaacatccgtggggaagacagggaccttcgtggcgtgccaggcacggggaacgcaggatgactcaggtgagctatgcatgcgaggaatcacgtacagtgatgtggagaggctaccggcgagctagtagactctcttgaccccagagtgattaaaagaccctcgtactggatttcttgtacgacaccgtnaatcagtgagtcctaacttggacctatgattgccttagacccagttatcgacgcccatggtcttgctataggagactccctgcaaggtagatggggccccgaaggcacttccgtgaaagaagtcaactacgctcaagggaggcgtcttactcatctcgaatggaagtcggtgggactcgaggaccgttgatacacccgncctacaagaagtttggctttgaactgctcttgggctactacacgtaatctaattgtggagttgaggcattgcccaagtaggcacaactccaagatagtagccacccaaaggcacaggataggctaggggccaagcagccaaggcaaggacgttccaagtccggactatctaagattggccaagaatacagggagtggactcaggcaactccggtgtcacagagtgagacccagtattgacntacgcagttggaacctagggttgctctgagaaggtcctcggcccaggaaaggcaagtgagggctcagtctcctgttggcagtgactcagcttcaagtgggggttgacaggtgctgtgggggaacactccctggaaaagtcccccagaaggcccttcgcgtcaggccgagagggaccaaacaaggtttgcaaaaacctgagtttctggggggcccacgggggcaccaaagagcctgttaagctaaatttacgtgtggaatcatcacagagatcctcggtagggacagtgacttgcaccaggagtgtcgaattacaacacaggggagcacacccaggcatcagagaagcaacgggtggaaagccagcaacaccacggagctacatgggcggccaaccgctacacagaatcgcgagcaagagatagagcaaacagagtcgatccagcactaccgcgagcagcagagccacccggccaataaggagaaagaagagcgaatcgtccgcctgtcttcttcttgctctgcacgtacttgtgggtgggggggggggcgc

SEQ ID NO: 717269 - DNA, 402 bp, Homo sapiens
cttgagattccttgtgaagttaaccccttttgcaaagcccttgggccggaaccccttttttcgccaggccaggattcccaagctccgggtggttaaggcagtttttgcagcaggggccctccaagccaattcaaattaaaaggcggcggttgcaggcaaaaagcctttggtaggtaaaaaaggaaaaaaggctcctgttggtgttaaaaacccaaaaaagcctttggtggggaaaaaggcagcggcttccaagaacccagcccctgaaaagaagcctgcagagaagaacccttctccagaggagaagaagcctgctgcataaacttttaaatttgatttttccataaaggtcaaatccttttggccagctttttttgaataaagccctgtttttccgggcca

SEQ ID NO: 717270 - DNA, 843 bp, Homo sapiens
  misc_feature (664)..(664): n is a, c, g, or t
  misc_feature (680)..(680): n is a, c, g, or t
  misc_feature (702)..(702): n is a, c, g, or t
  misc_feature (712)..(712): n is a, c, g, or t
agcggctcgctcccggggcgacgcccgcgtgcgccagagtcgccgaggtcgtccccggcaccggaagtgaccctggcgggtttgtcttcaaattctcggcgagcaggagccgcgccggcaggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtttggcaggaaataaatgtggaagctaaacatgttaaagatatcatgaaaacactagagagctttaaactggacagcactcccttgaaagcggcacagcatgaccttccagcttctgagggagaagtctggtccatgcctgtacctgttgaacgaagaccctcaccaggacctagaaaacgccaatcttctcagtacagtgaccctnaaatccacatggtaantcgtccaagtacaactgtcagnagttcaccgntcatctgccagaatgttcacatgacgaggggaaagctgttcgttgtcgtgaaaagaaagaccgaataaggagaaggaaagaaaattcccggtggggtaagaaccgaaaataattggtgaccggatatagat

SEQ ID NO: 717271 - DNA, 540 bp, Homo sapiens
  misc_feature (11)..(11): n is a, c, g, or t
  misc_feature (105)..(105): n is a, c, g, or t
  misc_feature (218)..(218): n is a, c, g, or t
  misc_feature (220)..(220): n is a, c, g, or t
  misc_feature (238)..(238): n is a, c, g, or t
  misc_feature (510)..(510): n is a, c, g, or t
ggccacatgcnttttttcaagggttgagtcctccatcattatacacaaaaaaactcatgcagtgtttttctctcacacaatctcaattcataattctcccacaanaaataactatacattatcctccccccataacatctacaacctccatcctctcagcaatactctcatatacaagctgcaatttaaaattttttatttggagggtggggtgactncncaacccccccaaaccccnttcaataaataaaactcctccaaacattttaaatctactaaataacgacactttccataccaacttatatcaacaacccctcctcaaaatcaaaaatttcttcaatttaaaactccttcaacctacccttccattcctcttcctaatcagggcgttcatcctcttcttttctctctttttatatatactacactttcaattctcttcttgaacgcacccccacccgcccccctctctcctcgcttcttatctttctcatcttctctcaactnctcctcctcctcatccctgcttctctttta

SEQ ID NO: 717272 - DNA, 950 bp, Homo sapiens
  misc_feature (109)..(109): n is a, c, g, or t
  misc_feature (160)..(160): n is a, c, g, or t
  misc_feature (163)..(164): n is a, c, g, or t
  misc_feature (178)..(178): n is a, c, g, or t
  misc_feature (227)..(227): n is a, c, g, or t
cgggttttctttgcccgcctcttttgtgttttttttgccccgagtgttccccttgtgttccccccgggccccacggcggcgaactcctttctcatgttctttgtaaaanccatgttttttttaaaggagtgaatagcatgagcacacatatagagatggnaanntggtatgtgtgatngtttcttgaggagccctggaaagtattttgtaataactatacttatttntaagagacatgtaaacctaaagtgtttctttttttcttcttctttttagcttacagttgaacatgagtcttcttatgattagtgagaatgtaaaattggctcgtgaatatgcattgctgggaaactatgactctgcgatggtctattatcagggagttcttgaccaaatgaacaagtatctgtactcagtcaaagatacatacctccagcagaaatggcaacaggtgagagtaatggctgctgtatgttttaatggcttaagtactcggaagagaaaatttagatcagatgtcaatgctgtatgtagttacatgttaagactgtatgactaccgagcacagtacacagtggctcactcctgtagtcctagcactttggaaagccaaagcagaaggatcacttgaggccaggagttcaagtccagcctagacaacatagcaagacttcattctacaaaaataaaaaaattagccagatgtggtggtgtgtgcctgtagtcctagctactagggaggttgaggtgggaggatcacttgagcctgggagattgaggctgcagtgagctatgcttgtaccactacactccagcctgggcaacagagctagaccttgtctcaaaaataaaaaacaaacaaacatgagtatgtgagttattacacagatttctatataatattactgacactttattatatgaataataatccactttcaccatcagcc

SEQ ID NO: 717273 - DNA, 1205 bp, Homo sapiens
cctatggatcgaccttattatctctcagttctcttctgtttttacgttgggtatattccctcgtcatgactaattggtaccaccccatgtgtccggtgtctcgctgtgtgtggggggttctcctgttgttgtgtcatcttttgttgggcatctgcgtggtgttgtcctttttatctctcctattagtttgttagccagagcatggactgtgtccgtgatgtggttatctttggtttttgtttcatatagttatggtatgagagtgttggggtgaggttgtgtgtggcagggatttgtatttggttattctgtaatggtgatatgggttttatatgttacaatgagagtatagagtcatgttgtagggagttgctgttatttgggattatttatagatatgtatttcagttcgttgacttcgcggggtttttgtcctcggcttgggttggtctcttgttcagcctcggtcgctgttcgtgcgccgttgttctgggtagtgtgatttcttctgtgtgtatctctgtggagtacagtcccgtattgtttttgagttgttgggataggtatcagccttcttcttctcagtcagcgggtagtgtgtctaagcgatgtgtgtgtagtgtcgtctttctgcttatggacgtacgtggctgttcacaggtggctaaagttgatgtcacttgggttatagatctgatgttatttccaaagttgaggctcgggatatcacagaaatgatctgatcataggctgtgccatgagagacctgttggttgtgtagataatatgcagttttcattgcctcactggcctgggtagcacaagctagaatatagattactagagcacacagtggggcaggcaggcttctagttactctggtaactgggctgtctactaaacctcctagcatttttcaggtgagaatagcttttaggataaagttctctctcctagttagtactatacacggagttttctttgtcttaccccatgcgctcgcttcggaagtgaactggatatattatatgctagctagctagggatataagcgtgaggagatatgtactactcatcacctccctacctgtgataagcccctcttcagacaaagaagtatactactataatctattgtctcttcctttgtggaatagaatacaggactagctagtagctacgtatgcaggcaggttggcgagact

SEQ ID NO: 717274 - DNA, 1017 bp, Homo sapiens
  misc_feature (323)..(323): n is a, c, g, or t
gcttctggagggctcgttgcggggtgagtgcttcgaggcgcagagctggctccgtcggaagagcgcacctgtgcagtgagggagcatcccgggcctcccggacgggcgtagtgcgaagtggctctcacatgacggtctaggaacagtagctatgaacgttagctgtgtgtgcctaccgcctgatttcatatggtgaaactgggcagcgtcagttccaatgatccgtgcaacccgtgttcatcagtaacgaagagcagaggcgtcacacgtcttccaatgacgtcttatcgcatcattgcgcagggccgtcaacccgatggagnacgcatcccaagagaagcgcagagaatacctaggctcaggggacgcatcgtgccctctgttattgaatagcctcgctctgacccgggtagtggctgttcttcttcgagagtatttcattccactcctcagtgcgagggagagtgagtgatcgacataaaaagttcacatggatgggtgtctatcatactgacttggaggagatgtgactcctcgatatgtggcgaatgattaggagaaccttgaggcgctagaggacatgaatggctctagctgtggggacgcatttctaggaaactctattgttctggtgcgcaatgactaggattggtgggtctcgagcccaccatcattgtgaggaagtgcagctgagtagcgtctttttgggacgcattactggtacagctgcagcatctaaccggtgagctggtgaatgtggagatgctctagataggatacagtgagggctgtatctggaggagtcttcaggagacgaacatgtatgaatggagtgtggagttgaaagcggcttgacaggagtggcagactaaaaggtaggctgggtctgtacagagggaagggggactggtgtgtcccagtgaggctgggaaggacgtttggacaaaggaggcgctgagaatttgtggggaaaatgggggtggggaaaggtcaaggggtgtgggtgagggttggttg

SEQ ID NO: 717275 - DNA, 683 bp, Homo sapiens
cttgagcctatgagtgcatgaccagcctaggcaatgtagtgacacctcatttatatttattctagaacaaagagagagtactactgaagaactctaaaaaataaaatataagcttaccttggattcttggcttagagtagatgtttctcttaagttatggaggaaacatgcttgtgaaagttcactgacccactgtagatgctgcaagaacaatcatcccttccatgtatgtcttgagagagaaatcacagaagcatttctcaccagtactctttggcttaaaatgttcagcaaaattgggctgtgggggtgacttttctgatattaatgatatctacatccaatacactgaatcttgctttacaggtaagactctaatatctatactgaaaatatgggagttatatggcactactgtaagtactgtttttcacaaagctcttatttggaagctagcaatgctagtctcttgaatgattgtttggactcattcattcctgttaagctgccacaagttaaagtgcactattgtatattgttaagaacacatttgaaatggaattttgatgctcctcagatcacaagaaatacaaatgtatatagtataatcggcacccaattcccctatagaggagtccattacatttactggccgtcgttttaccgcctgactgggccttggc

SEQ ID NO: 717276 - DNA, 134 bp, Homo sapiens
cagcttgagtaatggagccactgaataatatctgtgtatttggatgttcgattagagactttgccattctctcaatgagcgaccccttaatttgcaccaagtaatggtcatggtgaacaatggtgtcattcaca

SEQ ID NO: 717277 - DNA, 1055 bp, Homo sapiens
ccatttggtccggctctgtatccctgcgttgctctccagtctctcgcgatgccgcagatcaccatgaggtttcggatatcatgtagcctagacttgtctgggctctactgtggtccttgattatcgtgttgcgggttccgagctgcatcgatggttatgtggctatgactcacacatgatgtgtccgatatctgggatgccgtggttgcttacctggacccgcccttaccgatctattgtgtaactcgcccgtacgtatttgggtgatacattcacactctcacgatctgttacaagcctcggtggaggtcgtcagactgcccaggtagtgaatataaaagctgtaagggtcaatcttattggttccttgtgctgattgttctgggtactacataacgacgtgaagtgtgaatacttacaggcctcttattaagaatgacttgatgactatctcgacacaaatgggtgatctgactgaatgcatgattgagagtagatctagagcttatactgggctctatgtggcaccgtaacatctaggatactattattgaatccaacctgcgcccaataagagatccttgtcaggtgttatggcaagatggtttgtcaatgcatttactagatgttgaaaccttgtgcattgagtgaagacgacggagtgtgtgctgaaggtgaagatgcgacgtgcggtcaaaggctattaccatgcaggacgggtttaaatctcgtgggcctcatctgctactgcgtgccagctgtggaatacaggctttcagaagactgtcgaggtacgacgttgtgataagagtgacagactcaaaagacgttgggaacggatagtgcgggggcccgaggcccgagtactgggtcttggaaggcactgatgttaccaacacgagttgccctgtgcctgggtggcttaaagaacccaaggaccatgcttgcatgttggaatttgaattcccttatttgtcagtttacattcctttcaacgggggggcgccattggttcccccatggcctttccatcttccggctcccgttaaaaggca

SEQ ID NO: 717278 - DNA, 101 bp, Homo sapiens
gttagtcaggtcgatcattctatttccccctctattgatccccacctctcaaatatctcatcaacaaccgactaatcaccaccctaacaatgactaagtca

SEQ ID NO: 717279 - DNA, 333 bp, Homo sapiens
atctcatccttcaggccttcctctaagctggaactaggataagaattaacgagcccagccaggcgcggtggctcatgcctgtaatccccgcactttgggaagccaaggcaggtggatcacttgtgctcagcagtttgagaccagcctgggcaacagggcaggaccctgtctctaccaaaagtacaaaaattagccaggcacagtagcctataatcccagctactcaagtggctgaggtgggaggatcgcttgagactgtgaggcagaggttgcactgagctgagatcatgccactgcactgcagctgggtgatgaagcaagaccctgtctcaa

SEQ ID NO: 717280 - DNA, 158 bp, Homo sapiens
aaagataaatatgaggataagacttccaaggaagttggccaggttgcagtggctcattgccttgtaatcctagcactttgggaggctgagacaggcagattgctttgagcccaggaattttgaaaccagcctgggctaacattggcgaaacctcatct

SEQ ID NO: 717281 - DNA, 139 bp, Homo sapiens
cttctagtggagctgctgttatcagatgcacactggtaaaactgccacttgtggtgctgtataccttgagatgggtagcacgactcccagtgtgactaattaccaggcaatactatactacaacagcagggatcactgc

SEQ ID NO: 717282 - DNA, 659 bp, Homo sapiens
cacagattttaaactaccaaatttgccttaaaacctaagagattcctacagtgccctgatcccaaccttctgcggtgcgggctaggagtacaatagtcttagcgaactactatacttaatggatgcagggggtggacgcaacggaacaggttaccctaggatctaacagcgcaaacgttctctagagttcctatcaacactatggttaaccatctttacgttaaatcatcacatcacttttgatgcagccgatgttaatggactgtgtgggataactactcataatcctacatgaattagaagaaaacaccatcaggtaataccaggactataatattatttagcaccatattccttcattgtactcaactggtacaccttccctatttagctctcattatcactcacttaaccacttattcactgccttgactcatattactcgcttcacagcttcttatctctatttacacaatcctatcatcccattacttatcatctaaatcacatattaaactacatatctctagtccatatttcttcactactgcacacaatttcaactacatagtgtctatttttactcacttctgaatctcttataaacctcctatctccatacttccaatttatatatactaactaaaccccgtctatct

SEQ ID NO: 717283 - DNA, 578 bp, Homo sapiens
  misc_feature (47)..(47): n is a, c, g, or t
  misc_feature (71)..(71): n is a, c, g, or t
  misc_feature (81)..(81): n is a, c, g, or t
  misc_feature (83)..(83): n is a, c, g, or t
  misc_feature (99)..(100): n is a, c, g, or t
  misc_feature (107)..(107): n is a, c, g, or t
  misc_feature (110)..(111): n is a, c, g, or t
  misc_feature (117)..(117): n is a, c, g, or t
  misc_feature (121)..(121): n is a, c, g, or t
  misc_feature (124)..(124): n is a, c, g, or t
  misc_feature (127)..(128): n is a, c, g, or t
  misc_feature (130)..(133): n is a, c, g, or t
  misc_feature (141)..(141): n is a, c, g, or t
  misc_feature (147)..(147): n is a, c, g, or t
  misc_feature (156)..(156): n is a, c, g, or t
  misc_feature (160)..(160): n is a, c, g, or t
  misc_feature (162)..(162): n is a, c, g, or t
  misc_feature (165)..(166): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (181)..(181): n is a, c, g, or t
  misc_feature (186)..(186): n is a, c, g, or t
  misc_feature (192)..(192): n is a, c, g, or t
  misc_feature (200)..(200): n is a, c, g, or t
  misc_feature (210)..(210): n is a, c, g, or t
  misc_feature (231)..(232): n is a, c, g, or t
  misc_feature (236)..(236): n is a, c, g, or t
  misc_feature (246)..(246): n is a, c, g, or t
  misc_feature (279)..(279): n is a, c, g, or t
  misc_feature (281)..(281): n is a, c, g, or t
  misc_feature (291)..(291): n is a, c, g, or t
  misc_feature (305)..(305): n is a, c, g, or t
  misc_feature (352)..(352): n is a, c, g, or t
  misc_feature (359)..(360): n is a, c, g, or t
  misc_feature (369)..(369): n is a, c, g, or t
  misc_feature (386)..(386): n is a, c, g, or t
  misc_feature (390)..(391): n is a, c, g, or t
  misc_feature (394)..(394): n is a, c, g, or t
  misc_feature (436)..(436): n is a, c, g, or t
ctacataaataaatatagttttaaaagtggacctttaaacatcagtntttcccttccgtcatggcattccnacgacaaggncnaaacaccccccccccnnacctganaanncccgcnaccnacnacnncnnnnaccatgancaccanccccgccanaacnanacnntngtcacntcntggngagcnagaganatgaaganaacaaaaganaatcatgtgcgagtttaatgnnattnatccgatacntttttcaaaaagtcacactcacgtctgcatganantattagaggnatataatgtatganagagaattccaataacataatgtacaaaaatgttgtcacatacagangagcganngtctacgtnttgggggctattgctgngggnnggngggcctgatcttcatactcatcttcctcattgagtaccatgnccccttccaattcatccatactacaccatcatctgtgccatgctttgccatgtcccaggtgtactgtccaccccagtagtatctgccgtttggattggctgcatgacatctattataccaccatccaccaccgtcttcttta

SEQ ID NO: 717284 - DNA, 746 bp, Homo sapiens
  misc_feature (725)..(725): n is a, c, g, or t
  misc_feature (729)..(730): n is a, c, g, or t
  misc_feature (734)..(734): n is a, c, g, or t
ctggcttacccagcccaaaggaccccactcccgggggtctggggacctgaaggctcttgtctgacccctctccccacctgtatttcctggctggccttgcgtgcctctgtgtttagaagaaccgacgagtttattagagaaggaaagactgcactgtgtgaccttgaataagacagttcgcccgtgcctcagtttccctgactttcacgcaaggatcaccacggtttcctctgtcaagttcctgagatgggcaggggggatttttgttctcccagcacctgcggctgttgagaccagagaagctggtggtcgaccaaaagcctggggtattagttcaccccttagcttctcccccagcgagaccccccagggcccttgggcacaggggattaagccctctatctgcttacgtgcaagcggaagaaataggcccagagagcaacagtggcgggtctgcagtcacacagcccaacttgcgcttgtggcagtggcaaggttggaagctggttcagtggggctgtcgaccacaggtaccaaccctgccctcccctacagagtatgtgacgtagcacagccaatgactgcatcccagtgcttcgaccagtcacagggtcaagggtgcagtggctcacacctgtaatcccagcactttggagtcccaagcaggcagatcgcctgaagtcgggagtttgagaccagacctgggtgaaaccccatctctaaanttannacantacaattaaaaa

SEQ ID NO: 717285 - DNA, 774 bp, Homo sapiens
  misc_feature (25)..(25): n is a, c, g, or t
  misc_feature (27)..(27): n is a, c, g, or t
  misc_feature (604)..(604): n is a, c, g, or t
  misc_feature (613)..(613): n is a, c, g, or t
  misc_feature (646)..(648): n is a, c, g, or t
  misc_feature (673)..(673): n is a, c, g, or t
cgccgtcgggccttctccctccagngnccaagagccactggtactcagtgtctgggtgggggcaggggggatttttgttctcccagcacctgcggctgttgagaccagagaagctggtggtcgaccaaaagcctggggtattagttcaccccttagcttctcccccagcgagaccccccagggcccttgggcacaggggattaagccctctatctgcttacgtgcaagcggaagaaataggcccagagagcaacagtggcgggtctgcagtcacacagcccaacttgcgcttgtggcagtggcaaggttggaagctggttcagtggggctgtcgaccacaggtaccaaccctgccctcccctacagagtatgtgacgtagcacagccaatgactgcatcccagtgcttcgaccagtcacagggtcagaagttctgagggtacccctcactcaagctccaggcgtcaggaaaagaacattccacgaagtccatctggaagacggtcctttccctgctgcccccagcttctagaacattccctggaacacagcaagtgttcagtattgttcatggagtgacagatgtctcagccaagaaggtacantcacagggnagaatgacttcaactggtcttgacttcaacctnnntccagcctggttcccttctcccacntcctagagcccacagaagatcttttccaaactggaagtctgtccaggtcattcttctgctctaagggtttcagtagctccccttttcccaggaggaagtca

SEQ ID NO: 717286 - DNA, 1008 bp, Homo sapiens
  misc_feature (888)..(888): n is a, c, g, or t
gcagctctttgtcctgcgtcccaggtagctacacagccttcgaggtgaccggaccaggacagacggtcgcccagatcaatgctcatgtagcctcactggagggcattgccccggaagatcaatgtcgtgctcctggcaggcgcgcccctggaggatgaggccacgtctggttccagtgcgggggctggagcgctccctgactactcctggaaatagcatgcccgcagtgcgttggcagcgtaaagtccgatggtgttccctggcccggtgcctggagaacagtgaggaggtccagacgtcctagaggtggctcaaacaggaggaaccaagacacggaagtaagacaggtcagcgtgctaaagcggtcgcgatgtcggatactaatccgtgcggcatttggacgacaccgattgttgcctcccagcacgtctatggggccagaggacatgaaaggggcactcctagagtgtcctagacttctctgagagtctgtggctgatacactctgcctgtgcgtatgtcgtccatgacagtgaaaaacagaaagcgcgacattctaaggatctcaaggttcagagtcctagatatagagaacagacattagagcatagagacacacaagaacagaccaaggcgcggcgccaagcccggctcgcaaaagagagagtttgcactcacgcgcacagcgagggggagcgcccattttgcgttactacccccggggatatacccgccgcacgaggtcgttctctggtgtgtagtgcaaaccaaaacggggggcgagcgcccacccttttggattacgacgaggcgaggtcctcagcttgcatactaaggtacgagcgcattaacccacggcagaacctgtgaccttccacacgcacttgnccggtcctctgatcgcagacccttgccattggaagggcgcacgtgaagccgacccatgcaccgcggtgctacacacaccacgctgcgccgcgaaacacgccacgcttgtaggtgtacgaa

SEQ ID NO: 717287 - DNA, 343 bp, Homo sapiens
cgcctcctgcatctattcctggggtaaaatccccgcccgttggacacgtgaccactgagcctgcactctgcgcttccattggccagaccacgccccgccccttgggctccgggcacttacgtccgctagtgggcacaatctacagaggtacggaccgtggagattcgaggctgcagcctggacatcgcctatgtcctcgatagtgagcacatccctcataacactgagcggagtgtgacggtggataagtcggcgtgaggctagaaagagctggttgtgaagggacgggaagacccggcatagcagtccggacttctttgggagtggcggctcccatgttgat

SEQ ID NO: 717288 - DNA, 943 bp, Homo sapiens
  misc_feature (512)..(512): n is a, c, g, or t
  misc_feature (524)..(524): n is a, c, g, or t
  misc_feature (773)..(773): n is a, c, g, or t
  misc_feature (782)..(782): n is a, c, g, or t
  misc_feature (815)..(817): n is a, c, g, or t
  misc_feature (842)..(842): n is a, c, g, or t
ctggcttacccagcccaaaggaccccactcccgggggtctggggacctgaaggctcttgtctgacccctctccccacctgtatttcctggctggccttgcgtgcctctgtgtttagaagaaccgacgagtttattagagaaggaaagactgcactgtgtgaccttgaataagacagttcgcccgtgcctcagtttccctgactttcacgcaaggatcaccacggtttcctctgtcaagttcctgagatgggcaggggggatttttgttctcccagcacctgcggctgttgagaccagagaagctggtggtcgaccaaaagcctggggtattagttcaccccttagcttctcccccagcgagaccccccagggcccttgggcacaggggattaagccctctatctgcttacgtgcaagcggaagaaataggcccagagagcaacagtggcgggtctgcagtcacacagcccaacttgcgcttgtggcagtggcaaggttggtgagtatctgantcttcaggccanggcattttccgctcgagtggagcctgcctcagcctgttcctttaacatcagcttctgaaactatctctgcagaagttctgagggtacccctcactcaagctccaggcgtcaggaaaagaacattccacgaagtccatctggaagacggtcctttccctgctgcccccagcttctagaacattccctggaacacagcaagtgttcagtattgttcatggagtgacagatgtctcagccaagaaggtacantcacagggnagaatgacttcaactggtcttgacttcaacctnnntccagcctggttcccttctcccacntcctagagcccacagaagatcttttccaaactggaagtctgtccaggtcattcttctgctctaagggtttcagtagctccccttttcccaggaggaagtca

SEQ ID NO: 717289 - DNA, 708 bp, Homo sapiens
  misc_feature (25)..(25): n is a, c, g, or t
  misc_feature (27)..(27): n is a, c, g, or t
  misc_feature (323)..(323): n is a, c, g, or t
  misc_feature (335)..(335): n is a, c, g, or t
  misc_feature (538)..(538): n is a, c, g, or t
  misc_feature (547)..(547): n is a, c, g, or t
  misc_feature (580)..(582): n is a, c, g, or t
  misc_feature (607)..(607): n is a, c, g, or t
cgccgtcgggccttctccctccagngnccaagagccactggtactcagtgtctgggtgggggcaggggggatttttgttctcccagcacctgcggctgttgagaccagagaagctggtggtcgaccaaaagcctggggtattagttcaccccttagcttctcccccagcgagaccccccagggcccttgggcacaggggattaagccctctatctgcttacgtgcaagcggaagaaataggcccagagagcaacagtggcgggtctgcagtcacacagcccaacttgcgcttgtggcagtggcaaggttggtgagtatctgantcttcaggccanggcattttccgctcgagtggagcctgaagttctgagggtacccctcactcaagctccaggcgtcaggaaaagaacattccacgaagtccatctggaagacggtcctttccctgctgcccccagcttctagaacattccctggaacacagcaagtgttcagtattgttcatggagtgacagatgtctcagccaagaaggtacantcacagggnagaatgacttcaactggtcttgacttcaacctnnntccagcctggttcccttctcccacntcctagagcccacagaagatcttttccaaactggaagtctgtccaggtcattcttctgctctaagggtttcagtagctccccttttcccaggaggaagtca

SEQ ID NO: 717290 - DNA, 159 bp, Homo sapiens
tgtgactctcattacgaattgtagagacgtccttgcccgagtggtacgctcgtgcttccaggattctctccaggttgccagacatccgtactggctagccaccaaagcacacggagattctgtcaggcgctgagacaccacagccttttcaatcttgtc

SEQ ID NO: 717291 - DNA, 572 bp, Homo sapiens
  misc_feature (66)..(66): n is a, c, g, or t
  misc_feature (402)..(402): n is a, c, g, or t
  misc_feature (411)..(411): n is a, c, g, or t
  misc_feature (444)..(446): n is a, c, g, or t
  misc_feature (471)..(471): n is a, c, g, or t
gggggatgatgagaggcaatgtggcatggtggttaagcgcgtggacttggagccagacggctgggntgaatcctggctccgctctcaccaactgtgaccttgggcaaggaagctggttcagtggggctgtcgaccacaggtaccaaccctgccctcccctacagagtatgtgacgtagcacagccaatgactgcatcccagtgcttcgaccagtcacagggtcagaagttctgagggtacccctcactcaagctccaggcgtcaggaaaagaacattccacgaagtccatctggaagacggtcctttccctgctgcccccagcttctagaacattccctggaacacagcaagtgttcagtattgttcatggagtgacagatgtctcagccaagaaggtacantcacagggnagaatgacttcaactggtcttgacttcaacctnnntccagcctggttcccttctcccacntcctagagcccacagaagatcttttccaaactggaagtctgtccaggtcattcttctgctctaagggtttcagtagctccccttttcccaggaggaagtca

SEQ ID NO: 717292 - DNA, 123 bp, Homo sapiens
ggctgagcaagctgcaggctgcagcatagacgccgacatcgacgtttcatccaggcaagagcacgggcacagagccccccgctccggtgccctaccagaactattacgatcgggaggtcaccc

SEQ ID NO: 717293 - DNA, 103 bp, Homo sapiens
tcaggtgcgagctgtttactcagtgtgcgagctgcactcagtgagcgagctgccgattccggagtagggagcctgagaaacggctaccacatcaacggtaagg

SEQ ID NO: 717294 - DNA, 3545 bp, Homo sapiens
  misc_feature (8)..(8): n is a, c, g, or t
  misc_feature (1395)..(1395): n is a, c, g, or t
  misc_feature (1397)..(1397): n is a, c, g, or t
  misc_feature (1507)..(1507): n is a, c, g, or t
  misc_feature (1535)..(1535): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatcagncnttcaataatttaaagaaatagaagctcagaactgaagtgaatttagttttgcctttaagaattctagagatgaaatgctccattgtcctatacttgttacatccattganttgtcaggccttcccagctcgaacaccngcaggtgtatctaagaaataatgcataggcttaatgtattcacattgacataaataaattgccataaattgacagtcacgttaagattgtatgaccactttgtctagaataaacctttttttagcctgatttctttttttttccattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 717295 - DNA, 1445 bp, Homo sapiens
  misc_feature (445)..(445): n is a, c, g, or t
ggtagacggtgatcactgtggacacttaaggcggcaggctaaaggccaagtgacagtgcaccgctgtgcactgcctgatggctcagatggtggatgtgtgatcgtggtgagagatatgaggactggcgactttcgacatctttctatcgactggcccgcccaagcctgggcgtacttcccgtctgtctggtgtgcgctgtggtggcgagcacagtgcccaatcatgctccctttccagatggtgatctggcttctggcttgggtgaccagtcctcgtcgtggtgcacgtcgcaccctcgtagcgcgttcgttcagcatgcgtgggccccagcacgattagcaacacattacgacacaccaagaggtctgggtcgcgaaggcgaaggaacattggggtgcctcccctggaaacgtagggcccacccgtggggtagcgagttagttnctagctcgtgtgccgtgggcaatagatgtatccgatggcgcgtagaaagtggcaacccgtatcttgacacttctgattttatccaccacttttcaaacacttattcaacgaaaaggggactgagagttctaccgaagtggcagacagtgtttccagcgtattggcccccactccaaggggcgatagaggtttggcgagcaagaggtcgcaaacgcaattaaacctttgagcaaaagcaaatattgagcaggccatccacgggtcgcaacccccgtttgtctgagttcattggcaaccacccgaaaggctgaaagggtctttagagtccctttgccaaccagaaagaattggtgaaccatttcgcaggcttaagtagaccagatcgatttgcgacgacttccccctagggggaaaaggccccccaatttggcaattggtggtcatatatttcgtttgggatttgtaaccaggtcacatatcggttggtgagggcccaatttgttcaacatttggccgtaatttggggtgccccgttgggctcatctaacccccaagttgtggaagttataggttgaggacctaaagggccctttagcaccgacaccgttttcaacccagcttccaaaaccaaaccgaaagggaattcgccaaggaggaaggaacgtgggggggggagcccatgtggtccagtaccctgggggcgcccattttgggaggggggcgccccggttcacaaaataggccgacgtgaaaacacatttccaaaggccattgggcaacctgtgaaccaacaccacccaagggggaattggggggaaaccactttgccaacacggcagggtttggttcccttaaactccataggcgccctttggtttgccattgccccagtgggtggtgacgaaccttcacacaagggagacagtttcctgaaggattccacaagaggtaacccaaaagtctgagaagacacatggagcagacagtgtttcccaccaag

SEQ ID NO: 717296 - DNA, 519 bp, Homo sapiens
ctagaggatcccgacgctctctctgtgggggcgctctctctggggtctccgcagagaggggcatggactgctggctttacctgggttggggcattgtctggaccagtggccttcattgccacacttgaaataggcgccaggtggaggtggattttaaggaggcttctgtgtggagctgcggccccgtgggcctgcagggcccctgatggtggaggcaagcatttgaaactctgcctgttttggccttttactttcctcattacaatggttgaagactttgaaggctaaattaagaaggacttgtggtggggtttgacggccgtcgtcaagcttctggagcttgagccaaacatggggggtggattaggagatgaactgaaggtttaaaatactgattccttctgagggtttgaaggggaaagcgcggttgagttaataggcaggggaggatagacagaggcgtacggtggcaggataggtttaaaggccccacagagagagcgtcccccacagagagag

SEQ ID NO: 717297 - DNA, 2829 bp, Homo sapiens
cagtggagaatcattaatactttattgtttagtgtcgaagcataaatcaacttgttaggccaggggttcctgtctaaatacagtattagttccataatgcttaataaaaaagcatccttcaaaaaaaacttctaagagtttatcttatgcttatgaaagtggtttttcgcactacataacaaatttctgaagcagattgaatgaatgcaaatgtattttttaaatgctaattataaaagtacctgctagaactaagtgcagtcacggaatggtatttttgtttcatcatgcattttcaaaagcccaatttataagttggagttttgtttaaaaaaatttgaaatctgacatctttgatttttccctcacgaggggaaaatttataaaggtataaatttgtgtgggacaaaatagaaccattaacattttaccagcttgcatttttaatccctccttcgtgttagaaaactgtggtatacaacgctagtgtttcaagtcatgttgctactaataggtctttgtgatgcagagcattcacttagctgctgcttaatctgatattacataccaataagaaacattttatttattctgagattggaaaaactttccaaatagaacatgcttagccttgaaattgccatctttatggattactagatttgtcacttagagagatcttcgaaaaataaatctgatgaaattaataatgtcgagttattttagcaatatatttcagtcacttaaaaacacaagtttcctatttagcgtttgtttcccatttctccagaaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 717298 - DNA, 860 bp, Homo sapiens
  misc_feature (850)..(850): n is a, c, g, or t
ggcaggagcaagcgtctgccgcggtggccgggtgcgatgtgacaagatcaaagctgcggaaaatgacagtgaggtcagagagatggaaggatctggatggatgatgatgcttgggagaagacaagctgccttatgaggatgtcgcaataccatgaatgagcttcctgaacctgaacaagacaatggtggcaccacagaatctgtcaaagaacaagaaatgaggtgacagacttagccttacagtacctccatgagattgtccccccatgggaaactgacgctgtggtcctttctgtgtggatggattttctcaaagtacacagataaaggcatggtggttcagtctccaaattcaaacccttgtgagtaataaatcagcactcaaaatgtacaccccatttagttgggtggtagcaaagtgcaatgcgaaatggatgaggaaactgagattctcagataatggtgaatattccgtcttaaaacctaaaactcttcatggagtagctaatattgaccatgatgtgttaacatctggcctctacctctgatttgcttgtgtggtcaaagtttaacaccttccactacttatgtgtgtcctgtaacacagctgattgacgtatgagagggaaggcaagacaaggcaggcagacactagagaatattactctcatacttcccaatgggagcatcgggggattagccgtaattgggaatttgacatccatccggtgtgatctaaattcaaggttcactgggattcgttaaaatctgcggacctgtcccaacttggcgaaactggggggaattcactcccttcccacgctttttcttgcacttttgtgctcatacncaaacacaca

SEQ ID NO: 717299 - DNA, 3138 bp, Homo sapiens
  misc_feature (988)..(988): n is a, c, g, or t
  misc_feature (990)..(990): n is a, c, g, or t
  misc_feature (1100)..(1100): n is a, c, g, or t
  misc_feature (1128)..(1128): n is a, c, g, or t
cagtggagaatcattaatactttattgtttagtgtcgaagcataaatcaacttgttaggccaggggttcctgtctaaatacagtattagttccataatgcttaataaaaaagcatccttcaaaaaaaacttctaagagtttatcttatgcttatgaaagtggtttttcgcactacataacaaatttctgaagcagattgaatgaatgcaaatgtattttttaaatgctaattataaaagtacctgctagaactaagtgcagtcacggaatggtatttttgtttcatcatgcattttcaaaagcccaatttataagttggagttttgtttaaaaaaatttgaaatctgacatctttgatttttccctcacgaggggaaaatttataaaggtataaatttgtgtgggacaaaatagaaccattaacattttaccagcttgcatttttaatccctccttcgtgttagaaaactgtggtatacaacgctagtgtttcaagtcatgttgctactaataggtctttgtgatgcagagcattcacttagctgctgcttaatctgatattacataccaataagaaacattttatttattctgagattggaaaaactttccaaatagaacatgcttagccttgaaattgccatctttatggattactagatttgtcacttagagagatcttcgaaaaataaatctgatgaaattaataatgtcgagttattttagcaatatatttcagtcacttaaaaacacaagtttcctatttagcgtttgtttcccatttctccagaaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatcagncnttcaataatttaaagaaatagaagctcagaactgaagtgaatttagttttgcctttaagaattctagagatgaaatgctccattgtcctatacttgttacatccattganttgtcaggccttcccagctcgaacaccngcaggtgtatctaagaaataatgcataggcttaatgtattcacattgacataaataaattgccataaattgacagtcacgttaagattgtatgaccactttgtctagaataaacctttttttagcctgatttctttttttttccattttttttttcagctaaaaatatctttagaattcgcttccatgacccctctccagcccagtctcacactctgcaagccaatgacgtgttccacaagcagcagtggttcaactgtattcgagcggccattgcccccttccagtcggcaggcagtccacctgagctgcagggcctgccggagctgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgagttatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatttttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccacttcaaagattttgttgaaagttttagtgttgtctgaaatgcaagagggaaggtgattggtagtgagttaaaagaaaaagagaggaaaagagagtagttttgtcttcaagtaaaatgtctggttgtgccagacatttcacaagtgtgaaaggagataggagaagctcaacttgagggcgtgtagtaagttgtagaaggctcgaggggacgtggacttatttgccttggtttgcaatacctgcaaataatgagtttgaaaagaaacaatgaaatgtgttaaaaatttgaccatattagataaattttggtggatttagtcataagatggaaaaagactggtgaatcttttattacaaaatgtttctgttaaaatgggatcatcatctttgaaaggggggaggaggagtaaaagcccgattataatggtgatcaattcaagtcagtgttgactattctgtgaaatatatttggccagtggaaatgataatcagaaaagactgtaaatagatccatccaaatgatttctctgtacaaatgaatgatactatta

SEQ ID NO: 717300 - DNA, 1934 bp, Homo sapiens
  misc_feature (8)..(8): n is a, c, g, or t
  misc_feature (1395)..(1395): n is a, c, g, or t
  misc_feature (1397)..(1397): n is a, c, g, or t
  misc_feature (1507)..(1507): n is a, c, g, or t
  misc_feature (1535)..(1535): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtattacatcgacaagctggagtacctggatgaaaagcagagggaccccagaatcgaagcgagcaaagtgctgctgtgccatggggagctgcggagcaagagtggacataaactttacattttcctgtttcaagacatcttggttctgactcggcccgtcacacggaacgaacggcactcttaccaggtttaccggcagccaatcccagtccaagagctagtcctagaagacctgcaggatggagatgtgagaatgggaggctcctttcgaggagctttcagtaactcagagaaaggtaaaatcagncnttcaataatttaaagaaatagaagctcagaactgaagtgaatttagttttgcctttaagaattctagagatgaaatgctccattgtcctatacttgttacatccattganttgtcaggccttcccagctcgaacaccngcaggtgtatgcttacagcatgcatatttgaggttctaatgacagccaggaccctctccccaggaaaaatgtatgtacatccacatccacatgactttggaacttcagggatattcccagacaccctgtggatgccaattgagatcctcttgtctgtcctgacaggactccagggaacctgtcattccttctgttcccttcagcttcttcaaagatgatgccaagttcaaggtcatgacaactccccgtggacggagcctctgcttctttcccacgtgggtccacgtgaggctctgccccaccaatgcccggtgccttctagaactcagtagctcagctgtccactgccactcatgaagctgatctgagcccctcagtgggaagggcagagtcagtctc

SEQ ID NO: 717301 - DNA, 312 bp, Homo sapiens
atcccccaggttcacacttgctgcatgtgcacggacaccaccctgctcacgctgagagactgagtggtagactcctggggaagttacagagggtggccctcaggagcatggaacacaacctctacaattggacccctgttccccacagggtcccggaagctggactatgtgaggccagacatggcatgagcactgcttcctgtgcagtgcctgtgaacagccactgagctcccgttcttttgtgcccaacaagagtgctcactactgcgtgccctgctactgagaacaagtttgctcctcgctgcgccccgc

SEQ ID NO: 717302 - DNA, 463 bp, Homo sapiens
cagactagggggccgttccttgtagagtcaagtacctctgtcccaagaggaacccaaccgttgggttgtggaggggaagggagccacaccttacaacttttgccccgtaatgaagggggtttttgtgaaaccgacccaaatcattgtggaaaccattatttaagttttttcgggtcgagggggccgggggcttttttgttgtttactaacattaaattttcataggaccaggtttacaaagctttatatttgcccaaggatttttttttttttgtaattgtcgcagaaaatgtaattgtgggtatgtgtgcgggcgtgtgtgtgtgtgtgtgtgtgaatcgggggggtgtgttttgttttaatttgggggattttttttacaaaaaaaaaacccccgggaaaatgtccgtggaaaggcaaagcttttattttgaattaaatgttttttatgggaatttggtta

SEQ ID NO: 717303 - DNA, 1129 bp, Homo sapiens
  misc_feature (8)..(8): n is a, c, g, or t
  misc_feature (1103)..(1103): n is a, c, g, or t
  misc_feature (1110)..(1110): n is a, c, g, or t
agcggagnagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagcatggtggcacatgatgagactggaggtctcctacctattaaaaggaccatacgagtcctagatgtcaataaccagtccttcagagaacaagaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggcctaccatgaccccatgttaaagttgtccatcatgtcagaagaggaactcacacatatatttggtgatctggactcttacatacctctgcatgaagatttgttgacaagaataggagaagcaaccaagcctgatggaacagtggagcagattggtcacattctcgtgagctggttaccgcgcttgaatgcctacagaggttactgtagtaaccagctggcagccaaagctcttcttgatcaaaagaaacaggatccaagagtccaagacttcctccagcgatgtctcgagtctcccttcagtcgaaaactagatctttggagtttcctagatatccctcgaagtcgcctagtcaaataccctttactgttaaaagaaattcttaaacacactccaaaagagcaccctgatgttcagcttctggaggatgctatattgataatacagggagtcctctctgatatcaacttgaagaaaggtgaatccgagtgccagtatcacatcaacangcagaanaataacaatcccaagagcc

SEQ ID NO: 717304 - DNA, 1520 bp, Homo sapiens
  misc_feature (988)..(988): n is a, c, g, or t
gcggtggcggctgcagtccgctgagaggcgctttctgcctggcagaggctggcgggcatcgtgcccgtccctgccggtctcccgggcacccggccaccgccccaccccctcctccgtgccatggagcccgagctggcggctcagaagcagcctcgaccgcggaggcgaagccgccgggcctctgggctcagcacggagggagcgacggggccttcggccgacacctccgggtcggagctggacgggagatgttcccttcggagaggcagctccttcacattcttaacacctggccccaactgggacttcactttgaaaagaaaacgcagagagaaagatgatgatgttgtaagccttagcagccttgatctgaaggagccaagcaataaaagagttcgacctctggctcgtgtcacgtccttggcaaatttaatctctcctgtaagaaatggagctgtcagacgttttggtcaaacaatacagtcatttacccttcgtggtgaccacagatccccagcctctgcccagaagttttctagcaggtcaacagtcccaacacccgccaagagaaggagcagtgcactgtggtcagagatgctggacatcaccatgaaggagtctctcaccaccagggagatcagacggcaggaggcaatatatgaaatgtcccgaggtgaacaggatttaattgaggatctcaaacttgcaagaaaggtcagtaaataactttttatcagatgccctagtttttaaaaattacatttcacaaaatctaaaggatagttttcttaacctttagaagtagaagaatagaaaatatctactggtgaatacattttttttaggtgaggtctagacacatcctcaaatacaagtattagtaagagagtttatttggggattaatacatactaatttattttatgtgtagcaaacagaatccacgctagcttttatgtaattaattctctttgattccaagtatagntccctcatgttttcctcacatgatctctctgtgacacatttctcccctctgacaggcctaccatgaccccatgttaaagttgtccatcatgtcagaagaggaactcacacatatatttggtgatctggactcttacatacctctgcatgaaggttagatgtgccacttaattgtcattaaatctaaagagccagcggtgcatgtaattttcagtctaaacttctaatgtagtgctgacctattttttaaataaacctgttaatggtgtttatgcttttttatcacttcagatttgttgacaagaataggagaagcaaccaagcctgatggaacagtggagcagattggtcacattctcgtgagctgggtatgtagtgagttgttgaccccagatacagtttcttacagatgtgccatgttgcagtttctgatgaatatgagacagatttgatcccacaactctgttctacaaacacataaggcgttaaaactgaacaaatttacagtgacataagaagttacagtctgttta

SEQ ID NO: 717305 - DNA, 1695 bp, Homo sapiens
  misc_feature (85)..(85): n is a, c, g, or t
  misc_feature (1177)..(1177): n is a, c, g, or t
  misc_feature (1441)..(1441): n is a, c, g, or t
gatccaggggaccgggtggaggaggtggacgctctcgcgaggtgggagaagagtggagcgagtcagtcgatcagacgatggtggnactagggcctagctggcatcatgtgtcagggacgctcttcactgcgtccacatgacgcgtggcgtcgtactgacccaggggaatcgaaggctagggcttgggcgcacgcggactggtgcattcctcattacctctagggaggccgggacgcactggctgttgactgtgagcggttccatcggcaggcacctcgggctaggtcaccaacaggacttacgaaaggcatcctcacttcggtgcgcggaggcaactcgctgtcatggcgcttgtacggaaacgcatggatacgtgtggccaaattcatacaatagcatgtcgcgcgccatgtcacacggtacgctcgctccttcagttcggcatcgtccggttggaccgcgctggacatactatgcacatggttcccacctcgacatccgtcgcgtagtccattccagtaacacatgggaaggtgatcgcgaaaccaatccatgagtcacaccccgcctgcacaaggcaaggcgtatagggaaacgctaggaagacgttattccaacccctccacggccggtaaacttggttctatagccacatgttcgcatatgccgtgcgcagaatcggaatcttacttgtgttgcccacttgcgccccttgtccgtgcgcgcggtacttttccatgcgaatctgcaagctctctaaccgagccgtcatggccccaggagcagtagggaagcctgggcgtgtcattccgagctgagcgctgccctgtagcgtgcgctctgagtgacacaggggcctgacgtgggtcacagacgcacgcacaagtggctggtgcctatttaccgattcggagaacgcgtcacattcaccctttgttaatcgggactgcaaagggaatcggggccagaaaggggcagggaatcttttcggggggcttaaacccagtgcggggccatcgaaggcgggtcacttacattctggctcagagcgcattaccgagaacccctaggggtaatcgccgtaggggaacccttatggcgcttcccactttctgggaaacccttttggcgaaacctgtcccccatggggcgccccaaaggcgtaggtatggcctgngagaggttaggggggctggggcgtatactcagagctcatggaatctttgacccgtgggcacctgggcggctttgactgtggtcccgggagctgtgtttgcctacggccccttgggctttgtggaagtacccgcgaggggcgcactcggaagaccggttcaaccgcagtaaagaggcaggggcctcaccggaggaggactatccccagacaatataccctttctatgcccgatggcactcccgcaggccaaagacgagggcgggnaatttaagggggaagcccgggggacgcgagcacgccaccagagcgcggcagcggggccccccacgccggccaggggccgcattccgccgaccgcacctccagcgacggcaagcgcacagggcgggagctcacgcagcccgaaaaaacggcaggcaacgcgccgagaccaccgcgcacacgagcgaccaccacagcccgccataggcacaccacaccacagcaccaacgcaccaccaccaccacccacacaggca

SEQ ID NO: 717306 - DNA, 135 bp, Homo sapiens
  misc_feature (39)..(39): n is a, c, g, or t
gagcggcctcccagagtgctgggttgggattacggcgtngccgcgtcgctaggacccagtttggctgctggttccagcaggggactcggggatatcgtgtgcacaatgagttgtctcaaattttgcgtgtctgca

SEQ ID NO: 717307 - DNA, 546 bp, Homo sapiens
  misc_feature (104)..(104): n is a, c, g, or t
acaaagtgtcaaccagtgttttcctatgggaatacagagcaaaacaaagatgagaatacttcacagtccacatttagtctttagtatagacaaacccatctgangaaggaatctgaacagccagcaaaagccactatatgcctttggagctcaaactagtactacagctgatccaggtgccgcaaagccagtttatagtttcttgaacaacagttcctctagttcacgtacaccagccactatctgctggtggtggcatatattggtagttccacctcttcctccaatccaactgtggctaccttagtgtaaggacagtccagcaatcctagtgagcagctctagcctttggtaacaactgttgaatccagcacctactcagtctttgctattttctcaagatagcaaactagcaaccacatccagcacaggtacagctgtcaccccatttgtctttggtccaggagccagcagtaataataataaccaactactggtatcggctttggagccacaaacacattagctctgcggatcctccttgta

SEQ ID NO: 717308 - DNA, 345 bp, Homo sapiens
attagggtgtgcaggaaatctgcaaattaccttcaagagtctctcaacagcgctaggcacagtctctcatgcctgtaatcccagcactttgggagccaaggcaggtggatctcttgagccgaggagttcgagaccaccttgggcaacacggcaacacaccgtctccacaaaaaacacaaaaattagccgggagtggtgcccatgcctctagtcccagctactcaggaggctgaggcaggaggattgcttgagcctgcgaggtcgagactgcagttgcagtgagccgtaatcacaccactggactccagcctggatgacagagcaagaccctgtctcaaaaaaaaa

SEQ ID NO: 717309 - DNA, 222 bp, Homo sapiens
cccccccccccaaaaccttcttaggaactctcttttgtcacacagcgaaacctggaagtctaacagaggatgtcattattcaacagatgttggcttagtttaatctctctaaagagttgtttaatagagaaaatgtacacagactgatttggagaaacaattctctgaaaatactgtaaataggttgggggatttgttaaatgtgaaataggatggtgtttt

SEQ ID NO: 717310 - DNA, 93 bp, Homo sapiens
gaaagacaaaaggaaatagaagaaagggaaaaaaggcgtaaagacagacatgaagcaagtgggtttgcaaggagaccagatccagattctgat

SEQ ID NO: 717311 - DNA, 1174 bp, Homo sapiens
  misc_feature (1155)..(1155): n is a, c, g, or t
  misc_feature (1166)..(1166): n is a, c, g, or t
ctcagcatcagaagaagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggttgctcggataaaactttgtatgtattttgtatggcatagatctatattgtatgatgtcctatgccaaaagaaaaattatacgaaattgtaaattttattgttttaacgtgtatgcatgtttagtgacgtttacattttgaaataaatntgatcctttanaaaaaaaa

SEQ ID NO: 717312 - DNA, 424 bp, Homo sapiens
gccatcccgctgccagctgcgttgtcagtgtggcattgctgcctgggattaaccttctggcggtagtcaggcacgtgctgcagcgggacctgcggtccgtacgtgcgctcggtcccatggtgccggcaccccctaccaggtggagctcccatcagcagcttcactggcggacgccaagatcatggcttgcagcatctctgtgtcaaactggttgttgggccaggtgccggtgtcatcgccattttgggagccgctggtgccgggtctctgggcctgagagaaacgccagtccgtgttgggcggggcttgctgaagtaggttggaatctcctttcatttcaagtaaatcctgagttatcagaagaggctcgcttttctcacagctctcctggctgatgagcgtgtccgcatagttcggctgaggc

SEQ ID NO: 717313 - DNA, 168 bp, Homo sapiens
tttgggcacagaaattaaagctcctgattatgtattctttcagtgttttcagtgtatctatagtagaatctgtaatctcatttgtgacagtgttcacagtttaaatttgaggcccaaggttaatgggttctctcccacaccctgtggctttggtgtgtggttgttggg

SEQ ID NO: 717314 - DNA, 599 bp, Homo sapiens
  misc_feature (115)..(115): n is a, c, g, or t
  misc_feature (144)..(144): n is a, c, g, or t
  misc_feature (247)..(247): n is a, c, g, or t
  misc_feature (599)..(599): n is a, c, g, or t
agagaagatagaaaactaaacaaaatcagaaaaatgatgcatgaacaaattgagagtatcattaaatagattttttaaaaacctagtaaacagaacaaacaaattctggaactgncaaataaaataactgaattgaaaaattcnctagaacagatgaaagtagacttgatcaagcagaagaaggaatcaatgacttcaaagacattgaaatttcaaaggtcacatgaaattatcaagagaataacancaacaaaagaacaaagaaaagtgttgaaagcctaaggaacttataagacaccatcaagcagagcaatatatacattataaaagtttcagaagaagagagagactggggcagagagcttatctgaagaaataattcccaaatctgagaacgaaacttgttgtccaaattcaaaaagctcaaggaactatacatgttgatgaatgtacaaaaggcccacactaagacacattataaagtcaaaagacaaagacaaaaagagagtcttaaaagcagcaagagaaacagtaactcatcacatacaggggaacttccataagattataaagtggatctctcagcaggaacacctgcn

SEQ ID NO: 717315 - DNA, 1068 bp, Homo sapiens
  misc_feature (1049)..(1049): n is a, c, g, or t
  misc_feature (1060)..(1060): n is a, c, g, or t
ccattttcttcaaacatgcaaatgttttcccagactgcgtctattatcatgtcttccattttatagtggtatataggccatgcttgccagtaatagataggaggttgaggaacccataggactcatagaaataaatagtgaaaactacaaacccttattttgggacttcagttctcgtggtccataggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggttgctcggataaaactttgtatgtattttgtatggcatagatctatattgtatgatgtcctatgccaaaagaaaaattatacgaaattgtaaattttattgttttaacgtgtatgcatgtttagtgacgtttacattttgaaataaatntgatcctttanaaaaaaaa

SEQ ID NO: 717316 - DNA, 203 bp, Homo sapiens
aagaaagtgagcgcatgagtagcatagcatttagccaaaagggccccagatactaaataaagcaaactaagaagcacaatacaaaagcattgtggctaaagtactaacgcacctactctatggtacagataacaaaagacctccctgattggatctatatatgaaataaaaccagtagcaagttgatccagagctctgtagcc

SEQ ID NO: 717317 - DNA, 129 bp, Homo sapiens
tagaggacccctcagctgccccaagcttgtgtagagcttaaccaacgataacggcggcgacgcgcgaacacctcgcgagctcgcagtgcgcgggtgccacggccctgggccttggacgactggcaccaa

SEQ ID NO: 717318 - DNA, 124 bp, Homo sapiens
  misc_feature (9)..(9): n is a, c, g, or t
  misc_feature (100)..(100): n is a, c, g, or t
  misc_feature (104)..(104): n is a, c, g, or t
  misc_feature (106)..(109): n is a, c, g, or t
  misc_feature (111)..(111): n is a, c, g, or t
tcagctaantcgattgctaagacaaaatcaagatagttacctggcagatgattcagacaggagtcacagaaataatgaaatggcacttctagaatcaaanaatntnnnnangtccccaaaaaaa

SEQ ID NO: 717319 - DNA, 344 bp, Homo sapiens
cataccgagtggtcctgtggggcatggtttacaacctgctgtgtgagtacaacatggagctcatgtggaatcattgccttcccacagtttagcccaacttaatttctttattatttagtgaccttaaagactgtcagcaacctttatttctagcccatcattctactgaaatctaattcctcctttaataaattctttcttcctgtttcctcctctgaaagattttccttctatctaatgtaaatctcctcctagaatttaataaccactcccttgatcaatattgcaatgagaatcaatttgacctgttgtttaattttgtggctgtgtggttttcctttgct

SEQ ID NO: 717320 - DNA, 277 bp, Homo sapiens
  misc_feature (205)..(205): n is a, c, g, or t
  misc_feature (235)..(235): n is a, c, g, or t
  misc_feature (255)..(255): n is a, c, g, or t
  misc_feature (265)..(265): n is a, c, g, or t
tgactctagttggtcaccagagccggtccatttcacctgccagaggccctctggttcactgtccaggttaactaaggactgtggctacatccatctacccatgcccaccctcagtctgctctgggccagccactgtgtgatacctgagggatgattctaaaaattcacattctctctctgtccaaacggacacttctaacccttncatgggcatcctgttgctcttaatattaangtttgaactgccgtggcttnccctgggcancccattggaaca

SEQ ID NO: 717321 - DNA, 310 bp, Homo sapiens
ctagcagagcacagctcagcagacacagagaggtttgcagtatgtagatcagggataagccaggtggaaagggttggtgccagccctcagtccagtgagctctctgcactcccttgcagcatccggtacagattgggcggatgtgggaaggttggcacagtccagagccaggagcccatgtaacaacttggaaggtgactcaggtgaggctgtcaatgagggaatcccgcatgctggtggcaatggtgctaggctgggcttcattcagcttgaagacactctccaccactgaccactaggtagcagtacc

SEQ ID NO: 717322 - DNA, 850 bp, Homo sapiens
  misc_feature (548)..(548): n is a, c, g, or t
tgggctctaaagggggtaaagggggtgctatagggtaaatacgggccctatttcaaaaattttataggggaattaattctaggacagatgggcttgaaactggtgggtttggctcccacagatatttccagagctattggcaccgtaagttatcacccccgggtcgttgtacgcggtgaaatgtggtgtttggtgtttaacactgctccgggcatattgcgctatctggttttaaaacgcctatatgggggggcacagctctatggatgtggcaagaagcgttcttggtgtgatgtgtatacattatattataaataccgaaatgtgggggccttctcacatctcgggagagtataacatactctcgaatgtgtgctcacacgcgtcttcaagggagtctcgcacaggtctcgcccgtgggtctcataggaaatataatgtggggggaacagttagtgttagggcagtgtttgagacaaactatcttatgttcccccgccgcgtaatgatcagccggtgtgtcaacctccgctaagtgttcacctgtnacccctactgtgggtgtgggtgccccacattgtgtgtattttgtagtatgcgtgtccaaagcgcgcggaggtgggactccccgttttgcgcacctcctcccggtctctgttgtgtctaatgttgttcgaccaagggaggatggcgcggtacacgagaggattggggggaaatggggcgccagaatagggaggggcccttcacgggcatgggcatggcggcggggggcccacagggtatttatggttcccaaggaacggggtgttcactaaatttacacccttgagagagccggttcttggga

SEQ ID NO: 717323 - DNA, 198 bp, Homo sapiens
tgtacgaaccgagctcggtacccccttctacgtctcatcactgaagtgccaatccatgtgggagatttctctcgcaaaggttttcagagccttgaggccaacctacaccttgccactccattcaaaccttcagcttccaacccatcacatcatgacagccttcttccttgtgtggcaacagtgatgagacgtagaagg

SEQ ID NO: 717324 - DNA, 370 bp, Homo sapiens
aagaagtatagtcggagaggcgggctctacaggaagcagcaggcacgtgccaggtggaagccagctgcaggcgggggaggaaggaggccctatactacttacctatcttgtccatagggaccatctcactgcagcctgcagacttatgcgtagctccatccagcaagcggtacgtactccttggatgaggccctcagcactgcttccgcatggcacagaaactggttaacagctatactctagtatttaagcttacgtgctggccagacttacgtcctttagacttctgcaggtcagccttcaggctacctgttctcttcctccaacttacacctaagcattcccgacatccaacttgctaccggtcgaa

SEQ ID NO: 717325 - DNA, 157 bp, Homo sapiens
  misc_feature (43)..(44): n is a, c, g, or t
  misc_feature (52)..(52): n is a, c, g, or t
  misc_feature (54)..(54): n is a, c, g, or t
ccattgggttttgggtagattatttccttttaaaatgaactannttttaaanantgtttaaattaaggggtgcccactttaaaattttatttttatttaccacccatgaaataagctggatttaaaaagaacccaaattattttctagttaaaaaaa

SEQ ID NO: 717326 - DNA, 626 bp, Homo sapiens
tcgtgcgccatctgcagggtccaggtgatgcatgcctgtcttagatgtcaagctgaaacaaacaagaggactgtgtcgtggtctggggagaatgtaatcattccttccacaactgatgcatgtccctgtgggtgaaacaggacaatggctgccctctctgccagcaggactgggtggtccaaagaatcggcaaatgagagtggttagaaggcttcttagcgcagttgttcagagccctggtggatcttgtaatccagtgcccggcaaaggctagaacaatacaggggatccattcttcagatagcagccgatggttctgtggtcctttggcgactcatgaaagccttggtttagcgccccgtcagttttatcttcagaaattgtctgcgattaacaccatcatttattcaaggtggtccttcgcccctctgtggggtcgtgtagcgcacacagcttagaagtgctataccaaaggaaagcagttgccagttggtccacccttataatttacccattttttgcctccgccagcgcaagcggtttcatagaactttttgcatgtttatggttgttcagttaagttagaatgtcccagtaacaaataaagtgcagtttaaaacccaaaa

SEQ ID NO: 717327 - DNA, 350 bp, Homo sapiens
  misc_feature (336)..(336): n is a, c, g, or t
  misc_feature (340)..(340): n is a, c, g, or t
caaaggccctcgagatcatgaacctcccccaattgctccctgtagataatattattattgtaaaacctaacatgggtgtttgaggtatttttcagaccctgccttctgatggatcagctggcaccacccagacccagtaaactggctcatctggtcttctggcccccacccaggaaccaactcagtgcaagaggatagcttcaactccttatgatttcatccccgacccaaccaatcagcattcccgcttcccgagccccctgcccgccaaactacctttaaaaaaccctagcctccaaattttcagggaggctgatttgagtaataataaaaccnacanactcctgttt

SEQ ID NO: 717328 - DNA, 248 bp, Homo sapiens
atcggtcactggtctacattatatgtcttggcatgactccaggctgctctagtttgtggctccagcacagtatgagttaagtgagttcggttagagtgtggggacaaggacacagggaggaggggtccctataggcttgggtgcccattacatatgactcaaattacgtcaattgcgctgcttaggtgttgccctagccggatctagacgcagaggtcttagtatttagtctcgtgcccagctcgcaa

SEQ ID NO: 717329 - DNA, 214 bp, Homo sapiens
  misc_feature (40)..(40): n is a, c, g, or t
  misc_feature (143)..(143): n is a, c, g, or t
tccggagtttcgcaaacacaacatcggacgcatgcttctnggccgctcccgggaagtgcttgaacaatggtcgcgcgatcacccggacgaggccgtcatgggggttgctggagtaatccagaatcctgcgctggtcgcaaagnagcggcctccgacctcgccggtgggcgcctttacgctggtgggatacacgcaagagggcgaacagatccgc

SEQ ID NO: 717330 - DNA, 298 bp, Homo sapiens
gaggagtggctggatgacaaatcgtcagaaaaggtcacgcgagaaggaagccaggtttatgcccacgattctccagatgtgtctccagaaaactggctgaagacctatggcttgctcgccacgaaactcaccctcatggacgccttgtcactggcagcagtcccgcacagctccacctatgttcccgtcctggacaagcatgtcatgtctacgctctttgatgaggcaaactgattgtctatacgtccctacttgaggccattttcattttctgctcaaatacaaagtagtccaattt

SEQ ID NO: 717331 - DNA, 558 bp, Homo sapiens
  misc_feature (316)..(316): n is a, c, g, or t
  misc_feature (331)..(331): n is a, c, g, or t
  misc_feature (367)..(367): n is a, c, g, or t
  misc_feature (394)..(394): n is a, c, g, or t
  misc_feature (425)..(425): n is a, c, g, or t
  misc_feature (428)..(428): n is a, c, g, or t
  misc_feature (439)..(439): n is a, c, g, or t
  misc_feature (501)..(501): n is a, c, g, or t
  misc_feature (503)..(503): n is a, c, g, or t
ctcagtatactctaggttaggcagcctccatcagcagtggactgggaagtggatactactgtgtgccactgacccatgaacattttcttcagttgcctccagtttgggattggtcatcaagtactggatggactctcttcactttaacagaatcaaagctcacggtggtatttgcttgatcaaacattggtcaaaatgtccctctttacctgttttttttttaattaggtaaaagcctaatgcagtttatatttctaaatctcttctgtctatatgtggatttctaccaaatctgcaaccatcaaacagtaagacntttaccagatgtccnattagcagtgtttagatgtggcatttaagtcagaanaaagatatgatataattcctgaccatnaaaattgattgtctattttgaggggtggtgntgnagatttacgcnaatattaacacacatttatctaatgcctacaatctgcacactgatcacacagcccttgaganantacaatattcaaacaggcatacaagtacttaatgtttgtactactgaggtgtaag

SEQ ID NO: 717332 - DNA, 301 bp, Homo sapiens
atatagccaaaatgtcaaacaaaactatatatggggccgggcgtggtggctcacgcctgtaatcccagtaccttgggaggccaaggcgggcagatcacctgaggtcaggagttggagaccggcctggccaacacggcgaaaccctgtctctactaaaaatacaaaaaaatttgcagggtgtggtggtgcatgcctgtaatcccagccactcaggaggctgaaaccggagaatcgcttgaacctatgaggcggacgttgcagtgggccgagatcaggccagtgcactccatcctgagtaaca

SEQ ID NO: 717333 - DNA, 274 bp, Homo sapiens
tctggcacacgtgtcgccagccaacaggatgtggacgcctggcgccggctgcgagcgcttcccggcgcaagcactgccgaacctggcgattgaagccaatgccaaccaagccgctggaagcgctgtcgaatatcctcggtgactttcccggccgcgtgctgtttaccgccgagtccgccgggcgccgcgaggtgctgctggagttgctggaacgcctgaagctacgggcgaaaaccgtcgagagctggccggactttgtcgcgagcaaggatcg

SEQ ID NO: 717334 - DNA, 418 bp, Homo sapiens
  misc_feature (299)..(299): n is a, c, g, or t
  misc_feature (308)..(308): n is a, c, g, or t
  misc_feature (310)..(310): n is a, c, g, or t
  misc_feature (313)..(313): n is a, c, g, or t
  misc_feature (315)..(315): n is a, c, g, or t
  misc_feature (320)..(320): n is a, c, g, or t
  misc_feature (328)..(328): n is a, c, g, or t
  misc_feature (335)..(335): n is a, c, g, or t
  misc_feature (338)..(338): n is a, c, g, or t
  misc_feature (347)..(347): n is a, c, g, or t
aaaggatggaagccaatcctgataattttggcttattatccaaaatcctttattttttattgcagagacccagcagatgtaactctcattggagccatcccaaagaaaacccttctttgccctttgcagggccccttatttagggaactgaagtggatttccaggaccatttgattttgaactaagatttgatatagagttggaattgcttacataactctttgaaaatggatcatccctgggttctcaggtgaaggaggccattccaaagtaaaaaagaatattcgaataccataaanaccctctgntntcncnccaangctgtttnttagctnacntgcttgacnacccactgatggaacttctttattaatgtgaaatatttatattttgaaataaaattactagtggtgaatga

SEQ ID NO: 717335 - DNA, 344 bp, Homo sapiens
ttttataaaaaaaggaaaaaaaccctttaaaactaaaaaatatttttgggtgttttccccacccaactggcttttaaataaatttgcccccctattggttgaataagcccaaacccatttaactgagtgggaagtgaataaaaaaaggctttagggatcgattccctatttttccaaccccaatatgttaatgctaaggaaagtaacccaaaaggaggttcccctccttgtaatttaaaattgttattaaaaccttaatggatcccattctttaccctttggggttaaaataaaattacttggccatgcttgcccttttaaataaccctttttttattgtttta

SEQ ID NO: 717336 - DNA, 118 bp, Homo sapiens
actgtcagttcagtgttttagctgacgcggttatgcggaaaagactgttttcactgttacttatactaccattagttcttctatagggtgatagattggaccacatttgggtgtgagg

SEQ ID NO: 717337 - DNA, 258 bp, Homo sapiens
tgagacagtgtcgctctcattctgtcacccattctgtaatacagtggcatgatcatagctcactgcagccagaactcctgagctcaagcaatcctcctgcctcagtctccagaatagctgggaccacaggtgttccccacacccagctttttttgagacggagtctcgcgctgtcacccaggctggagtacagtggcacgatctcggctcactgcaacctccacctcctgggttcaggcaattctcatgccgtcgacg

SEQ ID NO: 717338 - DNA, 475 bp, Homo sapiens
agggatgggtgcatgatcccaagatggccagtataaataagatccaggaatttattttaactcttacttaaaagacaattggctggatttgctgagggaagatttaaacatctttgtggacatgtttgccaccacatggggagagcattcctgaacatgcagcaatagagaacaaagacgagagataaagagatgataagagaaggaccaagttctagcaacagtgcgtgaggcctgaatccagccatgccggaagcatgtgaagcagtaacttcgttcttattaagacaactgcagctggattttctgtcatttgcagtttcaaatgttgactaacacagatatgaagtatcttttcacagtaatatatttctctctatcataatattcttattttctactagtataaaactaatgaatgctcaatgcagaaaatccagaaaacaaacaaacaaaaataaataaagcaaaattc

SEQ ID NO: 717339 - DNA, 555 bp, Homo sapiens
  misc_feature (3)..(3): n is a, c, g, or t
  misc_feature (5)..(5): n is a, c, g, or t
  misc_feature (32)..(32): n is a, c, g, or t
  misc_feature (36)..(36): n is a, c, g, or t
  misc_feature (158)..(158): n is a, c, g, or t
acnancaattaatcatcggtcatcttttcccnatcnccctttaaaagacctttagtttcttccttataagagcccaacatgcggaaccttgtttctacttaaaaccccaaaatttagctcggcgtggtgacttgagcctataatcccagctacttggnagactgaggcaggagaatggcttgaacccacgaggcggaggttacagtgagccaagaatgcgccactgcactccagcctgggcgacaaagactctgtctcaaaaaaaaaaaggaacttaactggccaggtgtggtggctccacttttggaggtctaggtgggcagatcgcttgagttcagtagtttgagaccagcctgggcgacatagcaagatgctgtctctataaaaaacacaaaaacaattatccaggaatggtggtgcacacctttagtcccagctactcggggctgaggcaggaggattgcttgagcccaggggccagaagttgtggtgagccaagattgcgccactgaactccatcctgggttggtggcagagcaagatgctgtctcattt

SEQ ID NO: 717340 - DNA, 204 bp, Homo sapiens
taaaaagttccttagagtcactataatctatccagaaataatttctatttctggaattttaaaaatctccaattctgaaaatttagatgagtaaatggttttctgggaaaataagatttatcaaaaggaatccccgggagacagaaaatccaggtagataaaataacaaatagcagcctgaggatcacttgagcccgggagcca

SEQ ID NO: 717341 - DNA, 602 bp, Homo sapiens
  misc_feature (600)..(600): n is a, c, g, or t
actcctgcggataatcacaaacctcatcttgagttgacctgacctccttctacactaaccattaataaactcatctctgaaatgaggctacccataatcagaccacagaatagcagtatgaaatataaaactttagatataaagacaaaaggtacaaagttttaaatattgagcccaccaaaatccataatccatgtaacccaggacaatccactaaacctaagtttctcataaacttaaacctcattttgctcatctgtaaagtggtgatgaatatcttcctgcagggttatagaaaaacgtaaatgagctaatacatgtaaagtatacagtgtctggctttacccaaatatcaattaaatagtaagttcagagttacagtctttcttgtagtttgaaaattcttaaaatttccgtaaggtgatttttgaataccctaacatcaattctaagttttccttcattaaaaaagaaaaattggcaaggctaaggcaggaggattgctttagcatcaggagttcaaaacctcaactctacaaaaattttatttaaaaattagccaggcactggtggcatatgcctgtgatcccagctacttgnaa

SEQ ID NO: 717342 - DNA, 288 bp, Homo sapiens
  misc_feature (18)..(18): n is a, c, g, or t
  misc_feature (51)..(52): n is a, c, g, or t
  misc_feature (54)..(54): n is a, c, g, or t
  misc_feature (59)..(60): n is a, c, g, or t
  misc_feature (72)..(73): n is a, c, g, or t
  misc_feature (92)..(92): n is a, c, g, or t
  misc_feature (125)..(126): n is a, c, g, or t
  misc_feature (175)..(175): n is a, c, g, or t
  misc_feature (205)..(205): n is a, c, g, or t
  misc_feature (211)..(211): n is a, c, g, or t
  misc_feature (287)..(287): n is a, c, g, or t
gatatatatatatctctnatttcttttttaaaattcattattttatatatnncnccctnncagtgtaaggtnntttaaagacataaactggnatgtattacaaagcaaaagaataaaaaatactnnaattataattcattgccttaaaatattcttgtttaatcacttggataangatgtaattgtgtaatttattacataaatnttttcngagatttcgagattccttgccctttcattttaccttttttatgtttatatgagaaatagcttagttataaacctcnc

SEQ ID NO: 717343 - DNA, 299 bp, Homo sapiens
  misc_feature (248)..(248): n is a, c, g, or t
  misc_feature (280)..(280): n is a, c, g, or t
aataaagtcatcactgcccccgctgtcagcctctaccctgctggcttctctttctcaaggatgtggcagtcagacctcctcctccctgtcccagtctccacagccacctcttcaacttcctgagctgaagtcctgacttgctgtcaggcatcacaccacccccacctcctgtagcccctgtctttgcccaccaggttctctacctgtgctcagcaccccacagggactttattcctgcagagacactntcctctgggctcagctgtttctttcttggcancagatcatccatcagtata

SEQ ID NO: 717344 - DNA, 519 bp, Homo sapiens
ctgccaaaaaaaaaaacagtaggaaacagaacaccaacaagatacagcatccctcagcagaggcccacactagcctcggtctccggcctttcctgggggaatggtgctgccagaatccacctggatgggggagtagctgggtttggagggcagaacaatagacgctggtcctctaagtggcttaggggatctagcatcccaggctcaggactcactaaatcagaaggaggtgtgctcagattcttagttttcatactggcatttatcttaaagggtcctggagacctcataaaggcaatggtggtctatcttaaccgagaggttggatggggatctggttatcacctccacttaaaggaagagcaaatagatttttagggcaggtttttcatggaaaatggtacctcggcctccggttcccaactctcctggcatcccacaaaaagagcacacagaagggcatttttccttggaattggtggacctggtcttccaattctgccttacagcaagggttca

SEQ ID NO: 717345 - DNA, 587 bp, Homo sapiens
  misc_feature (526)..(526): n is a, c, g, or t
ctagaggatccctggccaggcctctaccttggccaggctcttcgtctctcggtctttattggatccaccggccaccgttcttgaacttgtcacctcaaggcatatgactccggagtcatcagggccagtactaaatggtcttctaattgggtactccaaaacttctaactactggtgggatatcttcgccggaatatcctacccctcaaattatcaggtaccaatctaaattaaattcaatatctaaataatggactggaaattccgtaaacaattttggacaaatacaaaagttatggccatcacagcaagaaaagcttggctcttcctccggattcatacatcaaacatttacggagtctctacaaggggggagtgatgaagtcacaaagctgaaaaagataatcccggctctcacgaagctcagtttcaaggacaagggtgtaatcagaatacacagggctgggatatgagacctggcaagataacgtgagagcacataggaaggatacctaacccagacggngagcagggagggggtcagggtgcccgggaagacttctgggaagaagtgacacttaccttga

SEQ ID NO: 717346 - DNA, 1456 bp, Homo sapiens
  misc_feature (134)..(134): n is a, c, g, or t
  misc_feature (256)..(256): n is a, c, g, or t
  misc_feature (347)..(347): n is a, c, g, or t
gcgaatacgttcctattgtactccctggaatatgactcacttccccatacgtcaatcggacagcatcatgtaactacgtcaactgggagcataggcatcgaatgagcatgaattcgtacattacgtcgacatcntgcgacttgacgcgcatatgacaacctatcgggacctccatgaagctactcattcttcactgagtgagtagcatatacaaccaagtaggctctttcataaggtcccattatcacccctgctntttatcgaggaattcaccccattaatgtacatcgccagtaaagagcacacgtttgttccgcaaggcacacgcgcatcgcatggggctcaangctagatacgattgcacggagatgagtccttggagaacgtatggactggactatggagtatcttactgctctcattcatcgctgcatcaaaccccctgtacttaaagccacgattaggcgctaagccctccttgcactgtgtgtgaccttaattcccttagtgtacgagtcagtgagactcttatttgatcgatcgttcttcccactccttgtctcgtgacggcattgatgatctaggatctcatactaatgcagttccactttgccatttgatcctttcaggggcaaggcccgcattaagccccttcgtcaggtgcaatgtcccatatgtactgttattcccagaaattcactccccttgtgggagaggtatttcctccagaggtcggcccacgtgttagttccctcaacataggggtatggattcccaaggttaaagtaaaaacggtttcccttcaagttttacttactcttggtggaacctttatgttccccattaattttcccaaagttatattgtcacaactgctctttctaccatcaagggaaaagtcctttaagtgggaattcccggcgttccgaacaaggaggattcctatccaataagtttcctaaggtaccccgctgggttatttaaagccatatatactggatgtggagcgtaaacataaggacacattgggccttctcgacttgagggtccattctgggaatttatatcccccactctagattatttcccgtggcgctaagcggagggggagaaaacctttctctccttggttggatgaaagatgaaaacgcgacggtcacatcccttggtctccacactttttttgtttccttcctaactttgaccggcgatcgtccaacaggttaccataggttccacataggtcctagtataaaatttcccccgcatagtattttttttacgccgcagaaacgcgcatgggggggcgaccacaattctcccccttggcgaaactataaaccacgactgtatgaagccctctcatttttaacgcgagaaagaaagtccccgtattgtgtgtgctctcgacagtattagccagcgagatattatcgtgatcgttataaccgcagaa

SEQ ID NO: 717347 - DNA, 311 bp, Homo sapiens
ggaaaaatcaatcagttaagtgctaccagaaagtgtaccaatttttataaaaattaagaatgatataaatttcacaatctaaaattttaattttgtgcattatttcattaatgcatgtgtatttgagtaattgtaagataaatgaatttttaattttgtgagatgtagcttaaactgtcttcttaatcaaccacttacaattccgttgttgctgcatcctttatttaaggcttgtttaaagcgttttgccacactctggaaatctcttatagtgtgaagtgctctggggcatggcctctatacagggaaaa

SEQ ID NO: 717348 - DNA, 150 bp, Homo sapiens
tgctggttaaacaaaccgtctgcagctggatttagcttgcaagctgccaagtcctagttttagaagtttcaatagcacatatagttagacaccacaggtgctattgaaacttctaaaactgctattgaaacttctaaaactagggggtac

SEQ ID NO: 717349 - DNA, 763 bp, Homo sapiens
cagaggctgcaatctcggcactttgggaggccaaggcaggtggctgggaggtggaggttgtagtgagccgagatcacgccactgcactccatgctgggcaccattgagcactgagtgaacgagactccgtctgcaatcccggcacctcgggaggccgaggcagtcaggcgtggcggcgctcgcctgcaattgcaggcactcggcaggctgaggcaggagaatcaggcagggaggttgcagtgagccgagatggcagcagtacagtccagcttcggctcggcatcagagggagaccgtggaaagagggagaccgtggggagagggagagggagagggacgaatcatttttattcacaatccaatctggcagctaacagaaaagcaggtctttgggatgtagaaaaccttggtttcttgaagagcccagcttgtaagaccgtggttgtcattaggctttcaacactattcatggaaaccacagaacaactctgtaatagaatcggatatacctgcctcctagggagaccaaacgcaactgaacaaccttttataaaggaggatcaaaattaaacgagcaaacaacgggagaaaaagaaaaacgacaaaataggggagagaaaagaaaagaaaaaagtttaaaaaagaaaaataagaagggagaggagaatagcaaagaagaaaggacaaaaagagatataaagaaatataaaagagaagaaaaggggcaaaaaaaaagaagagagaagaagaaaaaaataggaac

SEQ ID NO: 717350 - DNA, 326 bp, Homo sapiens
cccctttaacatctcatttctcttccttaggacttacaacaaaatcaaacagctaggcaccaggtgcagtggctcacacctgtaatcccagcactttgggaggcccaggcgggtggatcacctgagcccaggagttcgagaccagcctgggcaacatggtgaaaccacatatctacacaaatcacaaaagttagccagatgtgatagtgtatgcctgtagtcccaggctgaggtgggaggatttcttgagcccaggaggtagaggttgcagtgagccaagatcatgccattgcactccagcctgggcaagagtgagactccgtctc

SEQ ID NO: 717351 - DNA, 484 bp, Homo sapiens
  misc_feature (400)..(400): n is a, c, g, or t
cccaaggtctatgaaattgcctcaaagagtaacaacttcatcttcagtaagaccctcccaatccccttccgtcggtaaccttaactacatctgcctgtgagtccccagatttccagggccctgtagcttttctcagtataaaggcttcttccatggctggggtgagcagcctgagacatctgcaggggaggctccctagaaagagctgggtctttaataatctcctccctgggtgagagaggactgaaaacttacaggaaattagctctgataacagacccccttttcccacagctgccaccccaggattcccacccactcacaaacatacccataaattgatgtgtccacactcctcccaggactaggcaccaccctcaggtgatctacctgcctcggnctcccaaagtgctgggattacaggtgtgagccactgcgtccagtgtctcagttttttttttttttaaggtagacatatcattta

SEQ ID NO: 717352 - DNA, 935 bp, Homo sapiens
gggttgtctgtggccggaggctgatcaggtgtctctaggaacagatcaggacatttggtaatgatgcgctggaaagtaaagcactagaccagcgctcgaacgaaggcagacgagggttcaagtccctgagcagagcatggtgtatcacgtgattggatgcaaacatgacgaatgaaagattgggaggctggagtgagcatagaagcaattggtcactctggaacggagagacattggacgaaaggagtgattggcagtcgatgcttttaggtggtcttcgttattcaaacacctgaataataaggcttcgtgctagcagcagaagatcagatgcgtaaagattacctttccaaggtatgtcttgtactgaatacgtgtacgtagtcatccatggaagcaatcgcagtccgaagcgttgaggaaaagtgacgtcgccttgggagtgaggtcgagcgagcagcagaagacggctgaacagctgagtcataggaataacccttgggaacgcaggttcctaccagaaggaacattcgaattatgtcaacacgaattgcactacgaaagctcagtctggatggtcatctagggggttgaacattgaacattcgatgtaccatttacgtcggtcgagcgaagaatggtccactcttggaacttccagatcccaatgacgattacaaaggctattggttatagtgttcgaaacggaacgaacttaaaaagaacctgctggaacaaaaggcagtccacgtgcgtggaaacattccaacgaattaaccgcccatgggttctcaccagcattgatttcgcaagtcgacctaatctctttctaaaactggctggggatacaacttcaagagtcaattgtgaagtccaggttagggtggaccatggacacaaattatcgcacaatgggtgaactcatccacggtaac

SEQ ID NO: 717353 - DNA, 163 bp, Homo sapiens
gccgcgtagctattcttgagtatcccacgaacaccctactctttccaacatcagctatcctggagcaagaggtagaggaaggaagcgtggcgcggagagcccagtttgaagaccccagtggaggcaacgatgcttgacggatgttgtggcaagctttagttgg

SEQ ID NO: 717354 - DNA, 317 bp, Homo sapiens
acctgtgagagcgtgcgtgcacctctcgaacccgtcgcattcaaactcaatggctaagcaatgtgtctaacaagactggtgctggtagccaggtttctacttcaatcacctgattggcaaagctatcctgatccacaccaccccaaggctccgtcgtcaaaacactggactctttgagaatatggatacctcgagttcgcagttagtcaatggcttgctccaagtttgcttgcttatctcccatattacttcctagagcgataaaggcccgttgtttgcgacggcgaatggtcaccgagcaggtatccaatggtaaa

SEQ ID NO: 717355 - DNA, 276 bp, Homo sapiens
caagtatacctgctcttgacacaccggaattcgtctctgacccagacagtttataggccttaacactgtacaagactttagcataatgcagtttttaccaatacccagctccaactccgtctacatctgtctgggctgaaccgccccttctgtccctctctacagcttcctggacacgtccggcacgtgtatgaacagtttatcacagcagtgtatacaagcaggtaccaatactactggaaatacagaataggaagcttaaaatgcagaaattga

SEQ ID NO: 717356 - DNA, 354 bp, Homo sapiens
  misc_feature (119)..(119): n is a, c, g, or t
  misc_feature (308)..(308): n is a, c, g, or t
  misc_feature (323)..(323): n is a, c, g, or t
agggactgttgcctgaagccaaaaaacctaggcttttacatggcaccctaattatgaaagacagtaatttccggctggtatcctcagagcaagccctgaaggagctgggcctggcaganaccaacttcgcttcacctgtcgtgtgcacctgcaggacacacgcaaagaacaagaaacagctttacgtgtgtacagccatctcaagagcaccctcaaggaccactgtgtacagcatctccccgatggctctgtgactgtggagtccattctaatccaggctgccgcccattcgggaggacccttggtancaaaggttgctaatnggtctcctgggactttaccaggattgaaaga

SEQ ID NO: 717357 - DNA, 440 bp, Homo sapiens
  misc_feature (310)..(310): n is a, c, g, or t
  misc_feature (385)..(385): n is a, c, g, or t
ggccttctggtcagtgtcggacgagtcgggtgttgggcgtagaacggtcgggccgataagggcgcccaagcaccctggcggggtgatggtctcccttgatctgagaatggtacctctcgatatgagccagtggtgaaatggtgtcggtgcctatgggacagtgtacaaggccgtgatccccacagtggccatttgtggcctcaagagtgtgagagtccccaatggaggaggaggtggaggagtgcttcccatcagcacagttcgtgaggtggctttactgaggcgactcggaggcttttgagcatcccanatgttgtcctggctgactggaccgtcttgtgccaacatccctgaactgacctgggagatcaatggtaaccctggntgtttgacgcatgtagcaccaggacctaagggacatatctggacaagggacccca

SEQ ID NO: 717358 - DNA, 108 bp, Homo sapiens
tagaggatccagcacttagcctgcgggtactcttaccattacctggatacgcccagatgtacttgaactggggtttacgtttataggccacaagcttccctgcaggag

SEQ ID NO: 717359 - DNA, 314 bp, Homo sapiens
tacatattcgaatcgagctcgtgtaccctcgcggctgcagcgtggtgatgcttggtcgtgtggtccccccggcctcctggactcctggtcccgctgttcctgccagcgctggtttcgacttcgagcttcctgccccagacacctcaagagaaggctcactgattggtgtgccgctagctaccgggctgatgatgccaatgtggttcgtgaccgtgatctcgaggtggacaccaccctcaagagcctgagccagcagatcgagaacatccggagcccagagggcagccgcaagaaccccaaccgcatcacccgtt

SEQ ID NO: 717360 - DNA, 359 bp, Homo sapiens
tccccccgggaaaagggggcctcctcccttccctccttggggtggggggtgggcaaaccccagtgggggccagggcccccccaagcgcagggtggggtggacccccctttttgctccagggggtggccggtttttggggggggagggtttccccccttgcggccccccccctgcactccgtgaccttttaaaaccccgggggccccccgttagccccagggttttccgtttaaagggggccccccggcccccgggccctgtttttccgctaaaggcccgtcctccttttggggggtttccgggcccccttccccctcccctcccggggggggcaaaataaatgtttgtttgggttttta

SEQ ID NO: 717361 - DNA, 255 bp, Homo sapiens
agatcgagctcgttaccgtctgagcagtgggtactgggaatttccatgccggaacagcccagcagctgtgcccgccggagtgagcatgatttgcctccccagggagcaccaggagagggtgggctgggtgtcagatggtctggtagatgctgcctcacgccgggactgcagtaaattcatatggtgaggttgtgcccgtgtgagtgatcccgcacgagtctctcccacatgcgttcaccactgggcagtgtggcg

SEQ ID NO: 717362 - DNA, 217 bp, Homo sapiens
agtcagaagtaggaggagaacgcgccgaaggctggttggggcatccgagatcattaaaaagggctgaccctaacaataggtacgagaagtataaaatgtgaagtaagagaatacaaacaaatttcctttttggagtacttttaagaaaaaaagcagggccttggaagttttggttcttttttcctcccctgttgcaaattctcatggttagggttgg

SEQ ID NO: 717363 - DNA, 449 bp, Homo sapiens
tccaatatcagcagcggttgtagcgtcggaagggctctccctaccggccctataaggaacttctacaaagtaccagtgccacatactagagtggcgcacagcgactccagaatgatagagctatgggcatcgggtcatagaggcgaagaactgggatcatacataaacgggtacagggcgacgcattgatccctatacagagtaagggccagacagaacaagaggcatagctaccgtaactagcccccaattacacactacaacatatattacgcgaccaaaaggcgctgcaccgggtagcgagcctaggtaatacccaacgccgcacaaaggaaacaggtaacaattaacctatagcaggaccttggtctccaagaggaatcacctacacgttccagtagcacctagaaaccagtatacccctccccttgataactggataccccaaa

SEQ ID NO: 717364 - DNA, 204 bp, Homo sapiens
ctcgcgcgggcagcaggaattctcgcgagagcagcaggaattcagcagcaggaattctcgcgggacagcaggaattctcgcgggagcagcaggaatctcgcgagagcagcaggaattctcgcgggcaggaattctcgcgggagcagcaggacatctcgcgggagcagcaggaattctcgcgggaccagcaggaattctcgcggg

SEQ ID NO: 717365 - DNA, 696 bp, Homo sapiens
  misc_feature (218)..(218): n is a, c, g, or t
aggcagtggttcagtacctcaggcagtaattctggttggcattcactactttctccatcaaaggtcatccttagcatagtgctcgccctttcagacgcataagggtcgctgtactctacaacggctggatagctatgggtatgtcatcatagtacatgcgctcagcagcagcagtcccattgtcaatgactggtcagtcatgcccagtgacagcactngtatagcttcgagtcgtgccaaggttgttggcactgagaggcaagctgcattgctatatccctcagtgatgcactcttgagccagtacgctctacagatcttaggctacagtcatgtacagagtcggtgtatgtaagctgacagtccatctgtcatcattcttcagacacttggttgtacttcgtggataagcctctatccaggttgctgtagatcatcctcctcagtcagtagtagattggcgtgcgcatagcacaggtatgtcatcagcagcattgatctggacagcatctaacatgtctggctgttactctagcttcatgtcttcatcgtaggcataagtacgctggtcatctggtatcgtgcagatagttcttcaacggtgtccgtatcttccaagggtctctcacctttgcgctttatggtagatgtatttcccgtgagcaaccttctcctcgtaatcgttgatctgtttcat

SEQ ID NO: 717366 - DNA, 217 bp, Homo sapiens
gagagagaagaggacgacgatgactccgattatccggagaggatggaagacgacgacgacgacgccagttactgcacggaagcagcttcaggagccatagtacctacagcagcacttcaggtaggcgaaaccaagagtacatcggcctcgttctcctatattggagaaaagacatccgcccttgaatttccaagtcctcttaggatttaatggtgcc

SEQ ID NO: 717367 - DNA, 340 bp, Homo sapiens
cgcgtcgacctggtacctggaggcttggcagcagcatgccctccttcctcctgctctttgcctcagtctttgcgtgcagaaatgggattgctgttagccctatttcgtagggttgatatgggatgatgcggtattccatggtgtttctggtctttctcagggcagaataaagtttacctctgccatgatgatggtggtgctggtaatgtggttgatgatggtggtggttggtagtactactgttggtggtgatggtggtggttggtagtattactgttggtagtgaaaagggcggtagttggtgtcgacccgcccgcgaatttagtagtagtagtcgacc

SEQ ID NO: 717368 - DNA, 309 bp, Homo sapiens
atcctcattccagagggggccctgccacatagccaaaaggaagaagtgcttgttcagacaggtcaagaaggattttgacagacaggcctttttgggtttccctactcaatttattagtattagggcatatcccttttggccagtcatattttttcatgactgttcataccttgttgaacctaagggttaaaatggtcaattttccctgtgtctttggtcttcattttgaagggttatgttggaaatgtggtgttcaaatttcatgtaaaggtatgatcaaataaatttgtatgccttttttcctcttta

SEQ ID NO: 717369 - DNA, 105 bp, Homo sapiens
ttaaaatctccatttatatcttataagctttgaaatgcaagtacagctttaaagcatcataatggagattttaaagtagaaataaatatgtattccatgttttta

SEQ ID NO: 717370 - DNA, 393 bp, Homo sapiens
  misc_feature (293)..(293): n is a, c, g, or t
  misc_feature (360)..(360): n is a, c, g, or t
acaaaagaagtgaaaatagccagttcctgccttaactgatgacattccaccattgtgatttgttcctgccccaccctaactgatcaattgaccttgtgacaatacaccttccccacccttgagaaggtgctttgtaatattctccccactcaccccacgcccgcacccccgcacccttaagaaggtattttgtaatattctctccgccattgagaatgtgctttgtaagatccaccccctgcccacaaaaaattgctcctaactccaccgcctatcccaaaccttacaagaantaatggataaatcccaccaccctttggtggatttttttgggatttaggcccacctggcacccggggnggatttaaaaaaaggttttatttgtttcaacaa

SEQ ID NO: 717371 - DNA, 516 bp, Homo sapiens
ccaaggccccttctacagcccattggtgccagaacgcttcatgagctgaagctctggacaggctctcgggaggagctgctcgaggagaagattcctgaagacggcccctaaacactaccaaatagctcttctggggcagctgggccatgtccaaagaggctgcccctctcaccaaagaacagaggcagcagaaagctgcccctgaactgatgcttcctggaaaaccaagggggtcacccccctccctgtaagctgtggggataagcagaatatgcagcagctggggttgggtgacatagagcatcctattcctttgacattgtcataggataagctgtgttagcactcccccaggaaatgagattgatttttacaatagccaataacatttgcactttattaatgcctgtatataaatatgaatagctatgttatatatatatatatatatatctatatatgtctatagctctatatatttagcccttccctggaaaggggccagggaaaaacaaa

SEQ ID NO: 717372 - DNA, 207 bp, Homo sapiens
tttccaaatccaacccttatttgggacccttcagtgatgacccagcagacctccaaaaagcctcctttgcccagatctccagccgggtttggggctgggttgcggaggggagggtttgggagtccacacttttccaccaacttcccttcccacttttttattccacattgcagtgtttggaataaaccatgtttttatgcctcctca

SEQ ID NO: 717373 - DNA, 1009 bp, Homo sapiens
acggaatggtgcgaacaggcaaagcagatgcttactcatgcactgtagtctatctcttcggtcagcgcttccattccaagcatgatctactgactcacgtgcgcacctgtagactctatcggacacagcttatggaaggtaaagacacaaagaccagatctatatgaaactgtctggcaataacaggggcgtgcgtgagtagaaaaatgcgtcagaacgggggtctcccatctcggaggctcatgcctaagcgcgatacgtttgtgcatgacagacgtcgtatatatgcatgcggacggtcgcatccagatgtgctgtcgaactctattgtgcatgactttcgccttgttggagaaagactcctagatgagaccagaagagatctgtcatgatagaaactcatcactagtactgtccttacgaggaaccaaacgatatagatgtgcaatttcatggataggggccattattctgtgagtattagcacccctcactgaaggatggcatggcagttgaatgcgtttgaatatatggacacctagagtgctcatacacggttgtattaggtgcaatacctcgtgaaagcaatgatgcattacatggtactttacgctgctgaagtgtaacaactatcatgcatggtcggttgggttttgaacaacaatatgcgcattggcccctaagtattgcgccaaaactttatcacgtggagcactgatgagtattgaggaaaattgagagggtagtaaggtcgaggtgttatatgattaatagacgttttagggtataaacgtttcaccttagaaaaaggcttttaataaatgaagacaagtaaacttaggatttgcgtaattggacagaggtatatcactagttggagggaggtgctaaattagtataacttactttggcatatagggttgccacacggggtcttggaagaattgttacacgcgtaaggggaaggggtttactggacaagttggattggccatgggcttgtttgcag

SEQ ID NO: 717374 - DNA, 1262 bp, Homo sapiens
tcgccttgtggttggggggatgcgttgcgtccgtgccgggtgctccactggcattggcgggtctcggtttccggggcgtgtgtcccggcgttcctttccggggttggtgtttttccggcttctccggggcaccccttcggcgctcccttatggagggttcacgtgggcatatctcccctggcgtcttgtccgcccccaccccgaggccttttcgggggggcacccccccccatgtggtttcgggccattggctgcccaacggatgccagtaagggggtttcttccccccctgggcgcccctgcgccctctgtgtgggtcctaggttcttgtcgctaccctcccgaggggtgcctagtttcctccggtgtgggatctcggtggcgtcccatccctgggcgcgcttcccggggcccccccgttctcccggccaggatggggggatttttgcccctctccctgtgagtttcccgccggaatttcggggccccctgcccgagtcgggtcccccccggcccgaaaatgcggttcttcttagccccgggaccttctcccccagtattgcggttacgcccattgtgcgtgcccaatgggggttatatttgaggagaatttaggggaaattttgcccccctgggccccaagatgccgcaacccccctccatatgcggtaggcctttcctccgcggaacattggagtaattacgccctttctcgggaaataggaaaaattgtgcccttgaaagcctctgttatttctgagaatatccgccacctcggagattggtatgaagactctgcttgcctgagatttttgagccccctgtattctgaaaggttaacctcggttccccctctggtatttaaccgctgttcccggggctgaggtgttcttgggagtttcttcttaaggggcctggccaggcaccccgttgttttgtcttttccgggtcttgtccagggttggcaagtctcccacgcccgttgggcccccgttttcctttctcttatgcctgaaagtctttggcccaggaccccctgggctgttacattgctttgagttggaagccggtttgccatttacgccctgtaaatagtattccattcttaatattatagtaaggttttttttgtaccgccattttccgattctttgtaagagatgcacccaccaattttggttttctactgttatgtgaggaccttaggcccccagccacccgtccttgtgtaagggaaaattaaagtgctgcccgtaacccca

SEQ ID NO: 717375 - DNA, 415 bp, Homo sapiens
acccatggtttcttaagcctgcaatatcagcacttagggaggctaaggcgcctggaacttgttgtcaggagaccaagactcagcctggggaggatgaagaaatcccggcggaaccaaaaatagcaaaaagtacccgagcgtggtgcagggtgcctgagatagcagctactcggtaggactgggtaagagaatggctagaacccggcagacaggaaagcagtgagccaagatcgagccagtgtacgctagcctgggagacagggcatgacttcatggcagaaaaataacactgggaaatgggaaagtctctaaccatgacagacgcctcggccaattcgactttagactcgagcgagcatacgcatgccgccgaaatgggtcaacggccaaccctccctatagagtgccgaactcc

SEQ ID NO: 717376 - DNA, 119 bp, Homo sapiens
tgagcggtccatagcgacacgtacatagcgacaccgtacccccttccccatactagttattatcgaaaccatcagcctactcattcaaccaagtagccctggccgtacggtgtcgctat

SEQ ID NO: 717377 - DNA, 264 bp, Homo sapiens
tggagttcttgcagatcggggtcaggtgcccatcaagtggatgtgctggagtcattctccgccggctgttcacccaccacagtgatgtgtggagcttatgtctgtgactgtgagaaccctgacgacttttggggccaaaccttacgatgggatcccagcccgggagatccctgacctgcagcccccagcctgaatatgtgaaccagccagatgttcggccccagcccccttcgccccgagagggccctctgcaaggaacccacg

SEQ ID NO: 717378 - DNA, 215 bp, Homo sapiens
taataagtggttataacttttgagtcagtggtttatgttttgcattttttttgttttgagacaaagtctcgctctgtctcccaggctagagtaccgtggcacaatctcagctcattgcaacctctgcttcctgggctcaagcactctgcccacctcagcctccagagtagctggaaatacagatggagtctagctcagttctcctaagctacagt

SEQ ID NO: 717379 - DNA, 344 bp, Homo sapiens
cagcggactcggcagtgaagaggggctcgggcaggtcacgggaggtacagctttcaagcgtgcctgcgatggcgttcacgtccatctcggtcatcatcaccgagacgtccttgttattgacgtcgaaggcttgccttcaaggcctggatgtccgtggccacaccggaaacgccgggtaaatgccacctcctccatggctcggcgctcgatctcctccaagcactggggcacgatgtagggcaccttggagctctctctcttggtgaccccgccatcttgagtccgaagaccctgtctgtttccggacggggtctcttaagctgaatccctgttgttgaatttac

SEQ ID NO: 717380 - DNA, 325 bp, Homo sapiens
gggtctgccgtaatttttcttgtggttaccatgggcttacattttaaaaactgtgtagttataataggcaatttaagttgataataacttaacttggctacatgcaagtattctagacttaccttctacctcccaaatttgtttattttttattaaaagacatttttttttggagattcgagtctgtgcttggttcgcctggggctagaagtacaagtggtgcaatctgtggctcactgcaacctctgtctcccgggtttcaacgcaattctccggtcctcagccctccgtgagtaccgtgggactgcagggacccactcgggga

SEQ ID NO: 717381 - DNA, 198 bp, Homo sapiens
gcatcactgttccaaaaccgtcgctcaattccctccgcgcgaccgagtcgacagctgcgccggaacagcagcgcgccgggcccgtcagtactcccaacagtggtgctccacacccctgtggcggcgcactgaaacatccccttcccacacgcggctcgggaaagcgtacttaattgtggggagtcacgttctgcagca

SEQ ID NO: 717382 - DNA, 165 bp, Homo sapiens
aacatccaggactatggtaaataccaggaactagtgctgaaaaccgggaaattctcctattatcctaaaacatacgtgatgggtaacaaattcaaggtgcatcgatttacctacatttaagttcaccattaaaaagtatgattgaggcggtgcatgtggggagcg

SEQ ID NO: 717383 - DNA, 189 bp, Homo sapiens
aaaagtgtctgaacaggtagttcccttatctgagattgggctttccatggtttcagttacccatggtcagctgcagtctgaaaacagatgagtacagtatcatattttcagagagaaagagagaccacattcacataacttttattacagtatgtggttataactgttctattatttatcagctgtggg

SEQ ID NO: 717384 - DNA, 315 bp, Homo sapiens
ccccccttaaaaacccccccctttttttttagggggaaggggccggtcttttcccaggtccccccagggggggggaaacccttcctttttggtaaatttttaaaacccaaattttttttatttcccccccccaacccttttttttttgtttttttttgaaaaaggggccttggggccccccccccccccttttttttcccccccctttaagggtttaaggggttttgtttcccccgggggggggggggggccccccgggtttccctttcccctttttttggccccgtttattaaaggggcccccctttaaattta

SEQ ID NO: 717385 - DNA, 216 bp, Homo sapiens
cagatcagccacagcctgatgcctgcagccccactttgctcaccctttcccttcccttcctcctttccttccacaaaagaaggcctaccttttctccattccatgcttaaccataggccccctttccttgttgaccttgggaccctccattggtaccctggttaggcttttaaacttctcggggggggtgggggccacactcttttttggcctcta

SEQ ID NO: 717386 - DNA, 167 bp, Homo sapiens
cgtctagcatctagagatcctaatttgcaccacagctatagattcaacaccaaatggctattgggagagcgcccctcatcagtgggctcctcccccccagtggcccctgtatcctcccaggcttgtccacacccccgtcttgccacctcagtgcattaaggtcgggg

SEQ ID NO: 717387 - DNA, 160 bp, Homo sapiens
tccaggcacctaacgatttgttttgctcaatcaaacgcagacaggcgtctccgaagtaccaccactgggatatcctcggaccagcgcttaaaccgaatccccacaatctcaaactcaaccaggccaaagggaacacagtgacacaacaacagggttccaa

SEQ ID NO: 717388 - DNA, 385 bp, Homo sapiens
acagtgtgagactctgtctgaaaaaaataaaataactaataataaccagactcccgacatccaacaatctcaggcacttattaagtacctgctgtgtgccagaaattttgctgagaatccagaggaagcgatcctagcaggtggctgggcaacagcctggggtcctgaggtggaggcaggaggggctggaatccctgtaaacggcctccctccaaggaagcctggcccaggcgcccacccttcagtcaccctcccctgtttagctcacacagctgggtcagtgccaggcagccccacccaacgtggagctgtggggccctagaactgaggagccgccatcatttctggctctgccaccaagaggctgcccagagccaggcccact

SEQ ID NO: 717389 - DNA, 351 bp, Homo sapiens
tggacccattatgactcccaactcagtatttatgattatttttgaggcagggtctcactctgtcgccagactggagtgcagtggcaggatcaggctccgtgcagccccaaccttccaggctccagcaatcctcccgcctcagcctcctgagtagttgggagtagagatgcgtcccacatcgcctggctaatttttgtatttttgtggagaggggatctcgccacgttgcccaggcttgaagccggatcaagcaattgggttcttcggatttccgaaatagaccccaatattctgcctttaccccggaggatgcagatgtaccttctctcaggccgttgagatcaggcatgt

SEQ ID NO: 717390 - DNA, 255 bp, Homo sapiens
gaagttcagtaccggtctgggtaacatagtgagaccccgtctctacaaaacaagaattagctggatgtgatggcacatgtctgtagtcccagctactcaggaggctgaggctggagaattgcttgaacctgacagacggacgttgcagtgagctgaaattgtgccactgcactctagcctgggcaacagagcgagactctgtctcaaacaaaataaaaagagaaagaataaaagaaaatgttctcatttctctta

SEQ ID NO: 717391 - DNA, 331 bp, Homo sapiens
atgggatataattttgtaacatagggactaaatgaacaaatattcttattaaacaaataaaaatctccaccaggggtgaaggaataatgaattctaccaaacattgaagagtagaagaaatgattttaatcacattctgcacacttaattgactcctggcatccttttagatgttaaaacaaacaaacaaaacaaaacaaaaaaacaagcattggccaggtgcagtggctcgcgcctgtaatcccagcactttgggaggccgaggcaggcggatcacgaggtcaggagattgagaccatcctggctaacacgctgaaaccccgtctctact

SEQ ID NO: 717392 - DNA, 159 bp, Homo sapiens
catgatatagttcaaaaaggatacatgagtacttttatgagcaatgtaataggatccatgttttctatcccctgaagaatgttgtactagaatatttatgccatcaaaatttctgatttacaatcatgatatacaacttgaaagatgtacattaatgga

SEQ ID NO: 717393 - DNA, 393 bp, Homo sapiens
aaaacaacccccagccttctctgatgcccaggagactaatgggtactcggcttaacacttggatgacaaaatgacctgcacaacaaacccccatggcacaagtgtaccgatagaacaaacctgcacgtgtgcccctcaacttacacaaacacaagttaaatttaaaaaaagtcttgtgagggccgggagttgtttcatagcattattgtctactcggcatgtcgcagggaagaccgggcaggatgggaactggaggacctctccgagggccacacagctcgtcgtggattttcatcccagccctccatgatctgggttgcttacaacttcgttacagtgaatatatatcgatcatatgtttatcatacatacgcccagacctggcaaactcta

SEQ ID NO: 717394 - DNA, 388 bp, Homo sapiens
  misc_feature (2)..(2): n is a, c, g, or t
  misc_feature (37)..(37): n is a, c, g, or t
  misc_feature (214)..(214): n is a, c, g, or t
  misc_feature (382)..(382): n is a, c, g, or t
cngaaacatccccccaaagacatgccccagaaataangctttaccccacatgtcctatgtaatccctcaatcccagtcaaattgacacaaagttaactatcatggctgggcacagtgactcaccccctgtaatccccagcactttgggaggctgaggtgggtggaatcgctggagctcaagagcttgagaccagccctggcaacatggcgaaanaccgtctctacaagaattagccgggtgtgctcatgtctttagtcctagctacttggggtgctgaggtagaaggattggcttgaacctggtagttcgaggctgcagtaagccgagattgcaccactgcaatccagcctgggcgagagtgagatgaccttgtctcaaatnttaaaa

SEQ ID NO: 717395 - DNA, 193 bp, Homo sapiens
tctcaggctctgtctgttctctcgcggctgtttctcaggcaggcatgtttctcagccaggatgtcttctcagccagtgtatgtcttctctggcaggatgtcgttcgtcagccagggatgtcttctcagcccccatgagagctgagccccatgggaacaaaggctatgtctgattcattcttttttcttttttt

SEQ ID NO: 717396 - DNA, 138 bp, Homo sapiens
gagactccggcaggtgtaggggacaggcgtgggatgtgtcagtgcgcagggttggcagcggtggcacttctgcgtgccttaactggcagagcgtgctcaggtcgaagtgcaggctgcgccccctccttggtgctctag

SEQ ID NO: 717397 - DNA, 1037 bp, Homo sapiens
  misc_feature (8)..(8): n is a, c, g, or t
  misc_feature (61)..(62): n is a, c, g, or t
  misc_feature (67)..(67): n is a, c, g, or t
  misc_feature (81)..(81): n is a, c, g, or t
  misc_feature (88)..(88): n is a, c, g, or t
  misc_feature (95)..(95): n is a, c, g, or t
  misc_feature (107)..(107): n is a, c, g, or t
  misc_feature (109)..(109): n is a, c, g, or t
  misc_feature (119)..(119): n is a, c, g, or t
  misc_feature (122)..(122): n is a, c, g, or t
  misc_feature (131)..(131): n is a, c, g, or t
  misc_feature (141)..(141): n is a, c, g, or t
  misc_feature (147)..(147): n is a, c, g, or t
  misc_feature (154)..(154): n is a, c, g, or t
  misc_feature (169)..(169): n is a, c, g, or t
  misc_feature (171)..(171): n is a, c, g, or t
  misc_feature (174)..(176): n is a, c, g, or t
  misc_feature (179)..(179): n is a, c, g, or t
  misc_feature (186)..(186): n is a, c, g, or t
  misc_feature (214)..(214): n is a, c, g, or t
  misc_feature (216)..(216): n is a, c, g, or t
  misc_feature (219)..(219): n is a, c, g, or t
  misc_feature (223)..(223): n is a, c, g, or t
  misc_feature (226)..(226): n is a, c, g, or t
  misc_feature (229)..(229): n is a, c, g, or t
  misc_feature (256)..(256): n is a, c, g, or t
  misc_feature (266)..(266): n is a, c, g, or t
  misc_feature (268)..(268): n is a, c, g, or t
  misc_feature (279)..(279): n is a, c, g, or t
  misc_feature (299)..(299): n is a, c, g, or t
  misc_feature (332)..(332): n is a, c, g, or t
  misc_feature (350)..(350): n is a, c, g, or t
  misc_feature (357)..(357): n is a, c, g, or t
  misc_feature (381)..(381): n is a, c, g, or t
  misc_feature (387)..(387): n is a, c, g, or t
  misc_feature (408)..(408): n is a, c, g, or t
  misc_feature (414)..(414): n is a, c, g, or t
  misc_feature (422)..(422): n is a, c, g, or t
  misc_feature (436)..(436): n is a, c, g, or t
  misc_feature (440)..(440): n is a, c, g, or t
  misc_feature (456)..(456): n is a, c, g, or t
  misc_feature (462)..(462): n is a, c, g, or t
  misc_feature (464)..(464): n is a, c, g, or t
  misc_feature (466)..(466): n is a, c, g, or t
  misc_feature (477)..(477): n is a, c, g, or t
  misc_feature (481)..(481): n is a, c, g, or t
  misc_feature (514)..(514): n is a, c, g, or t
  misc_feature (519)..(519): n is a, c, g, or t
  misc_feature (575)..(575): n is a, c, g, or t
  misc_feature (580)..(580): n is a, c, g, or t
  misc_feature (586)..(586): n is a, c, g, or t
  misc_feature (597)..(597): n is a, c, g, or t
  misc_feature (643)..(643): n is a, c, g, or t
  misc_feature (663)..(664): n is a, c, g, or t
  misc_feature (671)..(672): n is a, c, g, or t
  misc_feature (682)..(682): n is a, c, g, or t
  misc_feature (705)..(705): n is a, c, g, or t
  misc_feature (715)..(715): n is a, c, g, or t
  misc_feature (818)..(818): n is a, c, g, or t
  misc_feature (828)..(828): n is a, c, g, or t
  misc_feature (840)..(840): n is a, c, g, or t
  misc_feature (959)..(959): n is a, c, g, or t
  misc_feature (989)..(989): n is a, c, g, or t
tccttacnaatgacgtgttgccggggcctaatgttctcacataacagtagaaaaccaaaannaaaantcatctcttcaaanaatcganaattgcntacaaaaaaaancntacataaatnaanaatgaatanatttacaggngtaaanacaaacngcttccaactcaaancnagnnncancccaccncgttctggccaaacacatcagccaaganangcnaccnccnccnccggcttggcctttccaaccctgacanacccgcaagncnaaacacctggntcttgccagcctctagaganatcccagaacactcagccctgacacgttatttncctgcacagatcagaggntgctggncacacagactcaccaagccacagntttgtnttccacaagctcgttcttttnttagcnacgttgtnccaagccacacgtnctanaggttgatctcaaagntatgtncntngtattaaacanatantttggggaacagttaacttcaatacaaggtcanttttngcaacaagttctacaatccagtgctgatatcagatacaagcttcaaggacaatttnttttngaaggnttattccagtntcgtgagggtagcatgaggggtgtgcgttggcgaggggcaaatttntattctcaattaacccatgnntcaaatnntacgcatctnctgagtccgtttagaagcatttnctgtggacgntggaggggcccgactcgtcgtactcctgcttgctaatccacatctgctggaaggtggacagtgaggccaggttggagccaccgatccacaccgagtacttgcnctctgggggngcgatgatcttnatcttcatggtgctgggcgccagggcggtgatctccttctgcatcctgtcggcaatgcccggatacatggtggtgccgcccgacagcaccgtgttggcgtacaggtctttgcggatgtncacgtcacacttcatgatggagttgaaggnggtctcgtggatgccgcaagagtccatacccaggaaggaaggctggaa

SEQ ID NO: 717398 - DNA, 269 bp, Homo sapiens
tgcagctacttgggaggctgaggaggagaatcgcttgaaccgggagtctggagtgcagtggttgtgatcataagcttgttggaaacttaggactcccgagttcaagaccagcctgaccaacatggagaaaccccatcccttactaaaaatacaaaattagccgggcgtggtggcacaatgcctgtaatcctagctacttgggaggctgaggcaggagaatcgcttgaacccggggagctggagtgcagtggtgtgatcatagcttggcg

SEQ ID NO: 717399 - DNA, 535 bp, Homo sapiens
  misc_feature (9)..(9): n is a, c, g, or t
  misc_feature (283)..(283): n is a, c, g, or t
  misc_feature (346)..(346): n is a, c, g, or t
  misc_feature (361)..(361): n is a, c, g, or t
  misc_feature (368)..(368): n is a, c, g, or t
  misc_feature (397)..(397): n is a, c, g, or t
  misc_feature (413)..(413): n is a, c, g, or t
  misc_feature (439)..(439): n is a, c, g, or t
  misc_feature (459)..(459): n is a, c, g, or t
  misc_feature (465)..(465): n is a, c, g, or t
  misc_feature (473)..(473): n is a, c, g, or t
  misc_feature (510)..(510): n is a, c, g, or t
  misc_feature (525)..(525): n is a, c, g, or t
tttgcactngcttggaaacagtactggtgtgctacaggtactcccccagcccaggcaacattcagaatcatgagtgtcaaccaccctacagaagtacacacagatacctgactggtgtggggtatgcctggtactgtaataggagcctaagacagcgcacctaccttttcaggatttagaacctaaaattagaaagagaatcccagctgtcattgttccttccccagaagctaagagccagcctcagagcctacccaggagctgtgaaggggcaagggtcaanctgactcactctaccaggaggagaccaggttgcagtggcgtaaggccccctggtttctctggncacactccaaggcancacagtnctgccagtgaggacagcttgacaaccagncagggaaaccattctngtctttattctgggggcttccagggnctgtcctggattggtcagancccggnttgccatntaagttttccagtaggttgactccaaggctcagcagngggctcaggttgggnttgccagggg

SEQ ID NO: 717400 - DNA, 404 bp, Homo sapiens
  misc_feature (404)..(404): n is a, c, g, or t
taaattgacaaaaataatatatatttatgttatattacttgatgttttgatatatgtatacattgtggaatgactaagttgagcttattagcatatctgttacctcacatccttaccactttttctgtggtaagatctactcttttagcaattttcagatatacaatacattgttattaactgtagtcactatgtcactacaaaacaaaagagcacagcttctgacaaccgaccttttccacccagccttctctaactcatgtttctgtaactgctctctactctggccccttctgacctaggagttgtggtgaacttctgctgttattatcaagaggggtggttctaccccttgtggtttgcctatactctactaacttctttgtaaataaccttttaattcn

SEQ ID NO: 717401 - DNA, 476 bp, Homo sapiens
cgcaaataaaccctctccaaatactcgccccctctataagtcaaacggctcccacttgagcctgagaagacacacggtttcctatttcctaagagaggggttgtaagactctttcttgcctcccttgtggttgtgaaggagagaccccagggtgcctccttattctcctctttaagcggttctgcctccctgggaacctctctttgggggaatccggccaaacacgggtaacccctgagggtcccacagtgccacagaggtgggcacacacacacagcacatgtgtctgtgtaatgtgtgaaatgtgaaagagacaccacgccctcctttcagaaggaaaaggggcctgaaggtgccacagctgtgtcctgggttaggggttgggggtcggccccttccagggcccggagggccggttcccttttctggtgctgctgcttgcaaattttagaggaaataaaaagggaagtgagaga

SEQ ID NO: 717402 - DNA, 167 bp, Homo sapiens
gatagcggatgaggggtccgctattaaaacttacgatcgccacccacacactggaacagacctagttcaacgaatctgaggaggccactcagtagacagtcccatcctcacacgattctttatttttcacttcatcttggcctggcattattgccgccctagcagca

SEQ ID NO: 717403 - DNA, 326 bp, Homo sapiens
gcattcagactctcctgtccacaaaactcccaagtcagagaacagagacaacaaaggaaaaacccaagcccgaggcatatgacatgatggttcgcgagctggcttagaaatgaaggcgcagccctctaacaggatgaagacggacggcacgaatgggcacacggacagacgcacggacgcaccctcaggaagctggacggctaagacgaccttcgaagaatgcttggaaaggatgaggactgaaccactgttaagaaaccaaaaccatatgtcagcagatgactctgacatgatggcttcgctgctagactaccgatgacaggcgt

SEQ ID NO: 717404 - DNA, 83 bp, Homo sapiens
tctctacaaaatttttttatcctcattgccagttaaatacagagttttacttgcatagcttaacaatgaagggtcatacactg

SEQ ID NO: 717405 - DNA, 390 bp, Homo sapiens
gtgaataaacaaaatcacggtcctgcacagtagctcaaaatgaaacctatgacgtcaaacactactctatctatggtacccgctacatcttgtctgatgcaattataacattaagtatatcttgtgaatctagcacgtatactaacccatcgccactccctaagcccaaaccttcatcatctctcttttgtggatgattgtcctggaaccctggtcccttacctttttcgtatatcctttgaaaggtatcttgagttatcttcttagaaatcttatgtaattatgctcctcttctgcttaaaaaccttgattgccttcctgttacctgtggttaaatctatgcttcaataatcttctttacattctggccttaactaactttattctgta

SEQ ID NO: 717406 - DNA, 180 bp, Homo sapiens
gcctctgacagccgtcttgacggcgcggtgggcttgtggtttggtggtcgggtcgggtgtggcgtgggtgatgggtgtggtgtgcggtgatgtgggtgtgttgtggatgggtgtcgtgtgtgtcggtggtcgggtcggtgttgctggcgtggggggtgtgcgcgtggtcggggggtgtgg

SEQ ID NO: 717407 - DNA, 247 bp, Homo sapiens
tataccccagcgtcacagttagctgtcacgagctggacgctctgcaaagagagcaggagctggtagcttcctacagtggtaggtcggaggaggcgccttcttagtgccaccaggtttataactgtgtggatcccacgggacttccatggttgccaaatccacaagcaatctactttgcttgcatttgtcttcactcttgtcccaagcagttaatttgacaggttaccactactcgcggaagttggtc

SEQ ID NO: 717408 - DNA, 405 bp, Homo sapiens
  misc_feature (386)..(386): n is a, c, g, or t
  misc_feature (396)..(396): n is a, c, g, or t
gacgtggcggcacagctgggcgagtatctggaggagctggaccagatctgcatttcttttgatgaaggcaaaaccacaatgaacttcattgaggcagcactgttgatccagggctcagcctgtgtctacagtaagaaggtggagtacctctactcgctggtctaccaggctctcgattttatttctggcaagaggcgggccaaacagctctccttagttcaggaagatgggagcaagaagactgtcaactcagaagactccctggtgaaacagagaatgagttcctggtcacttggacgacttcccctgactcccgggcttaatgttggatctggaaaaatgattcagggcatccagtgaacttgcttatccataccccctacttngcccatgggncctgggtgg

SEQ ID NO: 717409 - DNA, 278 bp, Homo sapiens
agagcttcttctaaactgactaccgaacactcggggccgtggcgagtgactatacgtgcgactaatcactatttaaatcgtgaattttcactggaacgctgtcgtgtatagcgacttaataaaatgtaaagttgtctgtgcgatagggccactgcctactacaccgatactcgtaggagcaccgtgaagaactcgaactgcaagcgcagccgaggcagctgtacgagccgcactaatgcggctggcctcgatgaacgcataagcatagccgttatctg

SEQ ID NO: 717410 - DNA, 894 bp, Homo sapiens
ggtctgtgtcctattctacttggaggcccaagcctctgtggccctgtgacctgcaggtattgggagatccacagctaaaaccccaggacaccctggaagcatagaaatgtctccctctgatgccgagccgaagctggactgtactgctgccatctcggctcactgcaacctccctgcctgattctcctgcctcagcctgccgagtgcctgcgattgcaggtgcgcgccgccacgcctgactggttttcgtacttttttggtggagacggggtttcgctgtgttggccgggctggtctccagctcctaaccgcgagtgatccgccagcctcggcctcctgaggtgccgggattgcagacggagtctcgttcactcagtgctcaatgttgcccaggctggagtgcagtggcgtgatctcagctggctacaacctccacctcccagccgcctgccttggcctcccaaagtaccgagattgcagcctctgcccggccgccaccccgtctgggaagtgaggagcgtctctgcctggccgcccatcgtctgggatgtgaggggcccctctgcctggctgcccagtctggaaagtgaggagggtctctgcccggccgccatcccatctaggaagtgacgagcacctcttcccagccaccatcccatctaggaagcaaggagcgtctctgcccggccgcccatcgtatgagatgtggggagcgcctcttgcccgttgccccgtctgggatatgacggagcgcctctgcccgtgccggaaccccgtcttgggacgtgaggagcgtctctgactggccgccccatctgagagggtccatcttcttgtagcgcctgtgcagtttgctaaggggctccacttcagagacctattcatcctggttcc

SEQ ID NO: 717411 - DNA, 492 bp, Homo sapiens
tagtgcaggatggggagtcagtagagtgtgggggaaggtatgggaagtgctatctctgactatgttctttaggtcgactttctaccagaattttcatggaaaagcagcaggaattagaatgtattataatccacatttagaatacaattttttacaaacaattagcccggcgtcgtggcaggcgcctgtagtcctagctactcgggaggctgaggcgggagaatggagtgaacccaggtgggtcaccatgtcgagatagcgaccatcctggcaaacatggtgaaaccccgtctctactaaaaatacaaaggttagctggacatggtggcacatgcctgtggtccaggctctgcttccaagatggcactgcctccataggggaggaatgccgtgttctcacatggcagaaggccgaagagcaaaaaaacaacaacaaaaaaggccagtgcagtggttcacgcctgtaatcccagctactctggagggtaccga

SEQ ID NO: 717412 - DNA, 112 bp, Homo sapiens
ctcagtacaggcaaggaagataacagccagcaccaggcctgctggaagagccacccagagaacccgcaaggattatcctaacaacagctgggatgccattgaagggtcttaa

SEQ ID NO: 717413 - DNA, 146 bp, Homo sapiens
acctcgtcgtcatcatttcgcaccattttgtcaatttgatgtctaagaatagacgcagaagagatcagcagggcaaaataatacaggctgcagtctactctgtaaatgtgcttttcttaaagtatgttccaagaagatgaggccca

SEQ ID NO: 717414 - DNA, 359 bp, Homo sapiens
  misc_feature (2)..(2): n is a, c, g, or t
gnaggaaaaaaattccagaaaaatttgaacttcaaatattttaattcaactattaagtaaatttaaaaatccttctaggatgggactctgggtcatttcctggacatgtatttaggtaaaacttgttgccctacatttcttgagcataaaaatttaacttggcatgaggccatgtggaggaaaaaaataccagaaatatttgaacttcaaatattttaattcaaatattcaataaatttgaaaatccttctaggatgggactctgggtcatttcctggacatttatttaggcaaaacttgttgctctacattccttgagcataaaaatataacttggcatgaggccatgtggacgaaaa

SEQ ID NO: 717415 - DNA, 464 bp, Homo sapiens
cagcataaattcggagtaagaaagtacccgccttttcatatcaacatggtttctaagaacatgtctctgtctctatccctatcattttaaatggctggacattccagttgtttctggatttttctctattgcaaatgttataataaatattttcaagcataaagctttttctctacttcatcatgaacagcataactaaccatgaaaataacatcaaacagtgattttcaccgacagcattctgttgagattcaagacagcacatgtaacctatatctaatctcatttcaccatattaggttttcaacactcattgtttcagtgtgtttcaggatatagcactcattggatacattctgtattgtatcgttgttttccttgtctgcacttatctccgaaataattacaacctttgtttacagcatttctttcttgattcttgtacatttcctggttttaagaac

SEQ ID NO: 717416 - DNA, 322 bp, Homo sapiens
caaaaggaaaagggctttttgagtcccttccaagtgagattgtaaatgtagaattttccactgttggatctagatttttttccttttttttgggggggtggggttacaaacctgaccccttgtccaggcatgtacaaaattgtagaatgtaatttttttttaatatataaaaagcttgtttctacagtttccagtggctataaccaccccggcaattttaggattttttttttaaacataggaactaaaacgggcaagattttttttatataaaataaaaccatttgccttttgtgggggcaaaaaaacaatcaaaaagcca

SEQ ID NO: 717417 - DNA, 482 bp, Homo sapiens
ttgggtggtttattgtcatctgcaggttggagtagtttttggtggatgtgttgggagatttgaatgttacttagctgttattatctctactactttggtagtcaatattgaattttttcactgaatccagccaaacactttttttttttttttggtactaatttcttgaaataatgtattgattagataagagaagtatgttttcagcagttctgtctacagaaaggcttgttctaagaaccatacaataggaattttaaataaatcaaaagccttatattatggaaacatcttgcttatatttattctgttaatctgtaatgtaaagttagattaaaaaaaaaaagacagtgatacaacaataaatacctcccaaaagcaggcatagtcaactctgaatttcaaaggggcttattataggtggaaaaaatttcaacatttattaaaaaaataaagataatttttatagcattatctaaata

SEQ ID NO: 717418 - DNA, 131 bp, Homo sapiens
  misc_feature (85)..(85): n is a, c, g, or t
cgcggccgcgcgacacggctgcgaaagacgacagcaaggggtactactctgtagtggagagtgagtagcctattctgaggaatanaatgcctgaaccctctaagtctgctccagcccctaaaaagggtttt

SEQ ID NO: 717419 - DNA, 1582 bp, Homo sapiens
  misc_feature (766)..(766): n is a, c, g, or t
cgcccttctatgttatgtgtggtgtcgccccattcagtggttttttcgtccgcgggggtgacacgaccgtatttttttgtccgaagaaattggggcgtacatctgtccgggccgcctcctgcgtgtttgtaccctctccgcagggaacgggtaatcttaaacaccgaggggtggtccctgaaagcagtgtgcctccgttcgagaagagatgacccctctacgagggggtcgtctgccccccgcgcttgtgtttgccgctcgttcccctccgaagggctggtccgccccggcgttttcttcgcttccccaatcagaggtgggttgttctgcagaattgcccgccctgtgtggcgactggtactttttcatctgggtgccttacgccttcattatgtgccaccacataatccccgctgtggtccctcacgggcggaaaaaaatgggtttgtttggctctctccccttgttgtgccccaaagtccggggccactgtgcccccgttttcgccgggaacaacacccctgggcgtttgtgaagcgctcccccagacccactgcgccttggggaaggttggggccccccggagttgttccggccttgttgtgttccccgcagagtgcccctcagtgtctctgaagacgcgccaccggaacacacattggtgatactccacgcgtggccttttcggggtaaagaaagagggctgggcacccaccggagaaagaaggtgtttctcaaaggggagccccacgcccacggagggtanccccgcgcacaaggggataacacacacatggcggttgaaagagaatagggcacccctcggtgagcccccccccgcgcgcggagacttttcccgcgcttttgtgagaaaaagccccccacacgggataatctcacagagatgctctcacgcgcctccacgccacgagaaggcccccacggggggaccacactggaagagaaccgcgctctcacagaaagcggggagagggccactcggaaaaaattctcggtctctctagagagcgcctctgtggggacacaatcctctccccgtggcacaccgcgccacgcgtgagagagaggcgcgagattctaccacgagccacatatgagaatatccctctgtacaccactctctgtgctctttggttacaagggtgttccgctcttcgaagagagattgtataaaagccacaccacaagagaaaaataccccacaccaatagctggataagaactccagaaaaagaggaatggggggccagtgccacaccactgctggggcctggcaatacccccttgggcctttttctcggacactttctggtgtggccgcccctgggggcccagagccctctgcccatcctctccccataccttggtctctccagccaaatggccattagccagctgtcatccagaaagactgtggagggacacccaccagaattttggaaacgcacctggacacacacacatattgggaaagaaaagtggcacggcctgtctcctcctgcagggccccccctaagaaagtatttttaaacacactgaaataagtatttttcccctgtta

SEQ ID NO: 717420 - DNA, 441 bp, Homo sapiens
  misc_feature (22)..(22): n is a, c, g, or t
  misc_feature (31)..(31): n is a, c, g, or t
  misc_feature (43)..(43): n is a, c, g, or t
  misc_feature (52)..(52): n is a, c, g, or t
  misc_feature (56)..(56): n is a, c, g, or t
  misc_feature (77)..(77): n is a, c, g, or t
  misc_feature (84)..(84): n is a, c, g, or t
  misc_feature (115)..(115): n is a, c, g, or t
  misc_feature (121)..(121): n is a, c, g, or t
  misc_feature (142)..(142): n is a, c, g, or t
  misc_feature (153)..(153): n is a, c, g, or t
  misc_feature (397)..(397): n is a, c, g, or t
  misc_feature (422)..(422): n is a, c, g, or t
  misc_feature (431)..(431): n is a, c, g, or t
gacatgtacaaatttgcaactncaaaccatnccccagtccagnatacagggncagncgtgtaggtgaccacaccagnagacctncagacctcggtccttctcagaccgttcgggnataggnttccagggcattttttttaantctcagtaggntagcagtaaacttttcagtattgctgttaggcaagtttgtgtttgtccaataggatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacaggaatttcccnttttataaggcaaggaaccatttgnaaaagttanacccacaaat

SEQ ID NO: 717421 - DNA, 101 bp, Homo sapiens
  misc_feature (4)..(4): n is a, c, g, or t
ggtnactctaaggatccccccgccgtacagttgcgggtaactatgcctggcaggcgagacgggcggtggtcgccctcggcggacgcaactggtacggcggg

SEQ ID NO: 717422 - DNA, 256 bp, Homo sapiens
tcccttttttttttccgggggtttccccccggggggttttgccccatcaacccgggggtcagaggggctctttttggccctttgcattaactgcaagatccccctgttttgtttttcccccttcccggccggggcccccccttttttcgggtttttttgaacccgggattccttttcttttttaaaggggggggaaaatttgtttttcccccggcgaaatgttttgtaaagggggggggggttttttttcttttta

SEQ ID NO: 717423 - DNA, 1033 bp, Homo sapiens
gctcctgaaagttagccagtctgcgacagagttcgccttctttagagtgagggaggcgtccagacgatatccatcttgaaatatattatgtacttccacaaatgatggaaagggcgaacattcacggagcgggagtggaggcggaaagggagctccgataatagaaggaggggtcagttccgcggtggggctgggcggtcggagggcgtgggagccagaccgcatgggtgagaagacgttgttccttctagaccggacattagggacatattgtgcgcgttcccgattgatcgtcagtaagttcataaggatactgtgttcccgtcgctacgtcgagatggtgacatgatccctcgttcacataattgagtgaactcgccgtcaggattttattgagtttaagagccttgcagcccagcgaatcgtgatttccgtttaaagtaatagaacgtgaactgataatttgggttatggatgaataaaaacggatacagtagtattaatcaagagtgtgtaggactgtggtaaactcttgggttgttgacccttgtacagcatcgtttgaagcgtagccgggggttgtcagagccttaagaatagtaacctatctttttcgcataaagaacctgaacggggctccaattcgctccctggaaaagaatcacgctccccctccagtttagttcccctggatatggatctcgaagaccctgaagatcttatccactttataaagtgctgatctggtgctggcgtcttttgggaggacaatttggtcgtgggtcagcgtgaacatgataagtggggggcgcggcaaaatgtggacaagggcggggcggcattgaacaaatcactagctttataggaaaagggggcccatatgagaagagtaaaaaaggacaggggggggggtgaaaagggcgagaggggaaagtggcttgggttttgagaaaccccttcggggggaacatgggggaccagaaataaggccggaaaaatgttattgtaccgatttgtggaatctgttaaaagg

SEQ ID NO: 717424 - DNA, 185 bp, Homo sapiens
tcacgaccatgtcaaggagccactgggctatgtttgccattatatcacatcgtcccgttagaaaattccaggactggccagtgcatgttctacaacctcctaggcctcatgatctgtctcgccctccttcgagcctcgacagtgctggagattacaggcgggtaccgaagctcgaacttcagtaa

SEQ ID NO: 717425 - DNA, 166 bp, Homo sapiens
  misc_feature (1)..(1): n is a, c, g, or t
ntatttaactttagaaactttattaggctgtcttgccgctataaagaaatacctgagactgggtaatttatgagaaaagaggtttaattggctcatggttctgtaaggctgtacaggaagcatagtgctgacatctgcttctggggaggcctcttgttgggagctt

SEQ ID NO: 717426 - DNA, 1071 bp, Homo sapiens
ccaatttgttggcctgaagtatgggcctttgttttagtactcggcgatgtatattgttccatcgggtggcaagtgcgctatgttagtgaatcttaagcgtttagtaggaaaagttcgcacgtggtttcggcaggggtacgatttttggtggtaatcgatacgtcatgggacacggtgcgtacgaattcccgtcggcttcttattgccaatttaggaagttttcggcaggcttatgcgtgtccactgtgattggctcatggttcgcccatggcgctcagcgtgtgttccgcccttcgggcaacactggaggctggctggatggccgcaaggcagatctgcggatgtcaatttcttgcattaggtcaagcagatatgaggaattcccacggcatatactgcggcttcgtacctatggggtcacgcacctggcatttctcataagcacagtgtagacttggtcccctggtgcgtgcccagcggttgcgccatgggaggccaggggcatgtggaggcaccagcgagctcaagctccacacctagtggccgcaacgcgttcgaccacgtagcccagcccttgcaggtcagtccgtatcgcggtatcggcacgggcctccatcctagtctccttcgggtcgccagtgtaggtccagacgctgcgagtcctgtcgtgccgcctaatcagctcgtgactcgcgtcagaacagcttatggcacggactgtcatggggccatcaccagcgaaggagacgcagtgcaagccggggcaaggcgggtccacgctatgacgccaacatgcccctacgggagcacccccacatcgtgtgtgtgagtgtagcttgtctctccgctgcagcctgaaaggggtctcgatttgccatcgaagaaagatcaaccgtctacttttctatcttttgtattttgataaacagctgaagtctggagctgttaaaaattatctctggggaaacctcagaactggtctatttggtgtcgtggaaccatcttactgctattcaatacacgattagtaatcaactgttcttgtatacttagtcttcagttttcatttcc

SEQ ID NO: 717427 - DNA, 325 bp, Homo sapiens
ccttccggagccctgttttatagcttatgaaaaaaggaaaagtggcctggcacggtggctcatgcctgtaatcccagcactttgggaggctgaggcgggtagatcacgaggtcaggagttcaagaccagcctggccgggatggtgaaaccccgtctctactaaaaatacaaaaattagccaggtgtggtggcaggcgcctgtagtcccagctactcaggaggctaaggcaggagaattgcttgaacccgggaggtggagcttgcagtgagctgagatcgtgccactgtactccagcctgggcaacagagtgagactctgtctcag

SEQ ID NO: 717428 - DNA, 526 bp, Homo sapiens
aaaaaaaaaaaggacaaaatttagggggggggtggtggcacattgcctattaattcccagctactgggggggctgaggcaggagaattagaatcactttacccggggaggcggaggtggtagtgagcagatatggcacgattgcttcccagtcggggcaacagagcaagactccgtctcaaaaccaaaacaaaacaaaacagggtatcttttatataaccacccccccataataaaatatttaggtgtagatctaccaatggtgtacaccttctatatgaagaagctatagaactctgatgaaagaattcaaagaggactaaaattggaccagatatcccatggtccagggataggaagactcgatataatagagatactcattctccctacctggatatacacttccaatacaacccgtgattattatcccagcaaggtattggggggatatggataaccggactctaaaggttagagggagacgcaaaagacggagaattgccaacagagttataagggagaaa

SEQ ID NO: 717429 - DNA, 277 bp, Homo sapiens
ttgggagctgggtgttgtggcatgtggggtcttggatgaagaggtgggagggctgcactggagtgtccggagctgagtggccgtgcccagtgtgtgctcaaggtgacaatgggtctgtgagttctcatgtggtgctgtgtgcttcctctgtccccgagagaccatgctgcacgctgcttcagcctgctcctccatgcttctcctctggcctcccgctgtgggtggatctctctatgagtctgatcctgcatgtgcatgcaactgcttgtgcgactgt

SEQ ID NO: 717430 - DNA, 518 bp, Homo sapiens
  misc_feature (232)..(232): n is a, c, g, or t
tggcgtcgtataatcgcgaatagttttactgctgtttgattgagggccggtgtatagatgtgtcactctggtttaaacctcatcaagctgtatatacgtgatggcaggtgcgtgtcgtgcatgtagtaacatactattcatataccccattaactcaacaaccccactcctagaattactccacagacatatacacccatgcaaaatgacacattcagagatactctcgttnttactcgttctcacgtgaaagtaaagaaaggaagaacatgacagagacgcgggcgggggagcacagcagcagcagagcagagataagaacgtaccgcacagcagcacacagacacagaacgaacatcagcaaagaaagaaagagagagagagaagaaagaaagaaagagaaaagaaagagagggaaagaaagactgggaacaacctaagagttccccagctggggactattaaataaatgtggcatagcctagagtggaatctatttcgccaacacgcagaacgcg

SEQ ID NO: 717431 - DNA, 435 bp, Homo sapiens
tcttcctcccaataactcataacccgagtattttctatgaggaaagacgtcagacaaattccaatactaggcaacctataaaatacttggcctgtactcctcaaaactaacaaggtcatcaaaaataaagtgtgagaaattgccacatttaaaaagacatgacaacttaatgtaaagtggtatctgagatggaatcttggaacagagaaagggcattgaataaaagctaagaatctctaaataaactatgccattttaaaaataatgatgtgtcaatattggcttattaatcataacacatgtatcatactaatgtaaagtgtcaacgatggggaaactgaatggaaggtatctgggaactttctgtactgtctcctcagttgtttctgtaaatctaccactgttctaaaaaataaagtttgttaaaaagaaaat

SEQ ID NO: 717432 - DNA, 365 bp, Homo sapiens
  misc_feature (20)..(20): n is a, c, g, or t
  misc_feature (74)..(74): n is a, c, g, or t
  misc_feature (112)..(112): n is a, c, g, or t
tatattgtggacgaccttcnttcctcactcgtctaccttctttccttattagtcactttcttaccagtcttccntccttttctgtcttctttccttactcgtctgccttctntccttattagtcactttcttaccagtcttccttccttactagtctaccttctttcctcactcgtctaccttctttccttattagtcactttcttaccagtcttccttccttactagtctatcttccttccttactactctaccttctttcctcactcgtctaccttctttccttattagtcactttcttaccagtcttccttccttactatctatcttctttcctcactcgtccaaccaaataggtagcgagc

SEQ ID NO: 717433 - DNA, 217 bp, Homo sapiens
acttaggctctgtaccgtgaacagcgtggaggaaaagatccttgtggccgcaaaatacaagcttaacgtggttataaaagtgatccaggcgggcatgtttttccaaaagtctttaaggccacgggcgggaggggatttctttaggccctctttgggcttgtggagggcgaatgggcgcgcggttccgtatccccccggttgctgggtttgctgcccc

SEQ ID NO: 717434 - DNA, 369 bp, Homo sapiens
  misc_feature (61)..(61): n is a, c, g, or t
  misc_feature (70)..(70): n is a, c, g, or t
  misc_feature (73)..(73): n is a, c, g, or t
  misc_feature (81)..(81): n is a, c, g, or t
  misc_feature (140)..(140): n is a, c, g, or t
  misc_feature (157)..(157): n is a, c, g, or t
  misc_feature (166)..(166): n is a, c, g, or t
  misc_feature (334)..(334): n is a, c, g, or t
  misc_feature (362)..(362): n is a, c, g, or t
  misc_feature (365)..(365): n is a, c, g, or t
gaaaacggaagtctcgcctctgtcaccccgggctggagtgccagtggtgtgatctcagganactgcaaantgncgcctccngggttcacgcccattctcctgtctcagcctcctgagtagctgggactacgggaacccgnccacgtgcccggctaantttttgtanttttagtagagacggggtttcaccgtggtctcaatctcctgatctcgtgatctgcccgcctcggcctcccaaagtgttgcagtcacaggcaagagccaccacgcacagcccagcactttgggaggctaagatgggaggatcacctgaggccatgagtttgagaccagncctggtaacatagcaagacctccatctntancatt

SEQ ID NO: 717435 - DNA, 204 bp, Homo sapiens
  misc_feature (116)..(117): n is a, c, g, or t
  misc_feature (161)..(161): n is a, c, g, or t
ttttcaaaaaaccggggccgggggccccaatggggcaccccaaatttttggtttttttttaaaacccctaaaaaaaagttgaaaaaaaaaccctcccaagaagggtggattttttnnccttttttttaaggggggccttcccttttgggaccccccttttngggttaatttttgagaaatgggaataaaattgtttctttttta

SEQ ID NO: 717436 - DNA, 97 bp, Homo sapiens
  misc_feature (92)..(92): n is a, c, g, or t
tctgtacttccaagaataagctctgacaacagccattgtttctgcttccactcatattctctgtattaaaatgtgtagagaatatgagtggnaggag

SEQ ID NO: 717437 - DNA, 282 bp, Homo sapiens
  misc_feature (232)..(232): n is a, c, g, or t
attatctatctatctatctatctatctcatctatctacctatctggactatctagctagctacctaccttcctatctcctctctggtatgtcagtagtcatatagatatgatggataagaaactccgggctaagggtgaaactctgaaaagaaacctgtctgccgggccgggcacagtggctcagaccggtaatcccagcacttggggagtccgagaagggccgatcagggnaggtcaggagtttgagaccaggcgggcgtggcaaaaccccatctctatta

SEQ ID NO: 717438 - DNA, 176 bp, Homo sapiens
cccgtaggcctttcctcaaggcccttttctctgcgagatgcagatctttttcaagtcgctccgccggcctctccagctccttcctcaactggtcacactggattaaagcctggttttttcaaaactggcttcctcagatatttgcaaaacttgtatcaccctgttcataacgcact

SEQ ID NO: 717439 - DNA, 1076 bp, Homo sapiens
gcttgctgaccctattccagcccggattctgggatccttccctctgagaccaacatctgtggatccatgccttcgacaccacacccaatggacttccatacactatgacgtgacctggagatcttgccccagtggtgcccattgatcctggtgcacatgtgcccagcaagggggtcctgtggtgcctgagagccagcatggtggtgctgtgagaccatatctagactactaatcattgtgatttactaccggtctggggaacagagcagacggcacagatggggcagaacagactcacctgacgagttgtgtgaccacacacacaaagcacgacatacaacaatgtgtagtgccacgcacagttgcaagatactcgccctgtggtcaagttagagcacacattgtgcccagtggtccaggcggatcgacccataattgcacaagtgcaggtcgcatggtcgatagtagggattgggctacatccttacgatggatccatagaacgacaaagatggagcgattgcattggtccagtgcgttggcattccaccatgccatatacaccacaagggctgacgacgacccaacaacacggtacacagaccatacttgcacgggttacccagacgttggaagtgagcacccccaaacacaagacgctaggaacagtccccgttacacagatcccagcaatgggcaagcgggccccaaaacggggctccagagaccaaagacaccttgaacacacgggaccgaaaatcgaagagccgcgcaccccgaagagccccacgatgggcataaacacgtaacgcacggcggaagcgcgaccatccccaagacgggcacaggaaccacatttgggcaatacgttcacctttcccgaagaggattcaagtgaggaaggaaaacgcgcgaagttgaaacaaccttttgcagttccacgggacataacaagttctcggtggagccccaagtcattggggcaagttcgcgcgtggtccaaagacccaacaacagggccgatgtgcgagtatacccagcgaaaaacggggggcgtcttacacaaagttgagaaa

SEQ ID NO: 717440 - DNA, 384 bp, Homo sapiens
tcctaaccaggtgtccttcctgtagtcagtcagctcagccccattctggcagtatttctattcccaccttggcctataatgaacaagcttggggctacggtctttggacagaggatacttgtactgaagcagcttagatttctatagagggtagcggaggaaaagataaggatgaggctgcttctggaataatggtcatgggaatgaaagggctgttgaaagattagaggccagtgtgcctgggtacagggactggggtcataattatacttggtcttttactagtgccttaggtccaagtcactgaacgggcttaataaaattctggtctgaataatattatgcttggctctttggacttcactggcggtggcagtgaggctc

SEQ ID NO: 717441 - DNA, 687 bp, Homo sapiens
gcctcaccaagtagaacaaatagagcttcttagcaagaaacgaggttcagagacagtggttggcgaggcttgaccatggttccgccagaccagtcccatcaagtgagctggtaagccaccagcagcctcctcaggagaatcactggatttccacgtatgcaatcagccctattgacgaatagtcagtggtgtgtcatcgtggaggcgtcccgtggtgctagaggcttgatgaatggataccggggccctgccaatggattcagaggaggatatgatggtaaccggccttcattctctaagcactccaaagcagtggttatacacagtctcagttcagtgtctccccgggattactcgtggctatcaacgggtatggatatcagactagaatttcaagcagaggctctgggacagagtggaccacggtggagccccatcgaggtcgctggatgggctcgcccagagaaccaacagagggatgccgcaaatgaacactcaggcaagtgaattaatctgattcagaggatgatgtgtaatcgccaaaaacacactggacagtgtagcataatatgttaccagaagagttattatctatgtgttctccctttgcaggaaacgttatcgtaaagggactgttttgcatcccataaagacgggagtacgaattgtcagtttctattacctgga

SEQ ID NO: 717442 - DNA, 824 bp, Homo sapiens
tggagacggagtctcgctctgtcaccaggctggagtgcagtggcgcgatctcagctcactgcagcctctgactccctagtttcaagcgattctcctgcctcagcgtcctgagtagctgggattacaggcacttgccaccaagcccaggtaattttggtatttttaatagagacagagtttcaccatgttggccaggatggtctcaatctcctaacctcatgatccacccgcctcggcctcccaaagtgctgggattcacaggcttgagccaccatgcccggccagtttttgactgttttttaaactcacgtgtgtcaaaggtcacatctttctctgcttgctacatgggcttcccctttttaacaaaacactatgattggaccctaacgaattcatcattttattaaatatcaccaacatttttaagcgatgcgaattgtctcattataagatttttcatattaatgcaacatagtgaacatacttgccttaatgtcttaatacatttgacctcttgtcttctgacctcttgtgagtaaattacctgagatctgctttccctgttgactccagtttcaggagtctgcaagttctgttcccagatgtgactgatgtactcttgtgtcctgaggatacgctcctgtgttacaagggaacggcagtcatgggggattgccttgtagtccgtttctaattgcccctttgattataccagggtttgatacgtcatttacgtataacttacagccataccttgacgctttcatctccaagttctctaagtgcattcccccaattcctttgtccacatgctgtaatgtccc

SEQ ID NO: 717443 - DNA, 150 bp, Homo sapiens
  misc_feature (150)..(150): n is a, c, g, or t
gactctacaggatcttactcggtatcccacccactcccaaggcgatacactccttctccaccaagtgaaggctaagcaggccgggatgatggcaacgtgtgcttttcttgctctctcaccctccttgtacctggagctcaccaccagggn

SEQ ID NO: 717444 - DNA, 856 bp, Homo sapiens
  misc_feature (40)..(40): n is a, c, g, or t
  misc_feature (69)..(69): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (122)..(122): n is a, c, g, or t
  misc_feature (138)..(138): n is a, c, g, or t
  misc_feature (143)..(143): n is a, c, g, or t
  misc_feature (152)..(152): n is a, c, g, or t
  misc_feature (172)..(172): n is a, c, g, or t
  misc_feature (177)..(177): n is a, c, g, or t
  misc_feature (200)..(200): n is a, c, g, or t
  misc_feature (215)..(215): n is a, c, g, or t
  misc_feature (219)..(220): n is a, c, g, or t
  misc_feature (223)..(223): n is a, c, g, or t
  misc_feature (239)..(239): n is a, c, g, or t
  misc_feature (250)..(250): n is a, c, g, or t
  misc_feature (261)..(261): n is a, c, g, or t
  misc_feature (286)..(286): n is a, c, g, or t
  misc_feature (295)..(295): n is a, c, g, or t
  misc_feature (304)..(304): n is a, c, g, or t
  misc_feature (317)..(317): n is a, c, g, or t
  misc_feature (328)..(328): n is a, c, g, or t
  misc_feature (354)..(354): n is a, c, g, or t
  misc_feature (390)..(390): n is a, c, g, or t
  misc_feature (420)..(420): n is a, c, g, or t
  misc_feature (504)..(504): n is a, c, g, or t
  misc_feature (638)..(638): n is a, c, g, or t
  misc_feature (711)..(711): n is a, c, g, or t
  misc_feature (793)..(793): n is a, c, g, or t
  misc_feature (815)..(815): n is a, c, g, or t
gtgatttgattaaagaagacagacaacaagtgcttttatnaggaacaacattctgaatactcacgagtngttatcttgcacacttaaccctaggccngagggngnggggccaccacacaggnggaggataccagggcngcgtncatgttgtnttgcttataccacaggaggngtggnggctgtttttttcgtgggtgcgnctactacgtctatgncctnntcntgtcattcaataattnctccgcctttntgatgtccccnataccaactaatcaacgtagttgtnctggtggcngccgctgtngggggccggtganctgtcacatangcgttccatcatgtcgccgcttttgntggtgctttgcggtgccctccctttgctgttttcgntggtcggcgggtgctgtttgctggccaccngtgtcgcatgtttttacttcacataaatgtattacactgtcctaggagagcaaatgcatattatgtgggggaaaaataggactnattatctcgtaccacaaacaggggttacagaaaacacaaggctggacaaggccacactgagacaggttagtgacttttctggcaggcccctcataggcactgagatgaggcctaaaaatatgctggggtgagtnccgtccttccttctgtggttaccacctggattaggcttcctgagctcggtcggtttttccctgtgatccagtnatgggaagtttcaactaggaattctaagggtgttcaggagctgaagtcagcctcaggcattgatttcctgttcatcggggtntccagggtaaccgggagcacancaatggcggctgccccgggcggcatgcgctggttcttcccc

SEQ ID NO: 717445 - DNA, 626 bp, Homo sapiens
tccagtgctagaggcgacgaggtggtgtgaatgttgaagaggtcttctcccacctgggtcatatgcatttgaccgagcgggcagatagagcggtagtgcagcagggtgccagtgtgtgtgctcgcagtgcggggcaggtgcctggagagcatggcagcccctgggagcctctgggccaggaagggcgatgtgcactgcaagtgtgccgtgtagcaggtggcctcatgctcagttgtgttcgactaggtgtcccgaaaggcactcactgtgtgtaggggatgttatgcaacacacggcgggaagccctgaatgcagttatctcagcaagcgtgtatcagaccccgacgtagccacatacaggttcaggaagcctcacaacagtgggcagcaatgaaccaccaacagcgacgcgccaaggaccaggtgggcaagtaggcagcctgcaagggccaagggccgatcatgggagccctaagcggccagtcgcaagatcagggagccaccgtaggaccgaataggaaaaagccagaaagagcacggcggcggcaaccgggatgtgcagcgaactcggaggacacctaccaccacggtcaccgtggtcttgagcaacgacccgttagagggac

SEQ ID NO: 717446 - DNA, 411 bp, Homo sapiens
ccgctctcagggctagtatctctggttgagaatatcaaggtgtcttctaatttccaatcattctccaggagcccagttatcattatcatgggtcactccctctgaaaaaaaaaaaaaaccaaaacggggtttggcttccccaccaattacgggatgaagccaaaaattcttaaaagcttcgctaattcaagcgggtcagctttatcaccgtgtctccactccaagaaaatatcccaaaggcaccgtgcatgcttccagatctatacacaagagggtacctcggcccagagcacccttcaagtcttctcaaacgggaacgctccaatttcccttcaagactcacaaatcggtcatctcggcttcagaaagagacacaacataccaggtccccccagacttggtaaaatagcc

SEQ ID NO: 717447 - DNA, 173 bp, Homo sapiens
tagaggaccccggtgggtaaacatccacattggcagtaggttccagtatctagctttaattaatttttagcaatgacattaacaagatttggccaggttataaaaatgagggctttctggagaattacataaagtacaagtttcccggctagggacatactaaaggtgctgaa

SEQ ID NO: 717448 - DNA, 118 bp, Homo sapiens
aaaaagccctgggtggggggggggggggtaatggcacagggatcccccattttattttggggccatccctgacttgccttttgtttaaaaaccgcctattaaatgtttttttttgaga

SEQ ID NO: 717449 - DNA, 239 bp, Homo sapiens
tctctgcgttctactatgtgatgacaccgaagttcagaaggtcatggaagactgtatgaggctgcatgtgaagttcagagtgctacgggaggagaacaagcagttcacggaagaagatggactgcggatgaggaagacagtgcagagcaacagccccatttcagcattagccccaactgggaaggaagaaggccttagcacccggctcttggctctggtggtaacgtgctttatcgttg

SEQ ID NO: 717450 - DNA, 1136 bp, Homo sapiens
gcgtgacgcgtgggtcgacccacgcgtcgggacaacatacaggaagccactgccaatgagctccgccgagatagcacctgtgggctagggctagctgcttaaaggagccgcgacccctttgcagaccagagggtgacccgtgatgatggctggcggtgctggcctagccctggccttgtggctactaatgccaccagtggaggtgggaggggcggtgccctcagacaatccaggacggtgagttcacgatacctgttgccgtgcggggaggaagcagtgtttctaccagtccgtgccggtcaaagcaagcctcgagaccgaataccatggtgatcggaggtgctggactggacgtggacttcaagactggagagccctcaggacgtgctgtaggtcagacgagtcccgcaaggctgatggggtacacacggtggagccaacggaggccgcggactacaaactgtgccattgacaactcctacagacaccatctacagaaaagcatggtgacctatgaactgctctatgacagcctccagggatgacgaaggaagctcgaacggatgagacacagctgcggacgccccgaagcacgcatgcttgacatgatcacgaattgcgaaggacattcacagaacagtaacactagagaaccaactgaataaccacagagaaggaccgcaaacactcacagaatgccaacagcaacaagtcaccacccatcacaaagagcacaatgaccagataacatgtcacaaactcaaaatagtacatatatgataaagtataagaataaaagaaaaaactgcgaggcagaagcatgatagaaagaagaaagatagacaaaccaatcaatatccagaataaagccattacaaagaacacagacaaacagaaaatgacaaaaagaaaggagcagagggggagagaaatacgacgctggctagacaaaagaagccagagaaagaaagcgaaagccgactacaagaaggaagactgaaaggtcagaggaaacaacggaaaaaacagacaaagaagaggaaacaaagccagcaaaaaggacacaacgctacaaagcaacgaggaacacaggggcaacaaacgtccggacacgccgacgcaaacgagaagaaaaa

SEQ ID NO: 717451 - DNA, 367 bp, Homo sapiens
aatagagaccagtaaattgtatagcagtgttgaatatttgggttcgggtggtttctattagaattatggtgagctcaggtgattgataatcttgatgcgaagtaataagggatgtgttaaggagtggacttctagggaattaagggggttgatgccttttgggggccagtgccctcctaatgggggggtaggggctaggctggagtggtaaaaggctcagaaaaattcctgcgaaaaaaaaaatttctgaggtaataattagggatttatcccgtattcgaaggcttttttggacaggtggtgtgtggtggccttggtatgtgctttctcgtgttacatcgcgccatcattgcaacacggtctctca

SEQ ID NO: 717452 - DNA, 131 bp, Homo sapiens
ggtcctttgaaaggaaaacccccttttttgggaccccccggttttttttaaaaaatattttgaaataaaaggaaatttttttagccctccccccccaggaataaaaaaaaacttttttttttgttcctgga

SEQ ID NO: 717453 - DNA, 269 bp, Homo sapiens
ttacatcacagaggcgccaccagaagtgccggcctagctcttaggaagaagtaatagagtttttggattcccaggcaagatggcagaacaggaacagctccggtctgcagctcccagtgagaccaaggcagaaggcaggtgatttctgcatttccaactgaggtacccggttcatctcattgggactggttagaccgtgggtgcagcccatggagggccagcagaagcaggatggggcgtcgccttcacctgggaggcgcaaggggtca

SEQ ID NO: 717454 - DNA, 115 bp, Homo sapiens
aggatggcatctgcgtcagagtgattcagtcccctttcttagtatcgtgtggtgaatcagcactttcctcttctgcctattctctgcggtacccgtagctcgatacttcgttaat

SEQ ID NO: 717455 - DNA, 711 bp, Homo sapiens
tcgagccgtggcaccggaatcgcctgacactgctgcctccagctagttatttcgctgcctcttccgttcttcaccgccgtacaccttggtaggtgaacttctcaccgtgagtggctgtaaatgactcgttgtgaagaatggagagccaagataccaacggaagtcttctcaggaatggtgaaacagtatatcatttcagaggagttaatttcagaaggcaaatagtggtgtcatgcttgtaacaaacaacgtatatggatcctactggttaaactagaatttgggaatcagtgaaacgtacaaaccgaggaaagagcagactgcgcgatggtgtctggcggtcatccccgtgctgcagagaacacttcatctatgtagttgtatcgttctggtgaatacatgttccgaccaccaatgggtgggctactgcgtagagttccctgcaggtctcatagatgatggtgaaacccctagaagctagctgctctccgggagctttgaacgaagaaaggtggctacaaaggggacattgcgaatgttctccagcggtctgtatggacccaggcttgtgaaatctgtactatacacattgtgacatgtcaccattaacggagatgatgccgaaaaacgcaaggcgaagccaaagcatgggaatggaaagttgtggaagtcatttctaaacccaagaatgactggtgcaagacttgttgc

SEQ ID NO: 717456 - DNA, 205 bp, Homo sapiens
  misc_feature (143)..(143): n is a, c, g, or t
  misc_feature (149)..(149): n is a, c, g, or t
aacaagtccagaaaccccaagatgtctgtagagaatggttaagttgcgttaatacctttgtcttcaccattcctgatgaagagggaaagggtagcacccccaatcactgcatgggctcttttgtcggagttaacttctaaggntttctncctccaacctttacgcagaacacaccaaatttgagtttctatctcaaacatagaga

SEQ ID NO: 717457 - DNA, 489 bp, Homo sapiens
aaacagcaggatctgaatagagtacggaggatcacccaagtcagagtaccaagggccatggtcaagattccccggggacatccctcatcagatccacccattaaagatcattgtcacccagtggagagtggactaggtgggtgcactcaggtgtggcctggacagcattcgggacgggtcctagtggttagggtgagggtcaggttgcattatcgtgaaggaggcaagtggcagctgaggcagatctgagggaaatgataataacgcaggccggtgatgcaatgggtttggtaagaagaggaaagaggtttgtggtggattccagtgtttctaatctgaggcttgggtgaggtcattaacaaataagaaagagtacatgggcataaatggctttaagacttaggaacctgaatgtgctattggagacagtatggggcacgtcattgctcatagacctgcagtacacaaaatgctaaaagatttcactct

SEQ ID NO: 717458 - DNA, 313 bp, Homo sapiens
attcgacgtgacatgctgttcgcctcctaaaagaacaccatgtgccaagcagaatgaacgcaatggagctgcatggaaaagaggatggctgatgaggctatcactgcagcgacctgcctgacagaagctttggtggatcacctcaaatgtggtgtgtggcccagtgcctacattgaaccatgatgtgaagctggaccatgatggtgaatgaccctatatgtgtccagtgctgcccaaatttgccaatgcagacatggccatgtgtgatctgtgaattgggttgcatggtgtacctgagcatcgaattctgtaa

SEQ ID NO: 717459 - DNA, 171 bp, Homo sapiens
cctggcgggagtgatgaagtatcgggtccttagagggttgcgtcacgtgtggggcatttgtgtccgagaccggcacgccaggaccattggccgccgtggccgcaccgtgggtgtgaccaagaagaaataagtctgtaggccttgtcttgtaataaatagtttttatcccta

SEQ ID NO: 717460 - DNA, 411 bp, Homo sapiens
tagactagcgtctctgcagtattgcgtcacgagtacactcaatctcatttcccctgagtatgatacgcgtcaaatatccctgtctgtcagtgctatagagggtctgtgagtcccggatcacttgtcagtgctgaccatgaagtggactgtccctatagtatggtcttgatcggtctcagcaatcgagctcatctggcgtcagctggattgatcttgtatcaaccatttccccatggcgtccgactcattctgaggcagagtggatgtcgcttccaatggcagcgtcgctacaggcagtatccgccaggtggttgtcaatgtagtcggtcagttcgggcattggactgcatgtggcgctactcagagagcgatagcagggtcctcggactgagctatagctgacgctgacgg

SEQ ID NO: 717461 - DNA, 865 bp, Homo sapiens
  misc_feature (103)..(103): n is a, c, g, or t
gttagaaagaatgctgtgatttacctataggcaaaagtttaaatgccttaactgtagacaaaagttaaaatatcttacttttttaaaaatttcattgccaaantgctttcccaaagaatgtgccaatatgtgaacatggccatttcattctaccttccccatcgttggttttttttttaatggctggctattttaatagtgaaaaatgatgtcacatttttatggcatttctcaattacgtggtgggccatattcccatatattaatcatagtatttggtatctggtaaacattcttttaatgtccttggcccatttattcattgacgaatttcacagatttttttctcatccgttttatgagctccgtgattaacaacctcctttatagcatcttattggaatattttaatcaggctggttgctttcagcataatggggattcggtatagaccaatctatggataatttcttggtgatggttcattatttctaattaaatagccttccacctgaagacttacaaatattttgaaattcttcggcgggtctaatgacttcctggtccaggtttcctttcacttggtcacgggtatcacttgcaagtgagtgttaccctgaaccttttttcccaatttcctcatctcatttatggagtctttcctttcccttgggtccggattctcctttccacagtctaacactggttttggagaaaattacgagtgttgctaaggccacggttgctaacccctttaatcggataatctcaatctactcctgcaaaaacaacctgtgtagggacatagagacaccggaacctaaatacggtgaaactgacacagctagcaagataagcgttgccc

SEQ ID NO: 717462 - DNA, 1212 bp, Homo sapiens
gaataaatttcattgctaggtgatgacaagcgcatcaggaggtcaacataggacaagcatcagacatggagggaaaagaggccaaagctgctgatactgtcatgcggcctgtctggaggggctgaggcttcgcgcctcggcaggctgcagcaggaggcagggtaaatcggtcaggcactacaggtctctcccgattccgcagacgtaaaccgttccccctcctgccagggagcagcaatagtcgtaggcaagtcgagcacggtgccttgtgcacctcgtaggttagacactctcttggaggttcgcctagctagttagctcattatctcatcgttccggtggtccattgccggatagcaccacatgcactagttcgtcaggttccaccgagggtacctgtgagactaggggacaccacggcatacgacagacccagaaggatacacgggtcccgaacatggctagactatcctggcaagcccgtcttcattactcgttgcacagggccacaagctagacccccttggaggggagttggatagagcacacataggtacttgatgattaccatgggcgagcacaccaatatctgatcagccgcactgaggcgggtcacgacttggaaacagagtcccagatcaagatggtaccacggcgaacgccctgggccgatgaaaaggcgtgccattggttgaatcgactacattgggtcatttcttccgacacactccccccaacggatagcgcgcttgggtacaagctccaattggactcctttgggtcattcgcggatggggtagaacacatcgcctgagcggatgacatacagctagggccgcgcacagacctcccatttgcggcttggacagcaggtggcgatgccaaaacaccttaaaaacaggggttaccctcagttcccatgccccctctcctgtaacacagctaccttcccattttgtcgcttggctcgtgagccagaggcgttgcgggccccacagggcgaccaaatgtgattcgcaccacgagagccaccttcgggcctgaatgtttggcgcaccccacaacttagcacagcggacaactcagattaccacaacacaacatgtgccaacgctcaggaaatatccatctcctatcacaaaccacttgggagacagagggcgtcgatacacctccacacaatagactagcacgcactcagcattgagacag

SEQ ID NO: 717463 - DNA, 710 bp, Homo sapiens
  misc_feature (331)..(331): n is a, c, g, or t
ggagagaactagtctcgagttttgaggtgtgtgtttcctatttatacaaatttttttattatatttaattcaggatgacaagccatcggggggtcaacaacacaagcccagacggagggaaagaggccaaacggctgaagtgtcagcggccgtgtcgggaggggctgaggcttcggcctcgggaggctgaagcaggaggcagggaaccggtcgaggcatacgggtcctcccgatccgcagagataaacctccccctcctgtgcaggagagcaaagtttgaggaagttgagagggccttggtgcaccttgcgggggtaaaacctcttggggngttcgccagtgtgatagcctcattatttcagtgtggggcgtcaatgcgcgaacacccattgtaacgtgttgtagttccacgagtgacgtggggcagggaccatgtaaggaaagccaggggaaagggctccgacagtcagcatcgtggaccctctcaataggtggtgaaggcaggatagcccttgggggttgtgttgcccttgtcggggatccggggggccccattggtagccacggggggtcagcttgtaggccgtcagggtacaggagcctggcgtgaagctgcttgtgatgataagggacttctcgcaatcccaagaaggggttgtcagccagtgatctgggcaggggtggggacactccggggggggaaaacgggg

SEQ ID NO: 717464 - DNA, 757 bp, Homo sapiens
  misc_feature (498)..(498): n is a, c, g, or t
tctctcactcgctctcgctcactctctcgcgcctggcatctattgcaaatctcaaaggccctgcatggaccaccatggcttatgatgactccgtgatgaaagaagattgtttagatggtgatcatacctttgaggacataggatttgcagctggccgaatccaacgagagaaaaaacgtccttactaaagattttttaagggaagaggaagaaattgctgctcaggtcaggaattcttccagagaagaagttgagaggatagtgaactttacttcattggggacaggaacagagcagagaagaagaggaagcactcctctgatgattactactatggagatatttcgtcgttgtggagatcgtcgacgaggagaggaaacgagagaagaagagtccagcccacaggtctacgtgatacagctataggacctgcttgaaagcgtatcagatccccacgtgacagcagagctccaatgccctccaaagaagactggggangaaatcctctgtgctcttcaagccattacggagagtaaaaaggagcaccacaggaacgaaaagtcagtggcaagcagcggggaactacccctagaggatggtgtctcccacaaatcgcacaaaaatgaaacctctctatgtgaacacagagacactgtaccttcgggagcctgatggttagagaagtgaagacttattctgtcaccaaaggagaagggaagcagctctgttgatgaggagtcttttcaatatcctccca

SEQ ID NO: 717465 - DNA, 1376 bp, Homo sapiens
gctcaccctggaagtaacccatcgagcacgggatctgtccgctaagctgggacagacgagtggagaaaatctgggaccagcaaccttctacaagttgagtctgcgatgtggcgtcccggaggtagtcactctccggtgtctgtctggaccgaggacccccactgtaacgctcgcgaaggcacatactcgcgatgaacgaatgtagcccagatcatagtttgtagacctgtcaacatcctcgagccactgattacgctattgacatatccaagaggcatggtagcctagtccacgtgatacctgccttgcttgggccaggtatccgacgtgaggacattgctgttgactgtgagcatcacaggcttgtagctgtgggttctacacgctagctatcatgatgccctcactcgtaacagaagggtgggctactagcacgcgtcctcgctcgactggcacagtttccctgcctggtcttgggcaaccttgggacgtcgcgaacactgcgggaaactctttgcatcgttgaccgtatctcctacattcgcataggatacccttctaacacgtaagaccgccgggacttaccaagggctattcacctctacccgaagctgaggccccggaacggcggggtgacaatattgctggtggctgatcgtagactttcacaggggagggataggactcgttgccataccggttcttgcacctgtggtaggagctattccgtatgacctagtggaagactcgtgaccccattgtggcgattgtcgttcccatggtctcacattccccattgagtatgcatacgcatgccttagctggactgacgttgcccgtgaggacctgtgcgccacaggtgtccacatacaagcccaaattattgcgccaaatgtgggatagcctgcggtctctcccagggttggccccttttgaaacgtgcgatccgtcctttgttcaccatagcgctcgttgtcccctgttctcatttggggggcatttgtgggaccgtttccgtttggttgtggcaaattcccaatttgaacaacaagttaacactttttccaaactttcgcgattacgattcgacacgggttgtttgaactcgttggtgaaccatttcctccggccaaaaaggaatccccttggtgaacacgacccaaatctagcgaagtgtggcctatggtacttgagacggggtgagagccccaccccaattgtgtaagccccctgggggggaatgtgggcgcgagacggagagattttgcacggagatgtggaaatattatcacttcgggcccctggggcgacccccagagagtaacattgggagcactccaacgaaacacatttgtgtgtcatcaccttaagaggcg

SEQ ID NO: 717466 - DNA, 161 bp, Homo sapiens
tactatccctctcatttttcattttgaagaaaggtaagaaccctgttaccctccaatgttgaattactgaaggtcaaattctagtgcctataaactttgataatgtcttataatttactattttttacaggtgctacagttttttgtttgtttgtttgttt

SEQ ID NO: 717467 - DNA, 1530 bp, Homo sapiens
atcgccaatcaggacggctcgttctacttcatggagatgaacacccggctgcaggtcgagcacccggtgaccgagatgatcaccggccaggacctggtcgaatggcaactgcgcgtggcgccggcgagccgctgccgctgtcgcaggagcagctccgcatcgacggccatgcgctcgaggcgcgcgtcctacgcgagaatcccggacaagcagttcctgccgtcgaccggcacgctgcgtactgacctgcgcgacgcggtccgagtgagttatgcgggcgaagacgtgcacgaccgcggtggatgtggcgtccaggatggataccatagacatatcatatctgatcagcccgtattacgaccgcattgattgccaagctcatcgtctggggcaaggatcgcgacgagctggcgcgcatgcggcaggcgctcgccgcctatctcgtggtcggcctgtcgaccaatatcgccttctgcagcggctggtggcctcggagccgttcgccagggcggacctcgacaccggcctgatcgcgcgccatgaggccacgctgttcgcgccaccggcgcggtcggcatggagctgatcgcgctggcggaggccgcgctgctcgacgccgagacgcgcgaagggatcgatgccgcggatccacattggccatggacccatgccggcccgtggcggctgaaccgggcgcgcagcgggtgctgcttcgcgcatggcaccgacacgctggaggtcacgctgcaggcgcacgcgcgagggcaggcacgctgttctatgccgaccaggccgcgccgttccgcacgcattgcgttcggccgacggaacggtccaggacgatctcggcacgcgccggcgcgcgaacggccaggtgcatcgcgacgccgattcttccatgtgttcgccggcggacgcacgtcgcgctggaatggcaggaacccgtggcgcaggtcggtcaggtggatacgtggatattcttgtgcttgatagggagtttatgagtaccaacactatcaactccaccacgacgagcgcaatacccagcgccaacttgccgttatggtccaccggcgccaccgtcacgcgcacgccgctgctgtgatgagcgatgaagatgacacaccatcagcgcccgcacggcgtcgtcggcgaagtgctgtatggggtcggcgaccaggtcggcgaaggcgagcagttgctcggcttcgaggccaaggcgggttgaacttcgcgggcagggcgtgcggtacttgcgttgcgaaatgcaagattcgcttgccttcccgcaagccggctgcggcgtcgcgttgacaatggcccgatgccttgtcttcgcgaggcgggtgcccgggtgccccgcctgacatcgagcccacggcatcggcgctcgggttccccggggcgggcgccatcggcaggtcggcaccggaccgcatggcttcgcggcacgaggaaatcctcttcggcacatcctgagtttcccatgccccgatcaccctcgacgcctgcgcaccgccgccatgcaac

SEQ ID NO: 717468 - DNA, 759 bp, Homo sapiens
  misc_feature (15)..(15): n is a, c, g, or t
  misc_feature (17)..(17): n is a, c, g, or t
  misc_feature (19)..(20): n is a, c, g, or t
  misc_feature (22)..(22): n is a, c, g, or t
  misc_feature (325)..(325): n is a, c, g, or t
  misc_feature (437)..(437): n is a, c, g, or t
  misc_feature (481)..(481): n is a, c, g, or t
  misc_feature (484)..(484): n is a, c, g, or t
  misc_feature (489)..(489): n is a, c, g, or t
  misc_feature (505)..(505): n is a, c, g, or t
  misc_feature (509)..(509): n is a, c, g, or t
  misc_feature (512)..(512): n is a, c, g, or t
  misc_feature (518)..(518): n is a, c, g, or t
  misc_feature (524)..(524): n is a, c, g, or t
  misc_feature (545)..(545): n is a, c, g, or t
  misc_feature (548)..(548): n is a, c, g, or t
  misc_feature (550)..(550): n is a, c, g, or t
  misc_feature (555)..(555): n is a, c, g, or t
  misc_feature (559)..(559): n is a, c, g, or t
  misc_feature (561)..(561): n is a, c, g, or t
  misc_feature (569)..(569): n is a, c, g, or t
cggacgggcgtgggncnanncntgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttaccnccctctctcctactcctgctcgcatctgctatagtggaggccggagcaaggaacaggttgaacagtctaccctcccttagcagggaactactcccacccttggaagcctccngtagacctaacccatcttctccttacacctagcaggtgtctccntcntatcnttaagggggccatcanattntcnatcacnaacaanttatcaattataaaacccccntgncnataancccnantaccaaangcccctcttcgtctgatccgtcctaatcacagcagtcctacttctcctatctctcccagtcctagctgtggcatcactatactactaacagactgtaactcaagacaccttcttcgacccgcggaggaggagaccccattctatacaacactattctgatttttcggtcacctgaagttatattcttatc

SEQ ID NO: 717469 - DNA, 1490 bp, Homo sapiens
atcgccaatcaggacggctcgttctacttcatggagatgaacacccggctgcaggtcgagcacccggtgaccgagatgatcaccggccaggacctggtcgaatggcaactgcgcgtggcgccggcgagccgctgccgctgtcgcaggagcagctccgcatcgacggccatgcgctcgaggcgcgcgtcctacgcgagaatcccggacaagcagttcctgccgtcgaccggcacgctgcgtactgacctgcgcgacgcggtccgagtgagttatgcgggcgaagacgtgcacggccccgccggcgtgcggatcgattcgggcgtgcgcgagggggatgcgatcagcccgtattacgaccgcattgattgccaagctcatcgtctggggcaaggatcgcgacgagctggcgcgcatgcggcaggcgctcgccgcctatctcgtggtcggcctgtcgaccaatatcgccttctgcagcggctggtggcctcggagccgttcgccagggcggacctcgacaccggcctgatcgcgcgccatgaggccacgctgttcgcgccaccggcgcggtcggcatggagctgatcgcgctggcggaggccgcgctgctcgacgccgagacgcgcgaagggatcgatgccgcggatccacattggccatggacccatgccggcccgtggcggctgaaccgggcgcgcagcgggtgctgcttcgcgcatggcaccgacacgctggaggtcacgctgcaggcgcacgcgcgagggcaggcacgctgttctatgccgaccaggccgcgccgttccgcacgcattgcgttcggccgacggaacggtccaggacgatctcggcacgcgccggcgcgcgaacggccaggtgcatcgcgacgccgattcttccatgtgttcgccggcggacgcacgtcgcgctggaatggcaggaacccgtggcgcaagcgggcgatgccgaagtcgaggtgcggcaagctgaccgcgccgatgccgggcaaggtgattgccgtgatggtcgagccggcgcggcgccaccgtcacgcgcacgccgctgctgtgatgagcgatgaagatgacacaccatcagcgcccgcacggcgtcgtcggcgaagtgctgtatggggtcggcgaccaggtcggcgaaggcgagcagttgctcggcttcgaggccaaggcgggttgaacttcgcgggcagggcgtgcggtacttgcgttgcgaaatgcaagattcgcttgccttcccgcaagccggctgcggcgtcgcgttgacaatggcccgatgccttgtcttcgcgaggcgggtgcccgggtgccccgcctgacatcgagcccacggcatcggcgctcgggttccccggggcgggcgccatcggcaggtcggcaccggaccgcatggcttcgcggcacgaggaaatcctcttcggcacatcctgagtttcccatgccccgatcaccctcgacgcctgcgcaccgccgccatgcaac

SEQ ID NO: 717470 - DNA, 846 bp, Homo sapiens
  misc_feature (15)..(15): n is a, c, g, or t
  misc_feature (17)..(17): n is a, c, g, or t
  misc_feature (19)..(20): n is a, c, g, or t
  misc_feature (22)..(22): n is a, c, g, or t
  misc_feature (325)..(325): n is a, c, g, or t
  misc_feature (437)..(437): n is a, c, g, or t
cggacgggcgtgggncnanncntgactattctctacaaaccacaaagacattggaacactatacctattattcggcgcatgagctggagtcctaggcacagctctaagcctccttattcgagccgagctgggccagccaggcaaccttctaggtaacgaccacatctacaacgttatcgtcacagcccatgcatttgtaataatcttcttcatagtaatacccatcataatcggaggctttggcaactgactagttcccctaataatcggtgcccccgatatggcgtttccccgcataaacaacataagcttctgactcttaccnccctctctcctactcctgctcgcatctgctatagtggaggccggagcaaggaacaggttgaacagtctaccctcccttagcagggaactactcccacccttggaagcctccngtagacctaacccatcttctccttacacctagcagggttctctatctaggggcatcatcatcacaaaatatatataaacccctgcctaaccaatacaaagcctcttcgtctgatcgtcctaatcaagagtctatctctatcttccatctagctgtgcacactatatataaagacgaactaaacacttttgaccgcggagagagaccatttatcacactatctgtttcggcaccgagttattctatcacagttggatatccatggcattattcggaaaagacttgtctaggtgcgcgtgaacatgtcagaatgggaaaccatatcggaaaagtacagaattccgaataagaacaggaattagccacagaatatagtgggccgtttacggcgtacccacccaggcaagttg

SEQ ID NO: 717471 - DNA, 193 bp, Homo sapiens
cgaccggttctcatcacatctgtcagaatctgctaacagtacaagaaaacagacacctattaaattaattaaactggtaagcttgtccttaagacagcaacctgtctgagggtccttcagaaagccccatttacaatttcataaaacttgtgttcggattgacaccttggtaataacgggtaaacatcttcac

SEQ ID NO: 717472 - DNA, 229 bp, Homo sapiens
  misc_feature (23)..(23): n is a, c, g, or t
  misc_feature (58)..(58): n is a, c, g, or t
  misc_feature (103)..(103): n is a, c, g, or t
  misc_feature (116)..(116): n is a, c, g, or t
  misc_feature (137)..(137): n is a, c, g, or t
  misc_feature (201)..(201): n is a, c, g, or t
acagaagccagagctatgtgttnattattccccatctagtctctccctccatctcagnaggaacccctttcttggctagttaaccctcaggtgttcaagaggncatatctctcatngggagaggtcaaactgggtgntagggcaagagctgtggctttcaaattataatacccttttctatgttaagagtggttgtgtccncacaggttactgctaatactggctgaat

SEQ ID NO: 717473 - DNA, 723 bp, Homo sapiens
caacacccggtaccctcaaactggtcaccgtgaaaacccccccttgttctcggtaattattcgaccccccctttattttcaccctgcgcttaagttgcatcattacttcttgtgtttttaaaaaccccgtttgtcactcccatcatcatgtttgaccccacctttttcaaatgacaccccccacccggggtgcttcttaaacaagcgcgcctctcttattatcaaaagttatataaataatataggtataccacccccccaatttcaattctaaataggatcccgtctctccacggatccccattagtacaacaacccgtcttcctaccttcaattccttgaaaaatcaaaggcttcttatctattagggaggattcttcctaccgggcatttttatcaaatgcaccccgccccgtcttagattattctaaacaatgttaatgacaccccccccccccccctttttctccgcgttattattattctagctctatgaccacaatctattgcgagtgcgtcttctctccccccaccgtcatattcgaaggagtggtctattttatcaacaaacattatttcaatcttgtttcttgccggcaatctgtatcataacacactccgtcgtgtcccccgttccccaaaataaacccccattatcctatacttgattcgtcccaaataaaacgctcaacaaactcctataagctctgcccaacaataaca

SEQ ID NO: 717474 - DNA, 224 bp, Homo sapiens
aacaaatctaccttggacggaacaggtacccctgatacagagacggccgtgtaggggctgccgggcctggtggtgtgctgggtactcctactggacgcagaccatataccctgcgtctggcgggtgcccgcaagctgatggcctcacagacactgcgccgaatgctagcccgtggacgagtacccgcccatcatgttcgaccagcaccccaacgagcagtacaa

SEQ ID NO: 717475 - DNA, 290 bp, Homo sapiens
aatctcggagtggtctgttgctcctgcacccgcgccgtggccgaaacactcagccccagcaacgccccagccacgcacaccctgaacaacccgttggaaataatcacgcagactccacagccaaattaaaaacaccgtgacgagggacagcttcgccaacacctcagttaagacgtaaataccgggaataatttagcagccgcagatggttattcggacatgccggtatgtctccaggatgttaccgacaaaatttctacatctcgcgcttcatgatttcggctgctcgt

SEQ ID NO: 717476 - DNA, 209 bp, Homo sapiens
ccgtcttatcttagtgatgtcttttcttctgcttgggttgagttgggtttgtcttgttctctagttccttggggtttgagcgttagattgtctatttgtgctcttgcagatttcgagatgtatggatttaatgctataaatgtgtctcctagcactggcttaagtgcaagccggagcagattcatttaggcgggtagctaagctcgaat

SEQ ID NO: 717477 - DNA, 183 bp, Homo sapiens
tcggtccccctctgatgaggcatatgtattttgaccctaaacctttatatctgtcctgcccttgaattacacatttgctaacttatgaaattaagcctgagtatccaacggttcatggcaattatctgaaatccatctccttcccctactcatcgcactaatttacactcacaacaccctagg

SEQ ID NO: 717478 - DNA, 547 bp, Homo sapiens
tgctgaggtgatctaaggatcccatgccaataacctcccccttatgccgcgccatggtggcttgcatcgagctcatcaactgttcgtgtgtgagttgcggcccaagatcgaggcgcggagggtaagccaattgcagaagatcggtttcaatggcggtcatggcgaaatgcggtgcgcctcctgagtgttaccagttgtgagcgactttaccgtaataaaacgcagcgctgtaaccgtacggcgaaaaagtgccactgggcattaatcaacgccgccactcgtcaggatctggacggttaatcccgctactgtcagccccggttcagcctgggcgggcgccatgccgtcaaactagcgcgcacataacgacccacttagccgttcattacatcgactatcgaggtcgccccatgaaaaaatttcgattgcctgggctgttgttcctggcccaagccaccaccgcgctggcgagcgaaaccccactcgccaacgacgacaaaggcttctggtacgcccagaccagtgtctacacggaggttattggcat

SEQ ID NO: 717479 - DNA, 1012 bp, Homo sapiens
  misc_feature (70)..(70): n is a, c, g, or t
  misc_feature (104)..(104): n is a, c, g, or t
  misc_feature (106)..(106): n is a, c, g, or t
  misc_feature (113)..(114): n is a, c, g, or t
  misc_feature (118)..(118): n is a, c, g, or t
  misc_feature (132)..(132): n is a, c, g, or t
  misc_feature (139)..(139): n is a, c, g, or t
  misc_feature (146)..(146): n is a, c, g, or t
  misc_feature (157)..(157): n is a, c, g, or t
  misc_feature (185)..(185): n is a, c, g, or t
  misc_feature (222)..(222): n is a, c, g, or t
  misc_feature (234)..(234): n is a, c, g, or t
  misc_feature (259)..(259): n is a, c, g, or t
  misc_feature (284)..(284): n is a, c, g, or t
  misc_feature (401)..(401): n is a, c, g, or t
  misc_feature (417)..(417): n is a, c, g, or t
  misc_feature (432)..(433): n is a, c, g, or t
  misc_feature (445)..(445): n is a, c, g, or t
  misc_feature (458)..(458): n is a, c, g, or t
  misc_feature (520)..(520): n is a, c, g, or t
  misc_feature (538)..(538): n is a, c, g, or t
  misc_feature (548)..(548): n is a, c, g, or t
  misc_feature (553)..(553): n is a, c, g, or t
  misc_feature (566)..(566): n is a, c, g, or t
  misc_feature (592)..(592): n is a, c, g, or t
  misc_feature (728)..(728): n is a, c, g, or t
  misc_feature (784)..(784): n is a, c, g, or t
  misc_feature (788)..(788): n is a, c, g, or t
  misc_feature (804)..(804): n is a, c, g, or t
agacaggcttgggagaaataccagaaagggattgttcaaagatggcattgtttaatccccgtgtggcccncggttgtgcaatcacagatgagccagaagaggtntngcccccnnccgngtttgggctccganactcttntcaaacntcaatttttantcttgggatagaaaaatagtatgtgctntctctaatacgctacttcgatatttattaaagaagtntttttaatgtantgtccacaggctcatttcattgaanacaactgactatgatgatagacagntcctgattggcaaaagttcaatggtatattcagaattaaattttgccgcgcacctaaacactgacaacatttagcttaaaggtttcccatggagaagagtggtaagagctgtagttngcaaaattggcagccnctttagggtgtcaannccgtgctgcttngcaaattgttganacttttgattttctgtttggcaatgctagtcagcgttcacctcttacagattagccaagaanctttatctaaatgcaganacttattaangaaanccatttaaactanacttacacaacatttcgggaggcccngctggcaaaattatatatggatgcagaagtattgcaagagtccattttccatttttaaatctgcaatatctgattacattgatgaattccgttgtattgtatgtgtgaatataaatatctgaattctcccgggggncttggttttcgtccaaggatgttggcagtggacacttagtttacctcaggaattgnaatnatgtaagactatattnggaaaaaatgctggagtatataattttggatactgatataaaattcatcagagatggagagttaatgcagaattggtcacgtgatagtgccataagcgactttatataatgcatatattcgtgtaattgtgtttgtaactagcaggcaacattttatatatcttgtcaagtgtagtcatgttaatagaaaaaaataagcaatgtcata

SEQ ID NO: 717480 - DNA, 1005 bp, Homo sapiens
  misc_feature (16)..(16): n is a, c, g, or t
  misc_feature (65)..(65): n is a, c, g, or t
  misc_feature (86)..(86): n is a, c, g, or t
  misc_feature (95)..(95): n is a, c, g, or t
  misc_feature (114)..(114): n is a, c, g, or t
  misc_feature (117)..(117): n is a, c, g, or t
  misc_feature (172)..(172): n is a, c, g, or t
  misc_feature (179)..(179): n is a, c, g, or t
  misc_feature (214)..(214): n is a, c, g, or t
  misc_feature (223)..(223): n is a, c, g, or t
  misc_feature (246)..(248): n is a, c, g, or t
  misc_feature (250)..(253): n is a, c, g, or t
  misc_feature (264)..(264): n is a, c, g, or t
  misc_feature (267)..(267): n is a, c, g, or t
  misc_feature (280)..(280): n is a, c, g, or t
  misc_feature (284)..(284): n is a, c, g, or t
  misc_feature (294)..(294): n is a, c, g, or t
  misc_feature (302)..(302): n is a, c, g, or t
  misc_feature (304)..(304): n is a, c, g, or t
  misc_feature (307)..(308): n is a, c, g, or t
  misc_feature (313)..(315): n is a, c, g, or t
  misc_feature (317)..(317): n is a, c, g, or t
  misc_feature (321)..(321): n is a, c, g, or t
  misc_feature (327)..(327): n is a, c, g, or t
  misc_feature (330)..(331): n is a, c, g, or t
  misc_feature (340)..(340): n is a, c, g, or t
  misc_feature (358)..(358): n is a, c, g, or t
  misc_feature (366)..(366): n is a, c, g, or t
  misc_feature (375)..(375): n is a, c, g, or t
  misc_feature (393)..(393): n is a, c, g, or t
  misc_feature (468)..(468): n is a, c, g, or t
  misc_feature (479)..(480): n is a, c, g, or t
  misc_feature (752)..(752): n is a, c, g, or t
  misc_feature (768)..(768): n is a, c, g, or t
  misc_feature (773)..(774): n is a, c, g, or t
  misc_feature (777)..(777): n is a, c, g, or t
  misc_feature (782)..(782): n is a, c, g, or t
  misc_feature (784)..(785): n is a, c, g, or t
  misc_feature (793)..(793): n is a, c, g, or t
  misc_feature (822)..(822): n is a, c, g, or t
  misc_feature (849)..(849): n is a, c, g, or t
  misc_feature (916)..(916): n is a, c, g, or t
  misc_feature (937)..(937): n is a, c, g, or t
  misc_feature (987)..(987): n is a, c, g, or t
taagtaatctagatgntgatttaaagtatatgggagaatgtatgtagattatatggaaatatganggtattttatttaaagggacntgggcctgntggataccaaggaataacnaanggtaaaactgagcataagtggcctgtccatattttgttaaatatcagattattgntttgtgntcatcaacattttcccgcattcatgcagtgcggcntctgaaaanatggttgaacatcctatggaatnnncnnnnttttttgaganggngtctcactctggnaccnaggcgagagngcaatggngnganntgggnnnanggcnaccgcngcnngcgccaccncgggttcaagtgattctnctgcctcngcctccggngtacctgggactacaggnatgcaccaccacgcccggctaatttttgtatttttagacgagacagggtttcaccctgttggccaggctggtctnaaactcctaanntcgaggtgatccaactgcctcggcctcccaaagtgctgggattacaggtatgagccaccgtgcccagcagaattttttaactatttggttacgactaatttggataatgtagtgcatgcagctttgatttgtgccactaagagtgggcaaactgtcttcctttttgtgaatcagtaaaaattttccctcaacatgtgtttgacagttgtcattcactgctaagttaaggcatttggtaaaccacacagcctctgcatccttcctagcgacancacaagaaaagttggntatgnnttnttttntnntcttgtgnattgaactggaggcaagccccacttttcnttagaaaaagaagtagaacaaaaaacnaatattttcttccttgctcgatttctgtgccttcatggtacacaaaataataggacagtaatggcanaatctgttgactgctgttacntcgcccaatattcttaagcattcttagcactagctgtgtttgtaaattanagattcttaagtatgtag

SEQ ID NO: 717481 - DNA, 230 bp, Homo sapiens
  misc_feature (37)..(37): n is a, c, g, or t
  misc_feature (119)..(119): n is a, c, g, or t
  misc_feature (122)..(122): n is a, c, g, or t
  misc_feature (151)..(152): n is a, c, g, or t
  misc_feature (197)..(197): n is a, c, g, or t
  misc_feature (206)..(206): n is a, c, g, or t
ggttttggtgttaggataatactggcttcatagaatnatttaggaaggattccctctttctctatcttgtggaatagtgtcaataggattggtaccaattgtttgaatgtctgataganttnagctgtgaatctgtctggtactgaacatnntttgttggtggtggtggtaactttttaattaccatttcaatcttnctgcttggnattggtctgttcagagtttctatt

SEQ ID NO: 717482 - DNA, 333 bp, Homo sapiens
caaatagggcagacaggatgtaaacccgagagagcagagagtggcggtctagagctcagccccctcagagcattccacagaccctgccttattctagctggtgagatagccataggaaacaatgattaagatgcatgtacagagtttctccttacaaatgagatgagggttatggagaggaggccattccaggggagagaatgtgccagggcacagcctagagtcatgagcctctgcaggaggcgtgtggaaatgcaatgagggtgtggaaatgcaatgaggctaaagtgggaggtgctggcaactaaaactactagggggattgggtccaga

SEQ ID NO: 717483 - DNA, 903 bp, Homo sapiens
  misc_feature (264)..(264): n is a, c, g, or t
  misc_feature (280)..(280): n is a, c, g, or t
  misc_feature (284)..(284): n is a, c, g, or t
  misc_feature (305)..(305): n is a, c, g, or t
  misc_feature (398)..(398): n is a, c, g, or t
  misc_feature (418)..(418): n is a, c, g, or t
  misc_feature (483)..(483): n is a, c, g, or t
  misc_feature (494)..(494): n is a, c, g, or t
gaatccccctggcacaccccaaagaggggtccctgctccgtctcacagggatcttttgtatatttggcttagcatcatacatttgccatgttgtttcatcatctgcctaatttactgttttgaatatttcatttgtttctaattgttactacagataatgctggggtgagcaactctgtgtacataggtttatctcctattgaatattttctttatataggcgttttttttttccttttttttgggagaacagagtctggctcntgtggcccaggctggnagtngcagttggcgcgacgggagcntcacttgcaacctccacttcccgggttcaagtgatgtgtcccacctcagcctcctgaatagctggggattataggtgcttgctaccatgccgnggctacttttggtattttangcagagacagggtttcaccatgtggccagggtggtctcgaactcctgacctcaagtgatccgtcnggccagcattngggaggccaaggcaggcagaacacttgaaggagttcaagaccagcgtggccaacgtggtgaaacccggtctctactaaaattacaaaaatggttagctctgtttccataatagaagtgaagggtacagtgtttctttgaaagaacaggtttgttcctccaagaaggttgggctgaatcgaggggctgcctggtatggggtttaaaaacctgtatatgggtggggccaaaaggagcaagcaatctgtttggaattactggtcggccaatgtgaataattggggtggaaacactttgacccttgcagtaatgggtaaagagtgattttgtggcgtagaagtacacccaagatttttgtgtctcagctaagtttttacgaaggggagtgtatgtacccacatgtcgaacggg

SEQ ID NO: 717484 - DNA, 252 bp, Homo sapiens
ttgtcctacgctcagctgggtgacagaggtgaccctatctcaaaaagaacaaaaaaaatttcagctgggtgtggtggcatgtgcctgtagtcccatatacttgggagactgagtcaggaggattgactgagcccaagagatggaggttgcagtgagccgagatcacgccactgcactccagcctgggtgacagtgccagaccctgtctcagaacacaaaacacaaaaatttcacagtgggagacgcgcgggg

SEQ ID NO: 717485 - DNA, 541 bp, Homo sapiens
atgacaatagatctgcatgttctagcaggcaatgctcggcatttgcattgaaatccagctcggggtttgccttctgggcattatgctaaattatagtgtttccattcttttatctttgttttaagctttaatgaaccacttctgatgaactgatctgcttttgtgaattagggatataatgcgacataatgacaacaagcccaaccaacgcatttaacaagcaaaagcactaacatgaaaatggtgtggaagtgcattagccaagaggaccagcatcctgttaagtagcaattactgaaacaaattaaatgaggagataatctaagaatatatcagatcataacaatgataaggagactgtcaagtggtcaagcagtctataagcagtagcatggtagcagctgctaaattggcttgtcttccatagactcagcaagtaagaagcccagatggatttagacagtttagtatttactggaaaagaaagtcagcatggtgtcagctccctgtatccctagtatcacagcatgacaccaaacag

SEQ ID NO: 717486 - DNA, 970 bp, Homo sapiens
  misc_feature (237)..(237): n is a, c, g, or t
cagataccggtgttttattattggtcggcggccacatgtggcccttttctccgtgggaccttcttggggcggccaaaagtactcatttcaggggtccctcccaagatctctggcaagggccctggatggggaccctttaggtgccccggcaggatcgcgtgaggaggaacccagagacacagtcggggccagcggacacagtagctccgggacatagtgggtcaaccttctcttctncacgctgttgcaagagatgatcttcctgctggaaccgccttgggctctccaccaacgcgaagtcacttccaggattccggaggcggacctttactcagccaaaccgccggaccacgtcctaatcctccgctgatgcctccagtgctggtgctaccgctgaccacagagaggctcacggcactctggcattctccagacattctgtactcctcgccgtccacgcagttttgcgctagtgtgcgatctcgatgtccaaggccagcttcacactcatgagctcctggtactcacgcagcatttctgacagctcctcgttggcctgtgcagggcagcctccagctctacgcgatatgctgtgggcatcaataaggcatatctcaccatcggcccgctgtgcatcagccacggagacctgaagagtcacggcactgcgttcttgatgttctcgatctcttgcccgcagcctgtggatcatcaagttgagctccgcaatactcactctttggcgttcttcaggttgtcaccagtgattggtcaacggagatctggacctgctggaccttggtctggtacagggcttcagcctcagcgatgctcctctgggcaatctcctcgtactgggcacggacctcggcaatatgctcacccagttccagtcgcggttgttgtccatggaaaggaccacggacgtatcgctgacatgggtctgcatctgggacagaatccggatcaa

SEQ ID NO: 717487 - DNA, 415 bp, Homo sapiens
ttcacctggcacctctatcctgtaattgcacatcatggcagcagggctgtgatttcagaggtactccctaagtgttctagcaatatgattatggagtgtgattcagtgtacatgctgattgtctttgcctcggtcctatatccccttgtctttagaaatcccatcctgccttgtgatatttagaagcacaagtacgttaaacaagtgctaaacgctctggaaagcatggctttattttcttaatggatgtcttggtgtgtaggagcatgcatttgtaggcaccacaatccggatacttctgacacagaagtgatgctagaatgtgtctatagattgtattgctagcatccagactttctagtttgtccagatttcgatttgatcaattttcttgtccaataaaaaagcatttcca

SEQ ID NO: 717488 - DNA, 204 bp, Homo sapiens
tggagatgcgaaaagagaccaggcacagaaagctgcaggtgctggagatgccaagatgaagtgtgtgtataagtagataactgtatactatctggtgactgtacagttcgaaatactatttatttctcaagttttataaaaatgcagaattttgttttactttttttttttttaaaaagacaatgtggatcaagcacaacagaa

SEQ ID NO: 717489 - DNA, 456 bp, Homo sapiens
ttcacctggcacctctatcctgtaattgcacatcatggcagcagggctgtgatttcagaggtactccctaagtgttctagcaatatgattatggagtgtgattcagtgtacatgctgattgtctttgcctcggtcctatatccccttgtctttagaaatcccatcctgccttgtgatatttagaagcacaagtacgttaaacaagtgctaaacgctctggaaagcatggctttattttcttaatggatgtcttggtgtgtaggagcatgcatttgtaggcaccacaatccggatacttctgacacagaagtgatgctagaatgtgtctatagattgtattgctagcatccagactttctagtttgtccagatttcgatttgatcaattttcttgtccaataaaaaagcatttccaaatctctacttatccttttatatgacaccccaatagatttt

SEQ ID NO: 717490 - DNA, 455 bp, Homo sapiens
ttattgttccactgagacaatacaacaatctggataggcacggtggccggacgcctagtaatcccagctactcaggaggctagaggcaggagaattgcttgaacctgggaggtgcaggttgcagtgagctgagatcatgccactggactccagcctgagtgacagagcaagactccgtctcgaaaaaaaaaaacaaaaaatatatgtgctactttcttaactggtaatccccacctccgagtggatcttaacaacataaacttttagctcatatttataatttaccttccctggcaacctaactggttgatcctgacctctctatgggcactctaataatccttgttcaccccttgccaaacgggtgtccctaatacggcccggccatattacccactttccttatcaaacccccgtgcatacgggcactatatcaaaacgtacttgaggcattg

SEQ ID NO: 717491 - DNA, 613 bp, Homo sapiens
  misc_feature (18)..(18): n is a, c, g, or t
  misc_feature (67)..(67): n is a, c, g, or t
  misc_feature (69)..(69): n is a, c, g, or t
  misc_feature (86)..(86): n is a, c, g, or t
  misc_feature (90)..(90): n is a, c, g, or t
  misc_feature (97)..(97): n is a, c, g, or t
  misc_feature (100)..(100): n is a, c, g, or t
  misc_feature (105)..(105): n is a, c, g, or t
  misc_feature (107)..(107): n is a, c, g, or t
  misc_feature (120)..(120): n is a, c, g, or t
  misc_feature (129)..(129): n is a, c, g, or t
  misc_feature (141)..(141): n is a, c, g, or t
  misc_feature (155)..(155): n is a, c, g, or t
  misc_feature (157)..(157): n is a, c, g, or t
  misc_feature (162)..(162): n is a, c, g, or t
  misc_feature (164)..(164): n is a, c, g, or t
  misc_feature (170)..(170): n is a, c, g, or t
  misc_feature (234)..(234): n is a, c, g, or t
  misc_feature (253)..(253): n is a, c, g, or t
  misc_feature (255)..(255): n is a, c, g, or t
  misc_feature (282)..(282): n is a, c, g, or t
  misc_feature (305)..(305): n is a, c, g, or t
  misc_feature (325)..(326): n is a, c, g, or t
  misc_feature (328)..(329): n is a, c, g, or t
  misc_feature (345)..(345): n is a, c, g, or t
  misc_feature (350)..(350): n is a, c, g, or t
  misc_feature (353)..(353): n is a, c, g, or t
  misc_feature (356)..(356): n is a, c, g, or t
  misc_feature (415)..(415): n is a, c, g, or t
  misc_feature (482)..(482): n is a, c, g, or t
  misc_feature (490)..(490): n is a, c, g, or t
  misc_feature (534)..(534): n is a, c, g, or t
  misc_feature (598)..(598): n is a, c, g, or t
acaatttttatagaattnacattttgcaaaatgcaacaaacattttaatttatactatgaaaaatantnagttttcaaaagttgtnttcntttcaanttntttcntnttatttttgacanaatttctgnaggtaaaacatntttaaattttaccntnattancntgctcnttttatttaaaatcatgacaaaaatcttctctctttgtcatgtttcccattactaatattactnttatgttgtacttttagancnatatctcaatacaccataaatcccatngtatttttgttttcttcttgatnttaaagctgtttttctttgnntnnatgcagcagcaaaacncaaancanttnttcaaaaagcacttctgcctataactccaataattttcaggacacatcaaccgacagtngttttgccacttcccagttcttttaaggattacatctctgcacttttgccttgaatggacgtctgtnaaagcttnttctctgcttaagccagtttactgtctacagcctgtgttcgtanaaatttagttggtgtggtccatttatctagtgcagtatatcgtgcaccacccctcttctgatgntccagttcaaggagt

SEQ ID NO: 717492 - DNA, 124 bp, Homo sapiens
tgcttcttgtgctcgtgtggttcttgtcatggttatcttgttgcccaagaaaagaactctgctgtccagtgcactgcttggttactatcccagcaaagaactgggtacctgtgctctgaattct

SEQ ID NO: 717493 - DNA, 205 bp, Homo sapiens
catacaatcgacgctcgtaccttccaggcttgattgcaggcttcacaaagctacttcagagactataagttggaagtcctagtatagagtccttatgaaagcgactgttaatgcgtccgtaattggattcggctaggcagtatactaatgaggatattagtccgtgtgcgattctgagaatgactgtgccagtgactcttccggt

SEQ ID NO: 717494 - DNA, 405 bp, Homo sapiens
tcctgtgacgattctcagatctagaactaaaataccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacacatacaccatggaatactatgcggccataaaaaatgatgagttcatatcctttgtagggacatggatgaaattggaaaccatcattctcagcaaactatcgcaagaacaaaaaaccaaacaccgcatattctcactcataggtgggaattgaacaatgagatcacatggccactcaatacggtattgaatggccactca

SEQ ID NO: 717495 - DNA, 498 bp, Homo sapiens
tgcgctgggatatagtaccgtaagggagatgatgaaaattataagcaagcataattatacatggactaacccctatatcttctgcatatgaattaactagaaataactttgcaaggagagccaacagctaaagtacccccggataaccacgacgacgctacctaagcaacagtctataaagagcacaccctgtctatggtagcataatagttgggaagatttataggtagacggcgacaaacctaccgagcctggttatagctggttgttctctataataatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacctaaaaaatcccaaacatataactga

SEQ ID NO: 717496 - DNA, 169 bp, Homo sapiens
  misc_feature (23)..(23): n is a, c, g, or t
  misc_feature (166)..(166): n is a, c, g, or t
tcggccgtagcagcgcacattantgaaattaagagagatcatagagagagactcaccaaaattgctccaactgtgacaaatgttgcagaaccgagaatcgttcttcaaaaatcaccttgatcttgaagacccgctctgataccaattgatagctgcgctgctacgnccg

SEQ ID NO: 717497 - DNA, 729 bp, Homo sapiens
  misc_feature (13)..(15): n is a, c, g, or t
  misc_feature (24)..(24): n is a, c, g, or t
  misc_feature (414)..(414): n is a, c, g, or t
  misc_feature (420)..(420): n is a, c, g, or t
  misc_feature (524)..(524): n is a, c, g, or t
  misc_feature (528)..(528): n is a, c, g, or t
  misc_feature (531)..(531): n is a, c, g, or t
  misc_feature (535)..(536): n is a, c, g, or t
  misc_feature (547)..(547): n is a, c, g, or t
ggattgcgacctnnngagctgcgnccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcggttactaaaaaatattataagtggagagcagaatgtccagaaataagtgcagatctacaccctagaagtattattggcctcctaaaggctggctaccatggagtcctgagatccaggatcccactggcagcaaagttcttatttacagaatcgcacactgggacccnaaagtntttacagcttatgacgtattcgagtaagtctaatcacatccgagcttattgtacaggaggtagaaactcagcggaatggaatcaagggctatcttgatctgganggtnggnagtnntctcatgcttntcaatcactccatccgtagccagaagattgtgtgtacttacggatcatttccatggaaagttcgtggcatccatttgataaatgaaccagaaattgccaatgcgtctttccatgaacaacatcctgatgaaaataagacggatcctgatggaccacacaaaaagtgtaattccaaattcctg

SEQ ID NO: 717498 - DNA, 220 bp, Homo sapiens
gtacacaagggattcagagctagaaagagaagtagtatcgatggaagtgcctttagaggagagccggaattgactcaagcattagctccagaattgccagtggttgtttcatggccgtgatggattcgatgagcttttattgctgctttcactgggagcaccatccaggggcaatgcaggataagcactgtctagtgaagagcagtttctggaattcttt

SEQ ID NO: 717499 - DNA, 349 bp, Homo sapiens
gtgatctcagtgaacaaattgtattcattttaatgtacgtgaagttatctattgcttggtcagtttcttctatttgcatttttaaggccttctttattccaactttataaagataattttctcctgcaaagtttgaatttgctttttatatttagatcgttttcatctacttgcaatccaatagtcttttaacaaattggatcatcacgtatattgagtagtccattcttttctcagtgtgctttacattgcaatgaccaaaacagcacttcccgcacacatgtggccgtctcatcaaagttaataggttaaccccaattcatctcatctgaagcatggttgtcatagc

SEQ ID NO: 717500 - DNA, 299 bp, Homo sapiens
  misc_feature (13)..(15): n is a, c, g, or t
  misc_feature (24)..(24): n is a, c, g, or t
ggattgcgacctnnngagctgcgnccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcgggctggagtgcaatggcgtgatctcagctcaccgcaacctccgcctcccagg

SEQ ID NO: 717501 - DNA, 918 bp, Homo sapiens
gcgccttccgacgacatagaggaggtgagccagggctgctcaggctgctgggcgccaatcgcgcggaggcgcagcagcgagcaggtgtggggacgccacgagcaggtggtggagctggtgctggaaacgcaagacggtgccgagaagcagctgtgagagatcctcatcatggagaaggaagtggcccagagccttcgtcagaatgctgaaggagcaggtgcaccaggtatggcgtggatgctgcagcaagctggaacgctggggttcaggaggctggggaggaggacacccgtcgtgaagggcagtctccttcagtctcaccatgagagctggtaggagagctcaatgagattgaggtggatctggagcgagaggagagggaggtctgaggaggagacagacctgtcaaaaagtctcctcgtgcgtgtacagtggctcagaatttatagcatccagagttagtaagaacttgatgtgggacttatgagtgtgaggccgagggatggtctactaggcagtcgcactccatgtgccctagatgtggtacaagcgcatgcacactggtagatgatccagctctccaggatattgatcagggagtatctcgtggattctggtgtacaccagatgtggtgtccagggagtgggtcgtggttgcgatctttgccggccgaggtggtggcattattgcctggggtcaagaattcgattttttacttgagatgttgggcgacgtagatcgtaacctcatgtattcggacagacggataccccgtattgttgtccatctgtgatgcggtccaccttcagtcagaggaattcgtgcctcggtgtccacggcttggtgtaacccaaagatcgaattaggaatgccacccacgaattggatggcaaaggttcatggcgcgtttaaaatcc

SEQ ID NO: 717502 - DNA, 215 bp, Homo sapiens
aagattcgtgcgccccgccgcttcttactgccgggcgctcactgcactccagcctgggcaacaagagcaaaactccgtgtcaaaaaataaaaaaaaaaaaaaattgtgattttttccttcttcgggaaaatcggcctttttagaaattcgaatttggggggccccaaaattccttcttccgggccccctcttaaggtccattcctaaggaattca

SEQ ID NO: 717503 - DNA, 1039 bp, Homo sapiens
  misc_feature (791)..(791): n is a, c, g, or t
tggaaacgggttctcgctttgtcccccaggtgtgaaggggaagggtgcaaccacagccccacgtggggcctctcaacctctcccagaactctcaagtgtgactcctctccaagtatagcgtgggactcacttggactccctccgtgaaaatagcgtggaacgtgcagatttgttgtgtgccaccacacccagctaccgtgtgtgttgtgttttaattagaaacacaaaggtctctctccactatgtgttgtgccgtgggtgtggctctttgaaaactctccgtgggctttagagcagagcctctccgcgttcttcagcctctccgaaagagtgtgcggggaattacgggtgtgtgtgacccaaaggacccgcggctccaccacctgtgtgtacttctaacaaactttccaccccaactctccctgtgttcccccgcagagaacaggtctcgagtggtgctataaagtgtgtgacacagtggctaaaagagtatacccgctctctatatgagaggcgtttctgtggggcgcccctgtgaaaaatataacaacatctcgctatattgtgtgtgggttctcccgcgctataatatctctaatagagagacgaaatctcgacggggtgagacatgtgggcacaaaaatattgtttcatctaccccttgttgtggggtgataattataccaggatggtgggggtggtgctccacaaattttatgtgtggtgtctctccctcgctctacagaggttgtatttttttttctcccccacaaaaaatcttattctcgaanggtatacaatgctgctgttggtggtatacagaatacaacaagaggcggtcgtcttttataattatcgccccctttttagaagaaaaaacaacacaccgacggaaatcttaacgagggggggggcgggcggctatctaagacataataaatatattaagccggactatttcttaatccgaaagatgcaatatagcaacttacaatataacaaattaacaacataacataatcgaagtatagagctgcga

SEQ ID NO: 717504 - DNA, 211 bp, Homo sapiens
gacgtcacgcgcgcgctcaagggcgaataaccatggcaggcccaaacacctcccccatgacgctgttcaacgtggctggccgcgcgatgtccgcgcagctcgtgcgcatgaacgcggcggcatcgaacctcgctaacgcgggcacggtctcgtccagcgaaagcacggcctcccgcccgctgcgtcccgtcttctccgaagaactggcccg

SEQ ID NO: 717505 - DNA, 644 bp, Homo sapiens
cgatgattcattcagtgaaactcactccgagttcctgcatgcagcaacttgagggataactaccgatttgcacatacaaatgttgagactgtggtgaacgagtatgatgataacggatatggtatcatcttatttggctcttcacatgtcactaacaagttggaggacaagactgtggcatatacagtgcactgcgctcacatgacagacgacaataaagatttgatacagggcaaggactgacttattgcttactatgatgtggactatgagaagaatgctgccggttgcaactactggagacacagggtaatgatggtggcaaagaaattgctggatgctgggcacaaactcaactttgctgtagctagccgcagaacctttagctcatgaactttatgattctggctaggagagcactgctggagagattcctgttgatgctatcataactgctcgagagaagtttgtcatgcaggaggatctctcgcgtgatgggaatgctctggataggtctctgcacgaatactatgatggcaatctgaagagatacctgaagtctgaacctatgccagagagcaatgatgggcctgtgaaggtctggttgcagagaatttgatgaactagcgaataatgaagatcgg

SEQ ID NO: 717506 - DNA, 363 bp, Homo sapiens
tctttttgatagagggtcttgctctgtcacccaggctggggtgcagtggcatgatctcggctcactgcagtctccacctcctgggttcaagtgatcctcctgcctcagcctcccgagtagctgggattacatgtgcccgccaccacatctggctaatttttgtatttttagtagagacgcgtttcaccatgttggccatgctgcctggctaattttttaaacttttttgtagttatgaggtcttgctctattgcccaggctgatcgggaactccagggcttgagcaatcttcccgcctcagcctcccaaagggcttggattaccggcatgagccgacggtgcccggctccagcaggttttgat

SEQ ID NO: 717507 - DNA, 411 bp, Homo sapiens
gtcactatgtagtcagtcacttgccaccctctgtacactggaagacatcctgctgagactgggacaggctggagagccactgtggttcagagtgggccgatcactgggtgaccgatggtggcacagcacaccgtgaagtgtgccccgtgacccctttcaggagggatcctggggagaccgatccaggacatgtgcgcaagagcaggcaacaggtggctgtgtaatatgggtagacgcagagcctgggcctgtaccaccagtggtggcactttgtggagagctgtccttgcattgatcatcagggctgctggctgcagggttggctgttacagggagcgcttcctggagggccgcagttgaggagggcctcgggtgctgagggtctggttggtgctcaggcactggacctcc

SEQ ID NO: 717508 - DNA, 457 bp, Homo sapiens
gcatggtaaaaccctgtctctactaaacatacaaaaataagccaagtggtggtggtgcgcacctgtaatcccagcgtattaaggaggctacggcaggagaatcccttgaagccgggaggcggaggttgcagtgagccgagatggtgccacggcactccagcctgggtgacagagcaagactccgtctcaaaaaaacaaaacaaaacaaaacaaaaagccagacatggtagcttgtgcctgtagtcccagctacgcgggaggttgagacaggagaatcacgtgaacccaggagggggaggttgcaatgagccgagatcataccactgcactccaagctgtgggcaacagagcaagagtttgtctcaaaaacaaagaataagaataaaaggtatacagaaattagcccaggcacaggggctcatgcccataataccaacatttggagaagccaaggcgg

SEQ ID NO: 717509 - DNA, 177 bp, Homo sapiens
ttacctaatggctgtatatatacttgtctcagctataatgcaggaaataggtttacttccagcagtttagtctaaactgttcaaaaaaaactatgaacagagttcaaatacaggactgtttgtttgaagagactttcttaaagttgtacttacaaaccatagtaagtttttttacct

SEQ ID NO: 717510 - DNA, 275 bp, Homo sapiens
gttaggggatgcccttccttcatgcaggatggagactgagaaagcaagatgttggctaccagaaatggggtttcaaaaatttgctgggggcgctattggacaataaaaacatataatgcgatctgccaaattaaaaaaacagaagctctgtgcgcgtgtatcagtaagtagataaaatcaatgctgaactgtgcaaaacagtaaaacattttcaaaagtcatcaatattttggatcagggggtgtgaggtggttatatgagacttggaagaatag

SEQ ID NO: 717511 - DNA, 719 bp, Homo sapiens
  misc_feature (45)..(45): n is a, c, g, or t
  misc_feature (78)..(78): n is a, c, g, or t
  misc_feature (142)..(142): n is a, c, g, or t
  misc_feature (198)..(198): n is a, c, g, or t
gtattgtcgcgaactcttttccccggaccgcgtttatctgtgttnggtttttacggtcccttgagggtttgcgccccngggccaaatttggggagagggggtgcgcggcgccccccgcacctctcatgttggtgtgggtttnagggggggcgcgctgtgccccccctcctcccctcgggtttggtaaaaggggagagnaattggcccttttttagtgtggggcgggcgcccctctctgggggagtttctataaggggggggggggaattctccgggtatttatttgtttttccgcccccataattatttggggggtttgtttggaccccccccccctttcaagggccctgtccggggaaaaaaagggggggtggtcccccccaattttttttttttttcttggggtgggggcccagggccctgtttcccgaattggggggtttttggttttcctttttttaaaaatgaaccccgggcccccttggggaggggggtttcccccttttgggccggggggttttaaaaattttcccccaaggggccggcctttttttccccctccaaggggggggggtttcggggcccgacccccgggccgggccctggggacagtttttctggggtttttttttttttttttacccccctggggggggtttttttttttttttttttttaaaaagggaaaaaaaagaaggggcccccccccggcccaggga

SEQ ID NO: 717512 - DNA, 261 bp, Homo sapiens
  misc_feature (2)..(2): n is a, c, g, or t
  misc_feature (10)..(10): n is a, c, g, or t
  misc_feature (19)..(19): n is a, c, g, or t
  misc_feature (60)..(60): n is a, c, g, or t
  misc_feature (83)..(83): n is a, c, g, or t
  misc_feature (86)..(86): n is a, c, g, or t
  misc_feature (88)..(88): n is a, c, g, or t
  misc_feature (104)..(104): n is a, c, g, or t
  misc_feature (106)..(106): n is a, c, g, or t
  misc_feature (150)..(151): n is a, c, g, or t
  misc_feature (165)..(165): n is a, c, g, or t
  misc_feature (172)..(172): n is a, c, g, or t
  misc_feature (179)..(179): n is a, c, g, or t
  misc_feature (231)..(231): n is a, c, g, or t
  misc_feature (248)..(248): n is a, c, g, or t
cnggcattgngggctacgnggaaacccctcgcggcctccggaccttcaagactgtctttnctgagcacatcagtgatgaatgnaancngcgtttctataagaancngcataaatctaagacgacggcctttaccaagtactgcaagaaanngcaggatgcggatngcaagangcagctngagaaggacttcagcagcatgacgaagtactgccaagtcatccgtgtcattncccacacccagatgcgnctttttctctgcg

SEQ ID NO: 717513 - DNA, 529 bp, Homo sapiens
ttatctacaactgagtcttcattcttaagtatcacgaacaatctacagaacgtgcctgctgaacatttaatatctacagtgtccaatgatatgaaatcagaattaagcaatacccacatgattttttttttggagacggggtttgcctctggtggcccaggcgggagtgcaagggcatgatctgggctcacggcaacttcggcctccgggttctagtgattctccggccccagcctctcaagtagctgggatggcaggcatgtgccacaaggcccagctagtttggtatttttagtagagacagggtttctccatgtgggtcaggtggttctcgagctccagatctcaggtgatccacctgtcccggcctcccaaagggtgggaattataggcatgaaccaccaggtccagccggattttttattattacaaacagtacggcagtaaactactttttttacatgtatcttggtgtcatcgtgtatatctgcatgataactttataaaagtagaaccagcagatccaaag

SEQ ID NO: 717514 - DNA, 360 bp, Homo sapiens
  misc_feature (27)..(27): n is a, c, g, or t
  misc_feature (86)..(86): n is a, c, g, or t
  misc_feature (101)..(101): n is a, c, g, or t
  misc_feature (112)..(112): n is a, c, g, or t
actataacctagcctggcctcccatgnggggcgcagtgattataggccgctctaggttaaaatgccttagcccattcttaccacangcacacctacacccntatccccatantagttattatcgaacctcagcctactcattcaccatagcctggccgtacgcctaaccgctaacattactgcaggccactactcatgcacctaattggaagcgccaccctagcaatatcaaccattaacttccctccacacttatcatcttcacattctaattctactgactatcctagaaatcgtgtcgccttaatccaagcctacgttttcacacttctagtaagcctctacctgccacgacaacac

SEQ ID NO: 717515 - DNA, 105 bp, Homo sapiens
ggacgcgtgggtccggacgcgtgggccataatatataagaagctcaaagcaacatctacttatatacatattcacagaaccattatataaatgttgttagacctc

SEQ ID NO: 717516 - DNA, 206 bp, Homo sapiens
  misc_feature (150)..(150): n is a, c, g, or t
cccactggaagggacaccacggctaaccccatgcctcctggacatgaccactcagctggcctgccacccggctgtccacctccccatggccctcgggttccctcaccccctccggtgctcagatagaactacagctggttggtgggagtncctatgtggggtgccagcggtccagcgtcttgtaacagatctctgctcctagcttc

SEQ ID NO: 717517 - DNA, 959 bp, Homo sapiens
ggctgccaggcgcgggcgccgcggcacgtcacaggctgggtcgcgaggtggcgatcgctgagagtgcaggagtggccgatggcgggcctgggaggctggcctgtgaggtggggctgcctgttgggtgccggacctgcactgtggcttcatctgagtggcgcacggcccgttgatcgagcgtgcggactggcctcccaagcgtggtggtgacaagctgcctggagctgcaatgggcctgcggctggggattcttgttttggcctcctgggcgccgtgtggctgctcagctcgggccacggagaggagcagccccggagacagcggcacagaggtgcttctgccaggttagtggttacttggatgattgtacctgtgatgttgaaaccattgctagctttactaactacaggcttttcccaagactacaaaaacttcttgacagtgactactttaggtattacaaggtaaacctgacgaggccgtgtcctttctggaatgacatcagccagtgtggaagcagggactgtgctgtcaaaccatgtcaatcttgatgcagttccttgattggcattacatctgcgagctacaagtattctgcaagaagccaataatctcattgaagactgtgaacaagctgaacgattggagcagtggatgaatctctgagtgagggaacacagaaggctgtacttcagtggaccaaggcattgattgattcttcagatagttctgtgacgtgatgaccttcaggtcccttgaagctgactatgtccatcggtccttatcctgagggctacacttgggtacgggggccaggatgtttgaaagtttggatggtatctacgaagacatggttaagcacagcacgtaaagacgttaaatctgggtagggcaaggccaggaaaaacttaaaaggggaaggtctggtgtgagagattagcacgtttcggcaagaggtt

SEQ ID NO: 717518 - DNA, 195 bp, Homo sapiens
gagtatcgaacaaaaactgtcacataatttctatcccagcactccacaaaagcaaaatgatactacttgacaatttgtgattcacacgaaggaaaaaagcacatgaaatggacaaatatattagatatatatacaaatacttgtcttactttttaaacaatctctctgtgtacgagattcaacgcggggatcctc

SEQ ID NO: 717519 - DNA, 1102 bp, Homo sapiens
gacccacgcgatcggacccacgcgtccgaagagaacaatagaactcactgatacatgtaaagaaagagaaagtgatactgggaagaagaaagtagaactatgaaatttccagaagtgaaatggttgccacagcgcgcagcagctgcgtcttgcctcagacggctaccaagagccgaagcacctaggctgcagtggaacgaaagatagatcaagtccctggtaggctctctgtggttgagacaacaaatgcacagaatactagagatcaagactgtcgacgatttggaagagctggacaacttatcatggacagagtagaaacgaagctcgtagaagcaacagaggcacgcagtggcttactgaagcgccaagaacttccacatggaacagtctggaagtatgctgaattacgagcacgacaggcaaatggaacagccagcagcttggccagaatacctcaacaggcacaacagcactcaggaggacctggactggacccaaattggagcagcagggaaacctggcgatgatgcctcaatcaatagtccccattacgtaacactcgtgattcagcaagcagatgccaccagcttcatcaacaccaagacaaggtcaagataccagggcacaaggttccatggatgcccgggcatgcacaaatggccagggccgcctggattcccactgggttggagccaaagaatacaacaccctctagggaagtagggcctacacttccttgggatggccaccaatgccatggaaaccactttagggacccgggtacccactgaatagaagctaaacggatggtgtcccccatccaaacaaaggagacagaaaaacgggacaacaaaacaacctgcaacaatgggggacacacacagaagcacgggcacaggaacacgcaaggccattcaagcactcggtcccttaaacccgagacaaaaattacagaaaaaaccgccaaacaccaaaccaagaacacgagaagggagcaaaaaaagcaactagaaagcgaaaaaaaaatagaggcagaacaagaagaaaaagccaaaagacacaaaaagacaagcagccaacagcccagagcgcgcaccag

SEQ ID NO: 717520 - DNA, 649 bp, Homo sapiens
  misc_feature (17)..(17): n is a, c, g, or t
  misc_feature (111)..(111): n is a, c, g, or t
  misc_feature (132)..(132): n is a, c, g, or t
  misc_feature (274)..(274): n is a, c, g, or t
ggatagtagatgattgngatacgctgtataacatgaggtcgtatactagtctgattaagggttctatgatgtgaacgtgttgagtgagtgagcctcattgcgttgtgctanatatgtacagtcagtataggncttcgactagtatgttcagtcctgtagctagtagagcgatatttgatcaggagatcgtggttactagcacagagagttctcgcagtaggttaatagtgatgagtaaggctaggctagctaggcttgctagcagtcatcatanagctattactcggagtagagcttagagtccttaatagagcattatgatgcgtctgtgagtgcgttagtagtttgagtatgctaggcaggatagtcatgagtatgtcagtctgtggcgcattatgagaatgactgcactggtgaagcttcagtgggttcggatgagaatgagctctgtttgtcgcagtcagatgcagcctgtgatcattatgcctcatagtcatagggctagtgtagggtaggctatgcgtctcgtcatggggtttaaaatgagtgtaaagcgtattattccagacccgcctagttttaagagtactccagcttggcctattcatccagcgatgagcgagtccacatcagctttagggagtcacag

SEQ ID NO: 717521 - DNA, 537 bp, Homo sapiens
ggccacaacggctgggtaacccagtatcgctacataccccgcatgttcccggcacatgatcctctccggcctctcgaggataagacgcatcgatcatgtggatagactgaccagggatgagaccaactatggaattccacagcgtgtcgtgctgctggggtcactcccactttgttcagtgatgtggttatctcctcagatggccagttggccctctcgaggctgcctgggatggacaccctgacgcctactgggatctcacaaggggcagccaccaactaggtcgactttgatgtggcgcatactcaagtgatgatgcatgaagtgtgtgtgctttcttcactcgtgactaaccaggctgagattgtctcctgggatctcagaagataaaaaccagtcaatgctagtggaagtacccgtgggttgtgtgcaaagtacacgtgtccaggattgacgatgccacatcagagtgggtgtctgagtgtccagcttctcgcccaacagtcgagcaaccctatcatcgtcccctgtggctgg

SEQ ID NO: 717522 - DNA, 763 bp, Homo sapiens
  misc_feature (61)..(61): n is a, c, g, or t
  misc_feature (108)..(109): n is a, c, g, or t
  misc_feature (111)..(111): n is a, c, g, or t
  misc_feature (120)..(120): n is a, c, g, or t
  misc_feature (128)..(129): n is a, c, g, or t
  misc_feature (134)..(135): n is a, c, g, or t
  misc_feature (138)..(138): n is a, c, g, or t
  misc_feature (144)..(144): n is a, c, g, or t
  misc_feature (148)..(148): n is a, c, g, or t
  misc_feature (189)..(189): n is a, c, g, or t
  misc_feature (195)..(195): n is a, c, g, or t
  misc_feature (249)..(249): n is a, c, g, or t
  misc_feature (252)..(252): n is a, c, g, or t
  misc_feature (256)..(256): n is a, c, g, or t
  misc_feature (261)..(261): n is a, c, g, or t
  misc_feature (267)..(267): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (299)..(299): n is a, c, g, or t
  misc_feature (301)..(301): n is a, c, g, or t
  misc_feature (325)..(325): n is a, c, g, or t
  misc_feature (355)..(355): n is a, c, g, or t
  misc_feature (362)..(362): n is a, c, g, or t
  misc_feature (406)..(406): n is a, c, g, or t
  misc_feature (465)..(465): n is a, c, g, or t
  misc_feature (599)..(599): n is a, c, g, or t
  misc_feature (625)..(625): n is a, c, g, or t
  misc_feature (699)..(699): n is a, c, g, or t
  misc_feature (741)..(741): n is a, c, g, or t
tcgcagacgcgctcgggcggcgggtccgaggccggcgtgcgcggaggctgggcgggcagcncgagcggtggccgcagcgagttttcccattcccattttcttccccanncngcccaccancccccttnncctcnngcnggagcntganccgagcccggctggctgtgctgcgcggtgccgccgggaaanatggtngtggcgctgcggtacgtgtggcctctcctcctctgcagcccctgcctgcttatncanattnccgangaattnatggagcnanctgtnatcacggaacagtctcnanggcgcctggttgtcttccccacanatgacatcagcctcaagtgtgaggccagtngcaaacncgaagtgcagttccgctggacgagggatggtgtccacttcaaanccaaggaagagctgggtgtgaccgtgtaccagtcgccccactctggctccttcaccatnacgggcaacaacagcaaatttgctcagaggttccagggcatctaccgctgctttgccagcaataagctgggcaccgccatgtcccatgagatccggctcatggccgagggtgcccccaagtggccaaaggaganagtgaagcccgtggaggtggaggaangggagtcagtggttctgccttgcaaccctcccccaagtgcagagcctctccggatctactggatgaacagcaanatcttgcacatcaagcaggacgagcgggtgacgatgggccanaacggcaactctactttgccaa

SEQ ID NO: 717523 - DNA, 757 bp, Homo sapiens
  misc_feature (757)..(757): n is a, c, g, or t
agcgggctttcccgacggccatcttgggaatctgacggatcggaggcattagtgaggaggcgcgaatcaacgttagcaggggggaagagtcttagacctggccagtcctcagggtgatgggccctgaggaagaactgagggatctccctagctataggagagaagaaagccccgggcatgtactgcgctgacgtgagactggtgctccaggaaccaggtggtgacgaactgggtgtgaggcacacagtcctaaagtcagcacatgcagtaggaggcccaggcaagtgccaggagtcaaggcctgctggatctcatcatccagtatccctgtttgatacagtttagctgctgctcctgaagaagtcgtcgtgcgctcccgttccaggcgttccattccgcaacgttgactaacgactccccgaaactcagtggagtgaagaagactggggtagatgcacgagcatcccggcagatgaggaagaggaggaagcctcctccgcctcttccacttagtacttagtattttcccccgtcttctttctccacaatcctcttctctgattcgttggtggtcctgaggaggaggaggtggccatctggtgtgatagcaaatcttagcgagagcattcgcagtaagtcctccacagggtcctccacagggtccttcgcagagtcctctgagctcgtgctgggtcctctttttgcatggagcgtcattcagtgaaagaggtccagcagcggaacaggggagggatcn

SEQ ID NO: 717524 - DNA, 318 bp, Homo sapiens
gcgtctctctcccagacagcctgttcagttctgtgtgagacatgcgggctttgtatcgattgccgtgccgactctttggtgacgctcgtatgcagcccctcagtgcaaggcgccttttttaaacaccccggagggatgcatgactgcactccattggcacgtagaacgctgaagaggtcgagaccgaaagcactcgcaagcatcaaatatttgaggggatgatgcgttcccctcggcttgcgtaggatcttggttacccagcacgctggaagactatccaacgcatctctcaatataaggaactctccactcgcgggt

SEQ ID NO: 717525 - DNA, 1955 bp, Homo sapiens
  misc_feature (102)..(102): n is a, c, g, or t
  misc_feature (182)..(182): n is a, c, g, or t
  misc_feature (238)..(238): n is a, c, g, or t
  misc_feature (244)..(244): n is a, c, g, or t
  misc_feature (249)..(249): n is a, c, g, or t
  misc_feature (256)..(256): n is a, c, g, or t
  misc_feature (271)..(272): n is a, c, g, or t
  misc_feature (293)..(293): n is a, c, g, or t
  misc_feature (296)..(297): n is a, c, g, or t
  misc_feature (306)..(306): n is a, c, g, or t
  misc_feature (329)..(329): n is a, c, g, or t
  misc_feature (341)..(341): n is a, c, g, or t
  misc_feature (346)..(346): n is a, c, g, or t
ggaacaccaccagtgtggagcagcccagccaagcactgtcaggaatcctgtgaagcagctccagctatgtgtctctctatgcctctggacgcacaactggcnatcgtgcttggactctggagatggtgtcacccacaatgtccccatctatgagggctatgccttgccccatgccatcatgngtctggatctggctggccgagatctcactgactacctcatgaagatcctgactgancgtggnctatnccttcgntactactgctgagcnntgagattgtccgggacatcanggnnaaactgtgntaatgtagctctggactttgaantgagatggcacngccgnatcctcatcctcccttgagaagagttacgagttgcctgatgggcaagtgatcaccatcggaaattgaacgtttccgctgccaagagaccctgttccagtactaccttcatcggggatggagtctgctggcgtccatgaaagcacctacacacagcgatcatgaaagcagtgatcatcgcacatcacatggacaggacactctactgctgaacaaactgttcctatcacaggggctccaatctattgtacccttggcattgcgcgatcgattgcgacacgagaatcactggcctatgagccatgagacctgaaaaccagatatactcgcctctcgcgaacactattgacaggtctgagtgtccatctgtgcctatgccctcacgcatttgatcaacaaccgacaataagtcctacagaccgagataaaaccctaggccgtgctaccaaacggtcgtggagacgtgcatcaacaaacacggtcgccgacattgggggaagtcattagtgacgctagtacgctctcgtcacagtcaacgcatgagcaagacggagaccgaccaggctgcacacacggccactcccaggcaagccacacaccaaccacagcacaacagctcagaacgaagcagcacagcagccagcacagatacacaacgcagcagggcacagcctcgacagccaacagacggacaacgacaggcgaacacaacagaccaccagcatcaagacaaagcactgacttgctactcagactaccatatcacgcacactctaataagcacaagccattcaataacactcagcaagatagacaacaatacgacctcaatcgacaccacatcaaagaacagaacactcaatacacactaatatgtacacatcagctatgtaacacatcagtactacgcatgatacaagaacaaacaaagactgctacatacaccgtacactcgatgcgcacgcaccgatcaatcaaatacgacaaaatactagacaaaccactaaaatgaagcatataaatcaccaaatacatatattaaagaggacgagctaacgagactgaggtcagggctcacgcacagcgaccgaggcaaagggtacagccgagctggccgcacgccgaaacgtgcgagcgatgcgtcggcgaaccagacggaggagtcgccagatcgcgcgcacacagagcgcgccgcagcgcgccgcgccgcgatgcacgcgagcgtgcagacagatcaggaggaataagaggaagcgagcgagccgggatcccgaaagtaggagccaccggaacaggcataatgagagatatcgagaatacggatgatgatacacatgcgactagacgatacgtactaggcgcacgtgtcaagtaggataatgagcagtcgagctcacgcggagacgatttgagcggctgagctgcgaccactagtcctatctctcacgagtggaccctcagtgatgggtgaagacatctatcggacagcttgatgatccattccctgattcacatacgtgtcgacgtgaacacatacgtccacaaccaatcacatcctaaggctccatcactccaagatctgtcatccagtagacaacagcaccacagcca

SEQ ID NO: 717526 - DNA, 309 bp, Homo sapiens
gcttgttcgcaagcgggtttgcctgtcagaacacaggtgtcgtgaaaactaccccgtaaaagccaaacatgggacaacggaagaagactcgatatcaacgattgtcggtcgatctgagacagccgtagatttctggggcaaggtctcaccagcatactggtgcactcgtgcagtctaatacaactggcgcgtggccctccgaacaacaaggataccaatttgaaacaacactcttgcacgaacaggacgcgctggcctggagactgcggacacacgggctcccgttccaatgttatgccctggcgtctt

SEQ ID NO: 717527 - DNA, 2392 bp, Homo sapiens
  misc_feature (91)..(91): n is a, c, g, or t
  misc_feature (131)..(132): n is a, c, g, or t
  misc_feature (367)..(367): n is a, c, g, or t
  misc_feature (369)..(369): n is a, c, g, or t
  misc_feature (385)..(385): n is a, c, g, or t
  misc_feature (393)..(393): n is a, c, g, or t
  misc_feature (486)..(486): n is a, c, g, or t
  misc_feature (502)..(502): n is a, c, g, or t
  misc_feature (508)..(508): n is a, c, g, or t
  misc_feature (539)..(539): n is a, c, g, or t
  misc_feature (619)..(619): n is a, c, g, or t
  misc_feature (675)..(675): n is a, c, g, or t
  misc_feature (681)..(681): n is a, c, g, or t
  misc_feature (686)..(686): n is a, c, g, or t
  misc_feature (693)..(693): n is a, c, g, or t
  misc_feature (708)..(709): n is a, c, g, or t
  misc_feature (730)..(730): n is a, c, g, or t
  misc_feature (733)..(734): n is a, c, g, or t
  misc_feature (743)..(743): n is a, c, g, or t
  misc_feature (766)..(766): n is a, c, g, or t
  misc_feature (778)..(778): n is a, c, g, or t
  misc_feature (783)..(783): n is a, c, g, or t
ggaacaccaccagtgtggagcagcccagccaagcactgtcaggaatcctgtgaagcagctccagctatgtgtgaggaggaggacagcactnccttggtgtgtgacaatggctcttggctctgtaaggccgnntttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgttttgcccctnangagcatccaccctgcncacggagncacccccttaaaccccaaaggccaaaccgggagaaaattgactcaaaattattgtttgaagactttacaatgttcccaggccatgtaatgtgngctcatcccaggcggntgctgntctctctatgcctctggacgcacaactggcnatcgtgcttggactctggagatggtgtcacccacaatgtccccatctatgagggctatgccttgccccatgccatcatgngtctggatctggctggccgagatctcactgactacctcatgaagatcctgactgancgtggnctatnccttcgntactactgctgagcnntgagattgtccgggacatcanggnnaaactgtgntaatgtagctctggactttgaantgagatggcacngccgnatcctcatcctcccttgagaagagttacgagttgcctgatgggcaagtgatcaccatcggaaattgaacgtttccgctgccaagagaccctgttccagtactaccttcatcggggatggagtctgctggcgtccatgaaagcacctacacacagcgatcatgaaagcagtgatcatcgcacatcacatggacaggacactctactgctgaacaaactgttcctatcacaggggctccaatctattgtacccttggcattgcgcgatcgattgcgacacgagaatcactggcctatgagccatgagacctgaaaaccagatatactcgcctctcgcgaacactattgacaggtctgagtgtccatctgtgcctatgccctcacgcatttgatcaacaaccgacaataagtcctacagaccgagataaaaccctaggccgtgctaccaaacggtcgtggagacgtgcatcaacaaacacggtcgccgacattgggggaagtcattagtgacgctagtacgctctcgtcacagtcaacgcatgagcaagacggagaccgaccaggctgcacacacggccactcccaggcaagccacacaccaaccacagcacaacagctcagaacgaagcagcacagcagccagcacagatacacaacgcagcagggcacagcctcgacagccaacagacggacaacgacaggcgaacacaacagaccaccagcatcaagacaaagcactgacttgctactcagactaccatatcacgcacactctaataagcacaagccattcaataacactcagcaagatagacaacaatacgacctcaatcgacaccacatcaaagaacagaacactcaatacacactaatatgtacacatcagctatgtaacacatcagtactacgcatgatacaagaacaaacaaagactgctacatacaccgtacactcgatgcgcacgcaccgatcaatcaaatacgacaaaatactagacaaaccactaaaatgaagcatataaatcaccaaatacatatattaaagaggacgagctaacgagactgaggtcagggctcacgcacagcgaccgaggcaaagggtacagccgagctggccgcacgccgaaacgtgcgagcgatgcgtcggcgaaccagacggaggagtcgccagatcgcgcgcacacagagcgcgccgcagcgcgccgcgccgcgatgcacgcgagcgtgcagacagatcaggaggaataagaggaagcgagcgagccgggatcccgaaagtaggagccaccggaacaggcataatgagagatatcgagaatacggatgatgatacacatgcgactagacgatacgtactaggcgcacgtgtcaagtaggataatgagcagtcgagctcacgcggagacgatttgagcggctgagctgcgaccactagtcctatctctcacgagtggaccctcagtgatgggtgaagacatctatcggacagcttgatgatccattccctgattcacatacgtgtcgacgtgaacacatacgtccacaaccaatcacatcctaaggctccatcactccaagatctgtcatccagtagacaacagcaccacagcca

SEQ ID NO: 717528 - DNA, 757 bp, Homo sapiens
tccccctgcgttcaccttctgcctctacccgcctgttgggtttaccaaacccaaaggaaaaaaaggaaaaaaaaaaaaaaaacaaaaccagccgctctcagcccggtgatggccccacgtcagaatgtatcagcagaggtgtgaagatgatcttctggctgaccctcttacctctctggctgaggcagctggcctcctggatctctggccagcccacctctctctgcttgctccccgcttgtgcacaatgtcttcttacactgggacggcccactggctccctcagctgtccagtccccctccgtgggccggccccaggtctccgtggacaattaagcaacagattgatattgtgagttgctcgggtgtggggaagtgaggcccagacctctgctctcggccatgtatttgtgtgacttgcccaggactctcctcaggtggggctggccctactcaggaattacactgaaagttaaggggccctcgataagttcccgggtgagtggttttgggcacccgctcagggattccctaagggctgaaacagttgttctcccgttagggtctgacctccgaatgcctttcatcgtgggggacacacaaaccaaacagcaatattgttcggtcttgatctgtctacgtacttggggccctgctgctttcccccgtgggatgccgaagaggcccttttgcccggctctgtccttgccaggcctgccggcgtccgtgcccgttaatgtcccgtccccaaggtctc

SEQ ID NO: 717529 - DNA, 199 bp, Homo sapiens
  misc_feature (42)..(42): n is a, c, g, or t
ttgggggcccttttccccccccgggggggtttttttttcccncccccccccccccgggggtttaaatggcccctttggggggggccccaacccccgttttcccccttttttttgggggtttttccggggttttgggggggggccctttttttttttttttttttttttttttttttaaaatatcccgggggggggggga

SEQ ID NO: 717530 - DNA, 376 bp, Homo sapiens
cctgtattgacatctttgttctggttttgacttggcttgacttggtaagactagtctttggaacttgccccactccacgtgagtggaagcttggcctgatcacccacggtgtgcctgtattggcacttttgttctggttttgacttggcttgacttggtaagactagtctttggaacttgccccactccatctgagtggaaacgtggcctgatcacccacagcatgcctgcacgggcactcttgttctggttttgacttgacttgaattgctggatactttggttttggttttgacttggcttgaattttttggtactcggattttgaatttcgtgattttggtttggtataaacggtaaaagtgtgttcccttca

SEQ ID NO: 717531 - DNA, 461 bp, Homo sapiens
gactttacatgagagaaaccgtgtatattctttgtgtgcgaagaaacaccctgaaggattgctaacacaagcagctctatgttgtttttaagtgacgtacgacgatgagcgttcaatatacgagactacctgtcatgcccctgtgaggaggagcatcatttacctacgtgttcagtttgatatcactggggattgatgacctcgagaacaagtcgaaagactcacttgtagacctcatcgggatctgcaagagctatgaagacgccactaaaatcacagtgaggtctaacaacagagaagttgccaagaggaatatctacttgatggacacatccgggaaggtggtgactgctacactgtggggggaagatgctgataaatttgatggttctagacagcccgtgttggctatcaaaggagcccgagtctctgatttcggtggacggagcctctccgtgctg

SEQ ID NO: 717532 - DNA, 260 bp, Homo sapiens
tcgtgctgagagatattctttcttctgccttggagtccggccctccccagacttcagttatgctagtctaagacccagattctgacaacattggggcaggatgagagggctgagcctgggttccaaattcctctagtgatctcctcacctctcccactccatggataccaagtctttcccttcattcccccaaacatcctgtagctctaactggagcacattcacttacgaacaccaggaaatcacagggcccttgtctg

SEQ ID NO: 717533 - DNA, 702 bp, Homo sapiens
gcagaaacctgcggaaaatggtagcgctggcggctgggccgagtgggtgtctggtgccggcgtatgggctacggtatgttgttggcgactgtgcttcaagcggtgtctgctataggggctattgtacactcggaggcatagcagagagttaggcttatatctagcaacttgcttcgcagctcttgtgatctctctcgagcaccagttcaacctgctctcagctaggatccttgattgcagaggcatgctgtcaggaggcagcacaaatttgaaaccaaacaagctgtatgcaggagctatccttgacgttccgtggatgaaaacttggggaacggttccctcaagtccaagctttctgtttacggacgtagataaagccaaaacctgtatcagagcgacatgaaaattcaagtatgtccgtggttccagaccctgtattaacagcttatgtggacacgacaatgggaacattggcttgacagaacatgagcattctccacattgcgaaccacagacccgtgtcagcacgactacctagaagtgacaaccgcttggacacgcatattacatcttgcttaaacatctgtcctaatccctttagtaaacctttatcaacatgcaaactctttaccagcactaagacaatacattacagaatcgcttgcctcccatcgaaccagtcctatcacttggaggcttaca

SEQ ID NO: 717534 - DNA, 461 bp, Homo sapiens
tctatattcatgtatgttggtgtccatggattggtatttattttttctaaacaggtataggcctctatggactgagtcacgcaccacccccattacattactgaggactataattcatgttctgtctcacattctctaagtgatctttataaccctttaatacatttttcttccaaactgaggttagctggaaaaatttaagagattcaacaatgagcatctgtccttcctctataccagtactagagaaaggtattaatcacgtcgtagtctcccttccaacacaacaaaaccaacgaccaatcaaacctcatttccagcctatcacccctcacccactttacacatttgacacacaacctttcaccacacccaaatattcctgaattatagttaaaactggatttataaaccgagtaaactcaatagtactgtttagtcctttataaatttggtgatag

SEQ ID NO: 717535 - DNA, 893 bp, Homo sapiens
  misc_feature (8)..(8): n is a, c, g, or t
  misc_feature (66)..(67): n is a, c, g, or t
  misc_feature (72)..(72): n is a, c, g, or t
  misc_feature (131)..(131): n is a, c, g, or t
  misc_feature (135)..(135): n is a, c, g, or t
  misc_feature (169)..(169): n is a, c, g, or t
  misc_feature (297)..(297): n is a, c, g, or t
  misc_feature (306)..(306): n is a, c, g, or t
  misc_feature (308)..(308): n is a, c, g, or t
  misc_feature (330)..(330): n is a, c, g, or t
  misc_feature (339)..(339): n is a, c, g, or t
  misc_feature (341)..(341): n is a, c, g, or t
  misc_feature (889)..(889): n is a, c, g, or t
aaaaaaanaataaaaaaaaataatcacatgttcatgcagattaaatatgtgtcttcactgcccctnnaaggngagcactctcactgtcagctccttcaattggtgtgtcaaggggtgagtgtcaaagggancccncaaatgtaattccgaatggggggcaagttggaanaatactcggggaaaaggtaaacaagaaggaagcataacaacgcccatggaccattaagcttcaaaaggtcaaggaacatgcaaggaccattggccatttacaatggtacatggcaccaaaagatcttnatccttcanangcactgggactataggaacttnattcttcanangttcagggactatacgaccttgattctttggaggctgtaggactgtggggccttgatccttaactaatactgggagaatggggtcttgattcttcacggactcggggaccacaggaccttgattctttacaggtgccacaactgcagaatcgtgaacctttgcatgctctgggactacaacatcttgatccttgactggccctgagaccactaaaccttgattctttacaggctcagagaccatggaaccttgattctttatgggtgctgtggccatggcactttcatccttcggatgctctgggaccatgggatcttgatccttgataggtgctgagaccatgggaccttcatccttgacaggtgctgggactatgggaccttcacccttgacaggtgctgggactatgggaccttgatccttgacaggtgctgagaccatgggaccttgatccttgacagatgctgagaccatgggaccttcgtccttgacaggtgctgggaccataggagcttgattcttcacaggctcaggaattctaggaccntgat

SEQ ID NO: 717536 - DNA, 224 bp, Homo sapiens
cgctgactctatgaggatccccttcgactgtgggctcagaggcagaatgtggctgtcaacgaactctgcggccgatgcatcaacccctgtgccgggcgcagccaggcgtccgtgctctaagggcagctgttccacactcgcctgctatcaccgtgccaccatgtgtgcgcagcaagctcccagggccagccagttctacaggtctggagggggcgccgtatgtg

SEQ ID NO: 717537 - DNA, 223 bp, Homo sapiens
ccaggagctttggcggcgggttgggtcactgttatttcctagcactttgggaggaggctgagacaggcggatcacctgaagtcaggagttcaagaccagcctggccaatgtggtgaaacccagtctctattaaaaataccaaaaattagccaggcatggtggcacatgcctataatcccagctacccgggaggctgaggcaggagaattgcttgaactcagaa

SEQ ID NO: 717538 - DNA, 843 bp, Homo sapiens
  misc_feature (55)..(55): n is a, c, g, or t
  misc_feature (65)..(65): n is a, c, g, or t
  misc_feature (114)..(114): n is a, c, g, or t
  misc_feature (116)..(116): n is a, c, g, or t
  misc_feature (150)..(150): n is a, c, g, or t
  misc_feature (246)..(246): n is a, c, g, or t
  misc_feature (296)..(296): n is a, c, g, or t
  misc_feature (325)..(325): n is a, c, g, or t
  misc_feature (340)..(340): n is a, c, g, or t
  misc_feature (398)..(398): n is a, c, g, or t
  misc_feature (423)..(423): n is a, c, g, or t
  misc_feature (439)..(439): n is a, c, g, or t
  misc_feature (548)..(548): n is a, c, g, or t
  misc_feature (559)..(559): n is a, c, g, or t
  misc_feature (589)..(589): n is a, c, g, or t
  misc_feature (613)..(613): n is a, c, g, or t
  misc_feature (633)..(633): n is a, c, g, or t
  misc_feature (672)..(672): n is a, c, g, or t
  misc_feature (687)..(687): n is a, c, g, or t
  misc_feature (712)..(712): n is a, c, g, or t
  misc_feature (740)..(740): n is a, c, g, or t
  misc_feature (752)..(752): n is a, c, g, or t
  misc_feature (759)..(759): n is a, c, g, or t
  misc_feature (774)..(774): n is a, c, g, or t
  misc_feature (818)..(818): n is a, c, g, or t
aaacgcatgacagtctgaaatagctctctggtgccaacctccaaattcccgctgngtgacttcanacccccactagttgacagagcagcagaattcaactccagtagacttgantntgcctctgggcaaagaagcagagctaacgagganagggatttaaagagtttttcttgggtgtttgtcaaacttttattccctgtctgtgtgcagagggattcaacttcaatttttctgcagtggctctgngtccagccccttacttaaagatctggaaagcatgacgactgggctttttntcctatgtctcttgggaactgcagctgcnatcccgacaaatgcnagattattatctgatcattccaaaccaactgctgaaacggtagcacccgacaacactncaatccccagtttaagggctgaagntgaagaaaatgaaaangaaacagcagtatccacagaagacgattcccaccataaggctgaaaaatcatcagtactaaagtcaaaagaggaaagccatgaacagtcagctgaacagggcaagagtnctagccaaganctgggattgaaggatcaagaggacagtganggtgacttaagtgtgaatttggantatgcaccaactgaaggtanattggacataaaagaagatatgagtgagcctcaggaganaaaactctcagagancactgattttttggctcctggtgtnagttccttcacagattctaaccaacaanaaagtatcaaanagagagnggtaaaccaagaacnacctagaaattattcacatcatcagttgaacaggagcggttaanatagccaaggcctaagggatctagg

SEQ ID NO: 717539 - DNA, 869 bp, Homo sapiens
atgccgctcattcatataatttattatactaacatttaccatctcaattgtaggaagactagtatagcgatcaaacctcgtatctgtccctaaatatgctcggagaacggaataaatgacttatcgaccgtgtggcataaatagtctactctcaataaagccatcaattacccaatacatctcttagtcatgtgatagtgcccttatagcccattacttaggtgcttcgcaagcacctggtattgcggccgggatggcgcctgaggcactgtaactgagcttcatcaaaatacatcactaaaatgttataggccgtaagcagtacggttacaattatactcatcaggaaacctatgtgccaagtgacgtggtaggttcaatccagttcaatccatatcaaattttagttatttcaacgcacccatggggacattgcactctctcttagagaagggacacattaatggggagtccggcaacaaacacaacacccaacaagcacataaattattaagcattcatccctctgactaattgttttaacccaaaatcaaaacaacaaacctattttaggctggttccccgaaccttttgtcgctgccgacgccacccgtaaaggaaaacgccgcccgtgcctaatacgtaaactaacgcgtgaactcgcgtaacacgcgttcaggagagtcatgggcaaaagccaacagaccactttgatgcgcagggtgaaccaacttgagtccaagggaaaaaaaaaactcgtaagcttcttctataactgaagtctccccagtgacccaaattctccaagggagttccccaccctgcagaagcctaaaagaaaaaaaataagaagaaacccgcgagggggg

SEQ ID NO: 717540 - DNA, 203 bp, Homo sapiens
tacatcgagctcgctccgtttccccatacagagtaatcccagcttcacttcttgatcaccaccactgagtccacctcacacagtaccccaaggcttacacttctgtgattaccaccacggggatcacctcacacagtactctcagttttcacgttctttgatacgccaccagccgaaggagacacctccatacggtgactccg

SEQ ID NO: 717541 - DNA, 173 bp, Homo sapiens
attgtacatgacgtatgatgtctagccttctgccaggctagtacggacatactatctggtgggcactgtagcggaaacttgaggatgaaatcagtagagctgcatgcacttgaaaaggcatggcctgtactcctcacttgagtgcaaggtccatcgaccaaagccctgttctg

SEQ ID NO: 717542 - DNA, 324 bp, Homo sapiens
tcagaaaggcggcgccgggagcttgtagagatcccaggcccttcgggttccagtctggttaacatttgcccttggaactactcctgcacaaggtctcctaccaccttctgctggagctgtgcttgggcatcagcaatgagtatgccttctatagtgctttgtgttagctgacttttctgcaccctgttaccttaggatattcagttctctcaacctcaagattgagacggtggtgggtatgcttcttcacttccatatgaccttcatgctgtactggaatatcacatgctacgaggtcatccttcacactactagtaagccaag

SEQ ID NO: 717543 - DNA, 197 bp, Homo sapiens
caggttgcccttttgaatccacagattcatgaacatatatcgataagtatctccattctcacttaaaatacatacgctgaagcggcacgcggtatcatgtcgtggcgccgcacttaacgcgaattggtgatacctgtcgagtacctaagttgtactctattatatacgtgtatatcattgactttaatacagcttct

SEQ ID NO: 717544 - DNA, 185 bp, Homo sapiens
ctagagtatccccccatgctgctctcaggatcggaagtactggcaacctctgagggcagggggagccggccgcaggaccccttccttatcgccgaccagtggcccgcgctgcccctgcaagctggactcggtctttgaggacccgctctccaagaagcttttcttcttctctgggccgccaagta

SEQ ID NO: 717545 - DNA, 755 bp, Homo sapiens
  misc_feature (594)..(594): n is a, c, g, or t
  misc_feature (646)..(646): n is a, c, g, or t
  misc_feature (732)..(732): n is a, c, g, or t
gggggctgaactgaaatacactagaagaggctggctacagtatcctttattaccatgtcagattaaatagctgctttaaaaacctgtgatactgtgaaagcacccacagaaacatgcaaactgatttcctacaaaaaatgaggggattataaccgatcagagtcacatgtcgtaacaatataaagggtggcgaacgcaaaagcagggaccacatgatcacacaagatgccaaagtttgacagtgatcttaataaattaagactgagtaacatcctgcctttagaaaaaaataaccccgaggtggacaccagggcaggggtggtggagaagaatcatgagtccagaacaaccgttaataacatgcttgtgagctatgcggatgtataaatgaacacaccccgaactaggtatcgaaaaggctgcaaaaagatgcgatgggatcatacaggtgatccataattgttgccaagagaataaacaatgggcgtaaaacggcggttctaaaccttgaactgatggatttgggattggttcgtaaaaacaaaaaaaacactctgggaataataaattcacaggttttccaaaaaaataagnaccatttaaatatctgcttgccggtcggctagagcaccccatgttttaaccntgagtatcctatgggtaggggccgtaataaaagataatttggccatttagcctttgggggggtgggtccccttgtaaacggcgcgnccctataaaaagccggggtggga

SEQ ID NO: 717546 - DNA, 116 bp, Homo sapiens
ggagccatgtggggcgtcttggctggatggggagccagaagcctggaggatgcaagcattcttacttgctgcaggactctgtgcgcgagttgggctggcagtcagatttctggggg

SEQ ID NO: 717547 - DNA, 126 bp, Homo sapiens
  misc_feature (38)..(38): n is a, c, g, or t
ctgtgtcactctatgtattggaactgctgatatcattnatagtttggtgaacatgcagaagcacacgagtaagtactccctcatacaaacacctgtgtattcaaattaattttttggctttttttt

SEQ ID NO: 717548 - DNA, 627 bp, Homo sapiens
  misc_feature (575)..(575): n is a, c, g, or t
  misc_feature (581)..(581): n is a, c, g, or t
gaaaatcatgctcaagtgtgaccccggtgaccagaatccctgatgttgatgggctctgcacctcgatccccacagtcttgggatctcagggcacaatggtggcacatgggtgggctctgtatgcagacccatttctctttggaatgtcaggcaagtaagcgtaactacgaattcattgtgaacagagagtccttacagcagaggaattggtgtgccttaaagatacatttcggggatagtatgggggcagactgtgtagccagaatgccctgtgcatgctgagcaagagtccagcaagtagagcagagttgggcaggcaggtgcctaggaactccgcctgcttcctgtgagtgcctgcattgaggaaggaaatctggcccgttgggttgtcctggttccactgctactgacccagaggggaactgagggctgagttatgaaaagataacttcatgaacgacttaactggcccagaagctgatttgcatgaaaatctgcactcagggtctgggatgaaggcttggccagcacttccagtttagaaacgcaatgttgccctagaagaccattattgncggtcngtttggacggaacgaaagagaaccacacaacaatcagataaacatt

SEQ ID NO: 717549 - DNA, 404 bp, Homo sapiens
gtttttgaaagtaggaccacggagaagaagtgccattttcatcacatcatacaggcatactttggagacaatgcagatttggttccagatcactgcaatgaagcaaatattacaataaagcaagtcacacaaatttttttggtttcccagtgcatataaaattttatgtttacactatcctgtagtctggtaaatgtgcaatagcattatgtctaaaaaacaatgtacataccttattttaaaatactttattgctaacatgttactggcacaaacacgaagtgagcacatgctgttggaaaaatggtgccaatagacttgttggtcacagggttgccacaaacttttaatttgtaaaaaatgcaatatcagcaaagtgcaataaagtgaagcacaataaaacg

SEQ ID NO: 717550 - DNA, 640 bp, Homo sapiens
  misc_feature (550)..(550): n is a, c, g, or t
catactgagcctacagggctggagcattcaaagattcgcgaactgttgttgggtgcaggaccccaaagtaggagctgctctctttggaagagtaaaaccatgacaacctcagaagagagtctgggtctcctccagatgacactcagcgtgtgtacaaagaggagacatgggtacacattggtagaaaaaaacagaaagctctcaaaagtggccttagagacatgggatgccacaaatggggaaactgaggtccaaagtgtgagacaggctcagctcagagacccatgggcagcaagcaccaatgttagctaaacttttgcttcttaactcgggatccctgcgcccaaacaaccagttaggcttggtgtaatatacgctccactttgctcatttgttcatatgtcacgattattaatcaagtagtctaacagaaggtgagggcagaaaaatagacacagcccccaccatctaagtacttcctggctatagaaggaaatgcttgaacaccaggggagacaatgcttggagagggatatggcacagggatggngaaagtgctttggcttgcaggaaaccctgagaaagtgggagaaaagcattttctcccaaaggaactaataatctcattatcactcctaac

SEQ ID NO: 717551 - DNA, 234 bp, Homo sapiens
tgcggtctcatatttaggtaaagctctaagactcctgagccatctttatatgtaagctggcttacctaggctggggcttgaactaagtaaagaagccaaggagtacagatctacgatagcagtagaaataagtctcattctaacaacattgcaactactgttaagagtccaccccgatgaagctgtatcagcatagtgtatctatggactgaattctataatgtatatattggt

SEQ ID NO: 717552 - DNA, 750 bp, Homo sapiens
tctggctaccggtgactaaaatggaagcgtttgggggtcgcggtccgaacttggggcggggggtccggccccaggacagtttaaccgaattccgtccactcccgattccttcagggatccggcgtctgcactttacagaggtccaatcacgcggacccaaaacccctagggtagaccgggacctcagtcctcggcgtaaatgttcgagggcggagtgggtgattggccgcaaactaatgctggggatcctacggctcctgggctcgtttccgcaactattctctcgctattatgcgatgtcaacaacagtaccatggcttggtgtcgcctcggggcgaactaaccgctgggaattcccatgttatttggaacgcaatgttcctccggcgccagatgggtgagattggatgagagagacgctttctggggagacgatggggaccacagtctaatatgtcctctaaagagcttattacattccatgggctggaccaggggcccatggttacacgccgggcgctccgaaagtatgaacacctctttggtgtgagaaaccaccagtgggtccatccgagagggcttatgcgctggatggagaagaagacgtcttccctccggtatatgtgtggcgactatggctgcggtgtgtgtaacgccttatgagaaggccccctttcgtctggggcccatctggggttcatggggtggccataacttggggcctacaagctcttctggtctggcagaaaa

SEQ ID NO: 717553 - DNA, 347 bp, Homo sapiens
tcagcacaccgcgttggggttcgtttagtaaatttgaggcccacggcatccgtgcacggtacgaacgcgtacgtggccatcggccattcgcgtttcagcgccgcattaattcgggcgtacccgccgtttgcatgttggtccacatcacagtttcgccgtgcaccgtcgtcattattcatatacgtcgcagttagcgtgcgcccggcgtatatcggcgccatttcaatagccagaggggtcccagcgttcacacacatgaaagtgggtcagcatgcatctgccatcattcaacaattttccacggtaaggtttagaagtgtattataagggaacaaatatacgtggga

SEQ ID NO: 717554 - DNA, 241 bp, Homo sapiens
ggaccagcccgggtatgcttccaccatgttgtgatgcagcaagaaggccctcaccagatgaaggctcacaatctttgacttcccagcctccagaactgcaagctaaatatttcttctgtttacaaatatctagtttgtggcattctattataacagcacaaaatggattaagacaaaaaaattggtaccaagattggagttgttgctatagtacatacttgaaaatgcggaagtagctttg

SEQ ID NO: 717555 - DNA, 341 bp, Homo sapiens
tttttacccccttttttatgggggatttcaagtcccccttttttttcccggttttttccagggtccagggttaaggggtttttttccaaacccccacccttttgggaattttcccttaatcccccctgctcctcctgggggcctgaaaaaaggactggcaaaaccccctttgttgggttttgggctttaaaccccgaaaacccccccattttttttccccggtggggcccccaacggggggggccaggttttctttttcccccaagggttttgcccctttcccctttttccctgactccaggcctgaaccccccccggggggtaaaaaatttttgttatta

SEQ ID NO: 717556 - DNA, 210 bp, Homo sapiens
tgcctgtacttgtatcaaggttttgcatatattttgtcacacgcgatgtccgagaagctggcatcctccgccctagcagcacatctgccccacgtattcttcgtgtttccgtgctacctctatactcgttcagcagcctggaagtcgacagctctatcccagactttcttcatttggctcctatcattgtgatacgaaataggctcattt

SEQ ID NO: 717557 - DNA, 591 bp, Homo sapiens
  misc_feature (407)..(407): n is a, c, g, or t
  misc_feature (411)..(411): n is a, c, g, or t
  misc_feature (420)..(420): n is a, c, g, or t
  misc_feature (427)..(427): n is a, c, g, or t
  misc_feature (435)..(435): n is a, c, g, or t
  misc_feature (441)..(441): n is a, c, g, or t
  misc_feature (444)..(444): n is a, c, g, or t
  misc_feature (449)..(449): n is a, c, g, or t
  misc_feature (452)..(452): n is a, c, g, or t
  misc_feature (455)..(455): n is a, c, g, or t
  misc_feature (471)..(472): n is a, c, g, or t
aacacagatatcgcccaggagctctgccttccccccgttaaatgcactgctccatgctgggctgaagatgcaatccaggccgccctggctgatttcaattttaaacaagaaccccaaaaaggagaggcagagaagaaatgagccctccctcggggaagcctccagcaggccacaccagctgtttcccacctggtgtgcagtcaccttagatgttcagaaaccgcttcctttcccctgaagaggtatgagatacgccccatacttgctgttcccgttatgactttcatgcaagccaaaaacaccgtttcattgttttgaatcctgtggtttttttcagcccccttttatcgccttaacctagttaatgtatattttgaattgtgtgtatgacctcagaactgaaattnatantgaagtgcnagttttnatagcccntgaagngcntaagnatntantttacctgattatttnngggggaattacccgtagaatgccctggtttgaatattttatagaacccattgttgtacataaaacagatttgggcatatatatatatgtattaaaaataattaaataatgggagattga

SEQ ID NO: 717558 - DNA, 177 bp, Homo sapiens
  misc_feature (11)..(11): n is a, c, g, or t
  misc_feature (30)..(30): n is a, c, g, or t
  misc_feature (41)..(41): n is a, c, g, or t
  misc_feature (122)..(122): n is a, c, g, or t
  misc_feature (166)..(166): n is a, c, g, or t
gaattcggcanaggaaaaagacaagaactnagaagggcccnctgactttagccacaaggcaatctcttgtatccctgcaagtaagcattttagtgagataggagggcaaatccaagcttcanagactgaaatgtgactggaacagtgagtagaagtaagtcctttnttaaaagccat

SEQ ID NO: 717559 - DNA, 247 bp, Homo sapiens
gatgaaggcgtttagtgaaatctacctattttatggtatataagtctcattaagttgtccagctgtggaaagaataataacagatatttatttattgggccagttgctgtgggccacaaattatgctgagctttttttaatgtcagtttcattttattttattttttgagatggggtctcactctgtcacccaggctggagtgcaggggcgcaatctcagcttattgcaacctctgtcttccaggcc

SEQ ID NO: 717560 - DNA, 803 bp, Homo sapiens
gagaaaactgaaccgaaaccaaataagttcaacgacacgtgcgtcagttacaattttacatgggtcgtctattttacccgtcctacaagcctctagagatacttcgagatctcccttcaccatttccgacgcgtcatctacaggactcaacatttgttgtagccacaggctttccacggacttcacgtcattatgggctcaactttcctccacctatcgtgcgtctccagtccgctctaactcagatagttctcacgttgtcacgatcgcaaaactatctactattgtggctttcaggaagtccggactcgcctagatacgtgacaattcttcgtaagatgtggttggactatgttcctgtatgtctccatctattgaatgacgggtctctaaggaaaaaagagacagacaagaatacacaagagaacacatacaaaaagacacagattagaacaagacatatacaatacagaaacgccgtgcaacggaagcctaggacgcagcgaggagacaaaggatcctggaaaggcacagaggctgcatggggtgctagcagccagaaagcacctccgaggccatcgcccgcctacacggggcggctgtacggagcaggaagaatccagcagagcgcgtgcggcctgtgtcggcggaagaatgccaggcgaacggagaagcaggaggatcccacagaggggacaaaaagggaaaagggggtgggaggagacccctgagcaacctggcaggggcgcgctatgaaaggaggaggtgctgaagccgcgaagacgccgaggggcgggctgaag

SEQ ID NO: 717561 - DNA, 995 bp, Homo sapiens
  misc_feature (575)..(575): n is a, c, g, or t
gacccagagagccctgagcagtcccaccggcgccgcggtctagttacacatcacaccccgggaggagccgcagctgccgccagccggcccgcagtcaccatcaccgcaaccatgagcagcgaggccgagacccagcagctcgtcggcgccgcccgccttcgtcctgccctggcgtcctcatcccgtccgtcgagaccagggcctaccccgtactggatctcagcgcaaggcgcgggtgtgctcgtgtgcgactcacctgcgtcgcgttactgcgcgctggccagacaagccccgggtctctcgacgaacggaagggtcttgggtgacacaggctttcactgttgtctccaatggggtacccgggaatggccactattgcgtccccccattcacaatagggtacctgcagcacacataggccatgggatttgcttgtaggcgacagaccatccacaagggtggacacgataacaacgagacgcaccttgaatcctcctatttggcacaccattggccttcctctgcatgggtgtgttcgccagcatgtcgccgtatagcatctgctgttccacaanttctaggcactgtctttccctcgggaacgtgtgaccgacccaagttggcagtgtgcggacacaaggtgtcagagcagcccccagtggggaagatcaccgcgaaggaccccccggttgaccccggatttccagacgcacttcgtggtgggcgtgagttaggaagggacttcgttcccgccaggagtaagcgccttctatcctggtttcaccgttttaatgaccgtttggctcgctttccttacacaccggtacccatattatcacgatcgcgtacccccttttagacaggcctatatgtggttctccttgcgccccaaacagcaacatccacgattagcattattgctcgcagacgcaagttagaactttacagaggttctataccacaagggcggcccattcggcagtaagccctcggaa

SEQ ID NO: 717562 - DNA, 776 bp, Homo sapiens
  misc_feature (249)..(249): n is a, c, g, or t
  misc_feature (634)..(634): n is a, c, g, or t
gccaggccgaggctcaagcgtgcacagcccaggctcaggctcaggctcaagcccaggccacaggcccaggcctcccaggcgtgacagcagcagcagcagcagcagcatcagcagcagcagcagcagcaacagccaccaccacactttcagtctgatggggcagccccccagggtgggggctggtggggacagataccccaaccctgcagcccagtgttcctttgacctgaccccgtatgggacggcagnggcatcatgaggacatctggctcactgtcatcaccaccaccgttgacgtggagctgatggtcagcttttagagatccgtgctgtcgcccactggtaataggaagaagtggctctgcgtgcttctgtctaccactatctgggggaaaagtgcgtttcttgacagacaggacttgactacatcttcttgggcctatgacaccgatttgctcccaggatacatgcctttttctgaacttgtctttagagagaacatcacccctactgacttgaatggaatacggagctgatggatgcctgcatcaacgtccactcgttagcgaagcttatacaactggggggtcgctgctcaagggacagatatggtatgaccttatagaaccttgtnccaggggggcacgggccctatggcttccctccgtatgttagaaggctggactactgtaggactataggttgggcctcccagatctcagtgaggccccagatgcaccgccctattgtgcttttcgtgcctgctaccgaggttt

SEQ ID NO: 717563 - DNA, 883 bp, Homo sapiens
ggtggtgctcctgggctgctgggcctccgtgagcgcccagaccgatgccagcccggccggtgacgacagagggcctcaactccaccgaggtagccctggccaccttcgtgaactttgcccgtcggaccaggccccccgggatctcccaggtctccagtggccctcctctcgcgccccacaggtcctatcacccagttcaccggtacagttgggccgacagccaggttttgtattcaaaaagcaagtgcatctattcattgaagttttatcacgctaaacccatacctcaaatcagtatttgtaaatttgttgaccaggattaaatccaatctacttttctgcattcatattacactctagtaaacctgcattatcctttattaatcgcacaactaacctgatgcatagaagcaattttagatacagtctgagtgcagagacaccgatctgataggtatctacacttgagagtgctcgaatcatatgtttccttcactataccagactggatattcctactgctgctaatatattagtatggggttcctctgccagacttcagattcgtttctgagaatttccttcggtccctgacgatcattcttctgtgcactgaataataaccctgtcaagcgttatcttgggtgagacccagggctgattaaagttgcacctatgataagctacgatttggagaactagttgtgaagcacattgagtgccctccagctatgggtttttacagcaatggcccggaaatcttgacgggtacgctgattcaaggcaaacaaggtcctatcactgttcagtccacgccttcacagcctctaattaacgcctccccgaagggcacgaccctcatgtgccggcccccactctccta

SEQ ID NO: 717564 - DNA, 362 bp, Homo sapiens
  misc_feature (9)..(9): n is a, c, g, or t
  misc_feature (15)..(15): n is a, c, g, or t
cccaaaatncccttntccatttttggcccctcctactgtaattaagcctatgccatttgttttgtgtggttttccttgcctataccttaatcattaaaaaattccttgatacccttgtcaagtaagtacccatgaaattttaaagtaagttataaaagaattgtcactggtcaggtgcagtggctcatgcctgtaatcccagcactttgggattagccctggcgtgatgactcttgcttatagtcccagttactcaggaggcttaggcaggagggttgcttgagctcagaagtttgaggttatagtgaggtatgatcataccagtgcactctagcctgggtgacagagcaagacattgtctc

SEQ ID NO: 717565 - DNA, 472 bp, Homo sapiens
  misc_feature (17)..(17): n is a, c, g, or t
  misc_feature (103)..(103): n is a, c, g, or t
  misc_feature (194)..(194): n is a, c, g, or t
taattaacccttaaaantctgttgtactgcccttcctaaacttggccctcccatcaattcaagattacccaaaaactgtcctccttaaactggtttctttgtnctcccaaccttgtgcacttgcctatcctattcctgtgtgctgcagccctgagtttttaaaaaacagaaaatgaggggcccaggtgtggtgngtgtcacgccctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 717566 - DNA, 656 bp, Homo sapiens
  misc_feature (31)..(31): n is a, c, g, or t
  misc_feature (54)..(54): n is a, c, g, or t
  misc_feature (154)..(154): n is a, c, g, or t
  misc_feature (649)..(649): n is a, c, g, or t
atctcccaggaactgttctaggcattggaangagcaaaagaaatcaagaaagancgtatcttttgctttatatctgtactagtaattcaaaggataccgaattcttaataaaagtcaatagccttgctcattatgaatcagacttttatcattngtttaccactcactgaaaatgaaaagcagaaaatgcaagttacacttcctccttcctatcaatttcttgtaacatagtggatgattgttattctaatttctttgactccctaattagattttaagaagtatagtgaatattttttcttttcatatttaatgtctgtatagtggttgtacagatctctaaaataaggtggagaagaaaagagttctgaatgggggtaaaataaaaagtggaatgttgtgtgtctgtgtatgtaatataaaatatcttgttcatgtttttacttacatgtgagaatatacttattttcttctatagattcttcctattaaagaaattaaacactattcagtgcaaatagcataaaataaatatattaatatttttagataacattgtttcttcattgtataaacacataaaaatttttaagtcgtttcagttcattcagttacgagggggcttcacaaactgtggaaaatggaattnaagatat

SEQ ID NO: 717567 - DNA, 403 bp, Homo sapiens
gtggcctatcatatggtctatcttggagaaagttccatgcactgatgaataaaatgtgtattccatggttgttgggtagaatgttctgtaaatatctgttaaattcatctgttttacggtacagtttaaatcaattgtttctttgttgactttatgtcttgatgacctgtttagttctgtcagtggagtattgaagtcccccactattattgtgttgctgtttatattatttcttaggtctagtagtaactgtttcataaatttgggagctccagtattaggtgcatatatatttagaattgtgatgtcttcctgttggacaagaccttttatcattacataatgtccctctttgtcttttctaactgctgtggctttaaagtttgttttgtctgttataaat

SEQ ID NO: 717568 - DNA, 432 bp, Homo sapiens
tcatcaagtgaaggaaagcggctgggctatatccatcgaaatttggctggaaacagattttctgatcacgtagccctttaatcagtattccaagcctgggatgatgctagaaggggtggagaagaagcagagatacgtgttggtgagcacacaagacttaatatggctacactaagaatgacctgggaagccaaagttcagctcaaagagatttggattaattctgggtttccagacgatggtgcgttgacacaagtgtttactagcactggaccagataataattgggatgtggtaatctccctccgggccttgggtgtgtaccccaaggtatgctatcataaggaaacgaggaagattctcaccagtgaagggcgtaatgcacttatccacaaatcatctgtcacttgtcctttgagcagccaagacatg

SEQ ID NO: 717569 - DNA, 235 bp, Homo sapiens
cacgagggggatcattacattccattcttttgcggggttcaacggcctccaggaatggcgatccaggtgtttcgtccttcattgataattcctccgctctcaacaaccctcatgtcaatctgtaaaaaatgcacaatttaggccacaaaaacaacactccccccaatgagcctcagcctaatcagggtgtcaaaaagtctacagggcccttgaagaaatggcacttgattcaata

SEQ ID NO: 717570 - DNA, 191 bp, Homo sapiens
gctagtgaccatcattacgggatcactagaggttgtgatccttctgaccaacacgatgatctcccattctgaggtaatctaccgtaaaaataggagataaaaaaaaaatatctgggcgtggtagcacgctcctgtagtcctagcgactcgggaggcagaggcagaagaatcacttgaacctgggcctctag

SEQ ID NO: 717571 - DNA, 489 bp, Homo sapiens
ccaaaacctttaccagctagaaatctgcataagattcctgccagttagaataaattcgtacattcattcgttgattccaaagtatttccaaagaactgtttatgtgcaaaatcctgacgcaggtactttcatgcagtctgcttcatttaaatcttcaaaaaccactgttaaagtagataggattggggggaaatgaagagaagttggttgataggtaaaaaaatacaattgatagaaggagtaagttctaatattggatagtatattagagaaattgtagttaacaataatttattgtgtatttcaaaataactagaagagaagaattgcaatgttcccaacataaagaaaagataaatgttttagatgatggatatccccattaccctgatttgatcattgtatatcacacacatgtatcaaagtatcacatgtactccaaatgtttgtacaactatgatatatcaataaaaaaatacaaaataaaaa

SEQ ID NO: 717572 - DNA, 533 bp, Homo sapiens
  misc_feature (352)..(352): n is a, c, g, or t
ggttctttgtttttagttgtgttggcggcggtggttcggcaacaaggtttgtttccctgcgcggtattcccccctgagatgtctctgggtgagataacgccgtgtgttgcccggctccttaccgcgtggtgtttaaaccgcgccgcgcccctgatgatcgctgtgtatacacgacctccacctattatagggcgcgcgtatagctctctctcccgccagctccgtgacagagcccgatgccgccagcgtaggtcctcttgagtgccgagggggagaccgcgcccgcgcgtataccttctgtagtagcccaaaccacatataacgagagtgtatccacatcggccggtgtcgncggacaattatatcgccccggggaatctcgcgcccctttccgggcccgcggtggtaccacgaaatcaacaccccaagcatcaggtgtcttttgttggtgagccctttctaaaccaaagccccttgggtttttccccaaaaaaagggatcaaaattttttggggaaaaatgggcccaaaaaa

SEQ ID NO: 717573 - DNA, 203 bp, Homo sapiens
  misc_feature (158)..(158): n is a, c, g, or t
tctagaggatcgcatttgcgaggagtctcaactcctgactcaggtgatcactgctcagcctacaaagtgctaggattataggcatgagcactgtgcctggcaaacataacttttatatgcactgggaaaccaaaaaaattaatgtgacttactttatngtgatattcattttatttgcagtgcgtctggaactgaacctgcaa

SEQ ID NO: 717574 - DNA, 157 bp, Homo sapiens
gtcgaccaagtggatatttggagcgctttgaggcctaaggtggaaaaggaaatgtcttccataaaaactagacggaagctcagaaacttctttgtgatgtttgcattcaactcacagagttcaccttccttttcacagagcagatttgaagtcgacg

SEQ ID NO: 717575 - DNA, 240 bp, Homo sapiens
gcacatcacacactgacagagaggcactccggatggtggtgaggacagcgactcttaagatgggacatgggcgtgtctggccacactggaatccagtttaggctgtatgcggaattccacctggaaagccaggtgttttatagaggttcttgatttttacataagtgccaataatgtgtgagaaacttaaagaacagctaacaactaaagtgtgaggacggttaataagaaaacaaaaag

SEQ ID NO: 717576 - DNA, 421 bp, Homo sapiens
taaaacatgaccagtcccgaacgtgatgactttactgcccatctaccaactgtaacctcggcgccggtgacgtccctcccgctggtcaacactaccggaaccagaaacctgtgaaggtcgaaacagctgagtatcctgtaataatgttagcgttgttaataccacctgctttaggatagaatgtaaatatgagagctattgttcacataactcaacagtaagcgattgtcaagtggggaacacgacagactactgtaccgtaccacggccactccagtgccaacagccaatactacagctaaacccacagtacagccctcccctactacaactaccaagacagttactacatcaggtacaacaaataacactgtgactccaacctcacagcctgtgcgaaagtctacctttgctgcagcca

SEQ ID NO: 717577 - DNA, 222 bp, Homo sapiens
tttttttgggggggttaaaaccccccccccgggaggccccaaaaacccccttggaaaaaaaaaaaaacccccccaggggtttcttggggccccctgggggggggggtttcccccggggccctttgggccccttgggccaaacccaaaaaaaaatgggggttttggggaaaaccccaaaccccggggctaaaacccccaggggggcggggtttttttttttta

SEQ ID NO: 717578 - DNA, 266 bp, Homo sapiens
atgaccacatcaagaccgccctgtctagtaaggacgggctcctgcccactaagtaccggctcttccggtagaaccgctccgcggactgacaggcccagggacctgaacctggctcccgttcccgtgcgttttaggttggacactaatttagtcaagaagcctgtctggttgtatcaccggtgcacctaatgtcaccacagcacccacgctgtttgcattctttccggactcagtgtgccgatcagtggcatcagtatcaaccctga

SEQ ID NO: 717579 - DNA, 273 bp, Homo sapiens
  misc_feature (120)..(120): n is a, c, g, or t
ggggaagacctcacaatcatgtcagaaggcaaggaggagcaagtcaagtctcccgtggagggcagcaggcaaagagggtaacttgtgcagggagactccccatttttcaaaaccatcagntcttgtgagacttattcactatcacaagaacaacatgagaaagacccgcccccatgatttaattacttcccacagggttcctcccagaacatgtgggaattatgggagctacaagatgagatttgggtggggacacagagccaaaccatgtca

SEQ ID NO: 717580 - DNA, 268 bp, Homo sapiens
atctgcagtctagcagaaattgatagaacattgtaaaagagctacaatatataactttggggttgtgttgtctttttagggccacacccacagcatatggaggttcccaggctaggggtagaattggagctatagctgctggcctacaccacagccccagcaaaacaggatctgagccatgtctgcgatctacaccacaactcatggcaatgccagatccttaactcactgagcaaggccagggatcgaacctgagtcctcatggatg

SEQ ID NO: 717581 - DNA, 368 bp, Homo sapiens
  misc_feature (267)..(267): n is a, c, g, or t
  misc_feature (274)..(274): n is a, c, g, or t
  misc_feature (285)..(285): n is a, c, g, or t
  misc_feature (295)..(295): n is a, c, g, or t
  misc_feature (339)..(339): n is a, c, g, or t
  misc_feature (346)..(346): n is a, c, g, or t
  misc_feature (355)..(355): n is a, c, g, or t
  misc_feature (360)..(360): n is a, c, g, or t
tttgtgtccaaagtgtccccaactgccctgtgggctcatgcccttggggtgggcttgtgcccttgcaagggcttggccacttggcccttttggagcaaacactttgtgccccccatccccccccctcaattttagcccagtatcagcccctcccatttcggggctggggtagggggacccaggccctccccgcctcctccctggtacacagggttttgtggggcccccaagcccctcctgtgccccctcccatccatagtgcatggngtgtggngcccccagggnttcaggacanatcaggcccccccttgtgtttacccccatcccccctgtgaacgngcccctnaataaagtnggggnaacgagga

SEQ ID NO: 717582 - DNA, 335 bp, Homo sapiens
gggcggctggtctggaacttgagacgcacatcggtgatgtcaaaagattttcccaggtacagcgtgaggttgatggagttggggtactgcacccagaccagcatggtctggctttgcccccaggtggtgtcggcctggttgttgtagtcggtcaggaaggttgccccgtgatgaaggtggggctgcccggtgtcgcacaggtgacaggacttggtgacaccggtcaccccggtctgcacacagtattcctcgggcggagtcccacacgtgttggtggcccccacagtcacgttgaaagcggcgttgacgaaatcgggcatgcagcgctgcggccg

SEQ ID NO: 717583 - DNA, 2392 bp, Homo sapiens
tgctgtccagggtgacaattctcaggtgctgcagctccttggaaggaacgcagtggctggcctgaaccaggtgaataaccaagggctgaccccgctgcacctggcctgccagctggggaagcaggagatggtccgcgtgctgctgctgtgcaatgctcggtgcaacatcatgggccccaacggctaccccatccactcggccatgaagttctctcagaaggggtgtgcggagatgatcatcagcatggacagcagccagatccacagcaaagacccccgttacggagccagccccctccactgggccaagaacgcagagatggcccgcatgctgctgaaacggggctgcaacgtgaacagcaccagctccgcggggaacacggccctgcacgtggcggtgatgcgcaaccgcttcgactgtgccatagtgctgctgacccacggggccaacgcggatgcccgcggagagcacggcaacaccccgctgcacctggccatgtcgaaagacaacgtggagatgatcaaggccctcatcgtgttcggagcagaagtggacaccccgaatgactttggggagactcctacattcctagcctccaaaatcggcagacttgtcaccaggaaggcgatcttgactctgccgagaaccgtgggggccgaatactgcttcccacccatccacggggtccccgcggagcagggctctgcagcgccacatcatcccttctccctggaaagagctcagcccccaccgatcagcctaaacaacctagaactacaggatctcatgcacatctcacgggcccggaagccagcgttcatcctgggctccatgagggacgagaagcggacccacgaccacctgctgtgcctggatggaggaggagtgaaaggcctcatcatcatccagctcctcatcgccatcgagaaggcctcgggtgtggccaccaaggacctgtttgactgggtggcgggcaccagcactggaggcatcctggccctggccattctgcacagtaagtccatggcctacatgcgcggcatgtactttcgcatgaaggatgaggtgttccggggctccaggccctacgagtcggggcccctggaggagttcctgaagcgggagtttggggagcacaccaagatgacggacgtcaggaaacccaaggtgatgctgacagggacactgtctgaccggcagccggctgaactccacctcttccggaactacgatgctccagaaactgtccgggagcctcgtttcaaccagaacgttaacctcaggcctgcagggctgcctctgcccctttccctgactgtcaaggacaactgactcccccatcagctcctacttacttccgacccaatgggcgcttcctggacggtgggctgctggccaacaaccccacgctggatgccatgaccgagatccatgagtacaatcaggacctgatccgcaagggtcaggccaacaaggtgaagaaactctccatcgttgtctccctggggacagggaggtccccacaagtgcctgtgacctgtgtggatgtcttccgtcccagcaacccctgggagctggccaagactgtttttggggccaaggaactgggcaagatggtggtggactgttgcacggatccagacgggcgggctgtggaccgggcacgggcctggtgcgagatggtcggcatccagtacttcagattgaacccccagctggggacggacatcatgctggatgaggtcagtgacacagtgctggtcaacgccctctgggagaccgaggtctacatctatgagcaccgcgaggagttccagaagctcatccagctgctgctctcaccctgagggtccccagcctctcaccggccccagctgacctcgtccattcagcccctgccaggccaagcccagccactgccctcccgggcagatctgggcccaggcacctctgagtccatagaccaggcctgggagaatgccaagctgcctgcccgaggctggtcctgaaggcctgtctcccactaaccccgccttccagcactttctgtcattccaggctgggaaagtctagagccccctttggcccctttccctgactgtcaaggacaactgactcccaggcttcctggtgggtgcagcccactccctctgccctctgctccgttccctgggggctgggactaaagaaatgggtgtcccccaccccatcagctgggaaagcccaggccgcaggagtgggatgcccgttggactttgcccctcacactggcccagcccctcacactgccccaccccgagaaccctcagctctcaaaggtcactcctgggagtttcttcttcccaatggaagtggcttaagagccaaaactgaaataaatcatttggattc

SEQ ID NO: 717584 - DNA, 156 bp, Homo sapiens
ggcttggcttaattttttcccaattttttggttgattatggggttccgcctattttggccaaaattggcttggattctaaggtatatccaccctcggctctcccaagggtttatagaaataaaaagggtgtagagcaacccttccccccagaaaga

SEQ ID NO: 717585 - DNA, 296 bp, Homo sapiens
acttagattttgcgaggtggtgtatgaattcgaaacgtcttatgtgcgcatagtgcttatagtcatattgtggttttgctaccatgataccttatcgctgcaagccaactgcggggaagtcctggccctgtagaagtgccacctatgactaccaaattctctgctagttgcttcctggtgtctatcggacactgtataagggaatccaatattaaagtggcaactgattgctcttcattatcttgttcaaaaagaatttccacaactgaatctctgattgatccaaggatatgtaa

SEQ ID NO: 717586 - DNA, 742 bp, Homo sapiens
  misc_feature (421)..(421): n is a, c, g, or t
  misc_feature (424)..(424): n is a, c, g, or t
  misc_feature (584)..(584): n is a, c, g, or t
  misc_feature (598)..(598): n is a, c, g, or t
ttagggtcctggtggactaggtcggcttcgtctccttatccagtcgcgagtatctctgccgcaaatagtgctccgccagtatcatcggttcaaggccaagtacagcatccgtagacttgtatctccctcatcttattgctatttatatggaaacatgggagactacatggtagcaatgacatggtatcctcatggtcgatctggacataggttcataatccaggatgctatgttgggacaagagaattaacccaagagccctggaaacgagagacatgggtcccaaatggatcaacatcacgaaggttctactccagtcggacaatgtggtgattaccagcgacagctggaacgcaagggcacacgtcctagcattttcttaacactgcaaaatggttttgcacgtgatttaacggctgcntanttagagatggtacaggttctgtcctagaatgcccactatcacgccacaaatgtttcccactttaagtcccaggataatcattgtcctccctgccgtagaatgccattgaaaactccgatgtttggcaggatcggtcctatttgtgaaatctccctatgtngggagattaacaantggacttagaattcagataaattaacctggaaaggcaagagagtaacgacatagataaaaaccacatgtaacagtgacaaagacactttgtgtggggaccggtccgaggggcctccctccgaaagaaaacagttcttccagaac

SEQ ID NO: 717587 - DNA, 1301 bp, Homo sapiens
ggccgcagccggggcctggtgcagcctccgtggtcgctgtcagtggaagcgcagtgcgtgccaatggaacccgggagcggtcgctgctgctgagtgcggcagtgtcgtgcagtccaaccgctgattgccctgcaccccctccgcgtgtgtggtccccgcagaggatccaactaaaccttgaactaagaagaccaactgtgttgtgatgcagggggagccatcagctgcctcagtgccgttcagggacagcaacgggtgtttctcgaaggccggagcaccgtacacgaacgcacgtcccgtaatcaggattacacttggttgaactactccgggagccaagccatctaacgagaggatgaaccaggacctgaccgatggcacacttgaaactgacgactacttggcacagcctcgaaagctctggcctgctggcccatggggaagatacacgtagtcgcagcgctagccgcccgattgacacggccaaactttcgctgaggcccgcaattctagtagcacccaaccaagggcaattacaaaggagagcagaactcccctgattaacaagtgatcaatcaaccggaagaggagtgcacgaagacaacgtatcagaccacaagagcacatagacattgtgccccacacaaccaccgagggcacgcgggacgctgcatccgggctcgaacagggtacaactacgtcttaggagaatgagagagggcattgggcactgctcctactacggacgacggaagcacgcgagatggacacatagcgaccaaatagtcggacatgggaggcgggccgcgtacagacagtaccacgcgaacccctatgcaaccagacacgcgccaacaggacgaccacaactacacacgacacgacaggcccagtacacggaacacaacacgggaacaggagacaggcccgcacgcacaacgccagcaaagaccagagaacacacgagaacgaacaacagacacagaccgcaccacacccagaccacaagcacgaacagaacgccaggacagccagcgagccagcacgagaacaagccacagcacggggccgccaggacgaccagggccacgcgccgcaacacccacaacacacaagcagcagagaggcaaacaggcggacggaacgccagcaggccagaagcgcgcacccaaaacagcacagagcaccgaaggcgcgccgcgaaacacggggggccggacaggacacccaccaggcacacgagagcgaaaccaatgaccaaagacgcgacgccccgacaggggagccacacagcgacccgc

SEQ ID NO: 717588 - DNA, 154 bp, Homo sapiens
  misc_feature (9)..(9): n is a, c, g, or t
gcatcgtanctaatggtcggcatctattactaatggtcggcatctttactactggtcgattcttatactaatggtcggcatcttatactaatggtcggcatcttaactaactggtcggcatctttactacatggtcggcctctttactcatgat

SEQ ID NO: 717589 - DNA, 1861 bp, Homo sapiens
  misc_feature (1)..(1): n is a, c, g, or t
  misc_feature (576)..(576): n is a, c, g, or t
nctgtttgggatgtggttcggcgcctgttcgtgcttcgctgttgcagtcgacttcagtactcgtggcgtgtgtgtttttgttagtgtactgcgctgcatcgctcttctatgtggtagttgaacgcagtcttggtggcctccccccggtggttctttcatgtctgtcgtcgagatgtgccgctgtgtttgtgcttcctcctgttgtgggccgtccgctgctctttccctctccgggggggggttgatttttcttctccttcgtcctctgttgtggtgagattgtctcgtggtcgtccctcgtcctttcctccctttgtgactgtggtgctcacactggcgacagccaggtggtgtgttggaccgaccacgcctgtgttgttgctcccttggttgccaccggctgcgtggggccgaccacccctctttagtcttcctcttcgtgcgtgtttttcttcggggagacagctccttattttgttctcgcccccccgttgttgggtgtccctcccctacgtgttggcgccccttccaacagttgtggtggttgcgggagaacagacaccccacacgacaggnttttctcagcgcgcttccgttgtttcccctccggcgggttttacattacccggcaggccctccctctctaagggtgttggggccccccctgtccggcggggcactcacaggagagtgtacttcctgctcgcccgcgggcccctcaataagaggcggggttgcgcgcaaatagtttgttggagtacacccctctcttatatagagggacccaccccgggggggagataaaagttgttatcttgcgaccaccaacagagaggggctcttaataccttctccttattagccccctctcgtgcctcttaaataaaatcgaagcggagtttcttcttcgcgcgccgcctccacagacaaacgtctcacagaagaaattgggtgcctactgctaaacccacactcgtgtctctgccacacacgtctaaccccccaccacccacctctgggggagagactttttttggagaagataatatatttttgcggcgtgtttctcgcccttctgggttatatgacacacaggagcccaccccctttgcttacagcgagatccctcgcgtgttatattttcccccccccccagcggaggacctcctattccccacagcgacatcgtggggtatttcgagatatggcccccctccacagcccatattacactggagacaggtatatatggtcttccacacaatatatcgccccacacatcgtgggatatgagacacgccacacactgcgcacatatatcgcacatactatctcctcgcgtatactgtgcccacgcactgtcacacccccatggtgagattcggatatatatcccccacatagcgccaccacgggatatatattccccccagtataagaactctttcagaagatgctatacacagtgcacagatagtgtctcgtctctgtgtgcgcactaatatcgctctctctgtgtatatatatggtgtgtggtgtctatactcggagcccagactatagtgttatatgttaagacacacacacataggggacatctccacagaaaatagacgtcgccaggtgccacgccagataatattatggccgcccctttgttctgctatatttatagattggtataatttcttctgcaccacttccctgaacaacacatatttttagagtatttttgttggacatagaaaaatagcccgcgccactgtctttcccccaaagttaatggcccctgattctgaaatcacccattaatgataggccatagcctggcccttccccattaaaaataatttgaagacct

SEQ ID NO: 717590 - DNA, 190 bp, Homo sapiens
gaacagtggtatcaacgcagagtgcccattactgccgggccatactggtggaggcgggcgacatgtggttgtctgtgtgtttctgttctctgccatttctgaaggaatcagcagaattgggggaaaccccaaagggtgtctggggaaaaattttgaacaaaaaaagtcggtgtgttaatggtgagaggcc

SEQ ID NO: 717591 - DNA, 144 bp, Homo sapiens
tcatcgaaaccctacggaaacgcaactatagaaggcccccctaaataaccgcgttaattgctgtgcggtttagggtagatcaccaggttaatgaagggtttgatgaagggtttcgatgaggggttgatgaccagggtttcgatg

SEQ ID NO: 717592 - DNA, 822 bp, Homo sapiens
gttgtgctgctcgcgtggacaccgcaatgcccctcagttagcctcgtgcccaagatggcctgctttccactcgctagcattccgtcgggggtccgtgtcctgtctcggtggccggtaaccagggtcctctgatgccctgcaggcaagtacacctagcagccaatgtcgcgttggtcgcggcatagaccctgtgtgccttccaggagctgcttaccgtcgactgtgtgttccgcgccggcggcatcagaaactatcgcataagtagaggtactagcgagcacgatgcagcagccggccttggcatgttctattgtgtgtcccgtaatgatactcggtctcacactctggaacgcaagcacgcttatagataggccacgagtacattttacttaaatagcccacaggaacatcgagtcacagacggtgattgtatacgaatgaattacccagtggaccgacgcagttcgtcttgatccattatatgtcgagagtggcacgacaagagactcgtaaaccttggcacttattgactaattcgtgcacagtttgccttagcaaggcattaaacagagctactaacacggttgaccactactacttgcgaacggcgacaaggagggccgaacaaatctttcaactccagcatggcaagcccaaccgcttgcagcattgccccaattgggcgctcattagagtcgcgaagaagccttgacaaggcgaagaacccagtacgcacacaacggttggttcctatacggagaaatgcccatggtcagctctggacccatagtgctgtgcttgtcggcgattaccattggttgt

SEQ ID NO: 717593 - DNA, 890 bp, Homo sapiens
  misc_feature (27)..(27): n is a, c, g, or t
  misc_feature (311)..(311): n is a, c, g, or t
  misc_feature (330)..(330): n is a, c, g, or t
  misc_feature (888)..(888): n is a, c, g, or t
ggaattctgggagatatacctcaagtngagatttgggtggggacaaagccaaagcacatcattccgcccctggcccctccaaatctcatgtcctcacatttcaaaactaatcatagacacattcccaacagtcctgcaaattcttaactcatttcagcattaactcaaaagtccacagtccaaagtctcatctgagacgaggcaagtcccttccacctatgagcctgtaaaatctaaagcaagctagttacttcctaaatacaatgaggatacaggtattgggtaaattcagctatccctcacatataaangtgaacaacagtacataantttcctagaggtaaaataatttttgtttatataccccacaacaagtatgagtaatagaatattgtttgtattattatgtaattgtcctagaattcataaattactacattctcattccttggccaaatttctgtgatagaattggcagtaccatatattacattagtaccaagtacattttgtaggtgacaatactgctcttttcatcaataccactctttacatgatggattcatggctagcaaacagaagtgaattatcagtaaacttgatgcatttggcctttctgatttttagataacgagaaaattaaaagtaggtctcccagctgtttccattcacctaacatcatgtcatttatttattaacagacaccttatcttgtctcttgcccttgctatttattcatttgcatgctaaaatttatcctaatgttacaaaagataatgcttacattactgaatagaaatgagtaagtttattcatgattgcatgaagagaaaacttgtttcaatagggactgaagaggaagccaaaaaagtatatcaaaatgtgatnaa

SEQ ID NO: 717594 - DNA, 784 bp, Homo sapiens
cgcatgattcccagctcatagttcagtgtctacccggcagatgctgtacttcatgagttccttcagcaatgctggtgagcacatgatctgtggcaggtgtctcctgtgagtgcaaggatgccacaggtacacaaaccacaacccagccctgcctgccagaagcttctgtcctagggctgggagccacaaatggaaacgaactactgagtgttctcattaatgtcaggagggtgacaagagccacgggagggggacagagagcaatgggtggcacttaggggaggccctgagcagggacagccacgcagacacaggggtggggctgggacccaggaaccacagttcaccaactgaaacaccgagttctctctgaaaaagccccgcgtgaaattccctctgaagagggcctgcagaggccgggccgctggctgtaaggggcccttggcggagtaggaaagtgagtttcatccaggccttttaagtagacatgggcagggttcaggaaaaccagcaaaggagggggaagcactgcaggactgaccctagcgggagccactgaacatccaggagcgacaggacgacagagcccaggaggagcggatgctgccagagaggccagcggggggctgagcttggcagtgatggagctgcagaaaggatgttacagcccccacttctcccaccatctgggagagatcaggggctcaggtggcggtccacagaggccaacctcacagggcacagggagatctggggggcaacaagagcccctgccagcacaaag

SEQ ID NO: 717595 - DNA, 309 bp, Homo sapiens
  misc_feature (17)..(17): n is a, c, g, or t
agctgcgggaaatggcnagtggtggcggctccttcacccaaggtgcgtgcctagaagggcctcctgagtagctgggacctacgggtgcacacccacccatacataccctggctaattgtttgtattttttgtagaggtgtggtctcaccatgtcgcccaggttggtcacaaactcttgggctccagcaatcctcctacctcagcctcccaaagtgctggaattacaggcatgagccactgtgcccggccctttttgatttttagtagagacaaggtctcactatcttgcccaggctgaccttcctggct

SEQ ID NO: 717596 - DNA, 1223 bp, Homo sapiens
  misc_feature (536)..(536): n is a, c, g, or t
cagacattcagatcctggattctaatccagactcactcttcaggaactgtgagctcctcctcctcacacagtctaacatagaacgatgttgaaaaaaagcactggagagaataatgagcagttcgcaaatgaagactgtccccactcctcccggaaatgcgctgtcagctttgagcttatacgttaatactagaaaggtcctgcattagttttaaagactgggcgcctcagctagggcctaggtgtatacaaaactggtatgtatgtatcactgtccgtgtgagctaggggggaggagtcgatctgtgggcactaagtatttagtgacataacttcgtgtgtatcttcttcttgtcacagcggtctcttgctagcttcgtaggacacgcacttgttcctgttggcatcgcagttttacgctgtacatgcactttgtaaaaccaagcttgcgcctccatcttcgttgcatcaagtgcttaacttatctccctagactccattttctttctttttactataaagttttgcatcccatnttctcgatcaaccatacttttgttacccttaagatttcttttctcctcttacgacgtttttttgttagaatgaacgttcttaaacttacttttgatgcaggacaccttccttaaataacgttaacgactctttgtgcccttttctccaagacttgtctgtttggaacacttcctcttccttttccttgataccgaccctccatgtaaacgcggggtacacatctctggtaatatccttagcttactgcaagctttgcgccttgtgcccacttgtcacttacccaaaacttaaaacttttcaacaggagggttcctcttttacgtgacagacatcacaccaacggttctattggcccactgttaacagccttaacttacacaccacaagacagatacaccagaccccaaggcgcgggtgcgcagccgctgctctctctcagccgaacagctacaatccccgcattcgccaggggaggagccagcccagacggcctctcacaggagagaatgcacccaggcgcgctacatgcgtgggctcagcaccaaaggttgggaccccccctaatttcgtcgtgagacgcttgcgcacacacaaacaagacgccaacaacgggcacacgtgggccccggtcgcacctagccacgacaaccgctcgtcgctgaccctgcgggcaaacaacagcgcgc

SEQ ID NO: 717597 - DNA, 1431 bp, Homo sapiens
ctgctgaggttgcgcattcggtggggtcccgaattgcggggttcgatccggagagtcactggtgcatcccacgctagtagccgggcgaaatgtgctggatgccacaagagcaggacgaaatctagacaggtgcggataatacgtggatggatgctactgcgaaggctggagaggttctgcgatgtgcgaactttcatgcctactggcacacccagagaagtgcggtgcccccctgggcgttgctgatcttgccaaaagaatacaacagtgggggtcgcactggcacagggtgccatagacgggcaatggaggtgcagatgcagataggggccctggacgcgattgatcatgtgcacaactggagcctaggtcgtccacaaaagatgatggaccccaggatgcatgtgctaccgctggatgcacctgtctaggacctgcgtgcccctgggatccaatgggacatgagcgcgcataccaaggggtagaccctagcgggacgccagacatcaatcacaagtacagaccatccgatacaaaaaacccatgtaagtcgatagacacccgagctggagcgatgtagagtaagtatttagtttctgcgtgttagtggcaactaggctggccactctggcatcagcgggggcactcagggcctttgcggacacgtctagcaattgggctggggcaagaccgcggtctggatccccgtagtcaacgccccgagcccgcaaactggtctccccgatggagacacagccgaatctataataggcgaggattccccgttggggggggaaccttgggacatgagctgaaaaggcttgtgtggtatgagctaaagtggcatttgaatcagggggctgggcaccacatcgcattcgagtcgcacggattcatattgtgggattgaaaaggattcaataacaggagggacgcggctgtgctcgcttcgtgagcactgtgcccccatgggcccatgggtataccagggcagacaaccaccgagcatgaatgacgcttgtactgcaagtcctcacagacggggacggtcccattttctgtgacaaaatctggcgtagcaacacagaaatgatgtcacgatatgagaccacatgacagtacccacctacagtgcagtttccacagcaaagctataacctgaaatcgacaggggaccgccaccacgcgggtacacaccagcgggaacccgtgcagagcccaacggggagtagagacccgtccccgcggaagagcgagccccacacagtgagcgcacaacccacgagtagagatcacaagggggacccatgggggaacccatgggacgcgacaccaggtggagcaccacagcggagcagtacacgaggacagttgacacaacaacgggcgcaacacctgtcgccgaaactcgcatggcacgaaatgcgggag

SEQ ID NO: 717598 - DNA, 721 bp, Homo sapiens
cactaagtctcatgacagcattcgctgccatctgataggctatagcacttatcttacaagtaagcatgcttgctaggacgctctggctagcctgttgaaacgcatattataccatctctactagaattgagtgcatatactagcatgagactgacacaccagcttgttgatagatagacgcagtatgatcatttgaaccatgcaggtgagccttacagtgtctcatatatcaacatgagcactcgtatctgcatgacggacacagactcattttgacacaggatgacttcaatgctacacagtcgagcgcgtacatgcataagtcagagtctcatgcgtatagagcgcactattcatacacgtaggctccatacgaaggtatacaccaatctctagcagattaatctacagtcatgctatcactggctcacatatatgcaggtggtaggcatcatgcggaccttgaatcccggatgtccgctacatgtacgcataatcctgagtcgcgcacgtttaccatatgaagctggctacacggcgattatatgatcaccatattgtacttcactatgaccaggacactaagtacgtctgcagtaccactggacacggtaccctggataccattaacgtagttatactcacgacttttaacaggccaccaagttaagcaccttgcgcattccctcatttgcctagtagccttgaccccggtagcgcc

SEQ ID NO: 717599 - DNA, 290 bp, Homo sapiens
taggctaatgtgtgtgtgtcttagtttttttaaaaaaagtttaagaagtaaaaaaaattttgtttaatagtaaaaaaaggttatagaataggatataaagaaggtactttcgtgcagctgtaaaatgtttgtgttgttagcgaaacgttactacaaaagagtcaagtaaaaggccgggcatagtgcgtcacgcttgtggtcctagcactttgggaggccgagatgggcagatcgcttaagcccaggagtttgagaccagccaggaaaatgtggtgaaactgcgtctctgc

SEQ ID NO: 717600 - DNA, 240 bp, Homo sapiens
ctagcttggtcagtaccctttctggtcatttcttgtgtgtgttggcctttctttctttctttttgagacacagtcttgccctgtcaccagcatggagtgcagtggcgcaatcttggctcactgcaacctccgcctcctgggttcaagccattctcctgcctcagcctcccaagtagctgggattacaggcacccaccaccatgcccagctaatttttgtatttttagtagagacggggtt

SEQ ID NO: 717601 - DNA, 942 bp, Homo sapiens
gctgcaggatcagtgaggggccctgcgccagctcctgctagctcccttgccctttcgaggtctgaagccagcgtgccctatgggtcatgccgggctgagggccatgcaatggatggctctcaaggtgcgtgtccatgggcaaagatggtagtgggtgtcctgcctgtggtgccgccagtaccagattcccctgtgtcatcccatcattttccatatcctggtgccccccacccctggaagagcccagtctgttgaagttagcttaagtagggttaatatccagcttgaaaggcacgttgatttcgtgtaccctaccaggagcttcttgtttaccttgtaagggttagccttcatcttcctgtgtgctgaaacgctcctttgtgtgtgtgtcagctgaggctgggggagagccgtggtccctgaggatgggtcagagctaaagtccttcctggactgagagtcagactctctgcactgtgtaacttcccgggccaggctgcccctaatctctgtaggaaccgtggatatgtctgccatgttgccccgttatctcttttcccctttcatgttccaccgataggagcaactgcagactgaacagaggctcttactctttcctatgtcagtgttactgtgtgcttggtcttgttgactatatgccatctcaggacacttccgtaaatgttaggttccctgtcaagtatagtaccacgccgcccagtagtgcccagaaggaggtataatctggggcccaggcagggtaggctgaatatggcggaggccaacgtatgtgggacggggcacgtgaaactgagcgctggcgcagagcaggagggggaccgaagcgacgcagacgaacaacgggacagggcacgcgcgcaatggtggaaacacgcggacaacaccaaaaccatacagcgggcagccgaaaaccaaagagat

SEQ ID NO: 717602 - DNA, 441 bp, Homo sapiens
  misc_feature (7)..(7): n is a, c, g, or t
  misc_feature (20)..(20): n is a, c, g, or t
  misc_feature (37)..(37): n is a, c, g, or t
  misc_feature (55)..(55): n is a, c, g, or t
  misc_feature (68)..(68): n is a, c, g, or t
  misc_feature (80)..(80): n is a, c, g, or t
  misc_feature (155)..(155): n is a, c, g, or t
  misc_feature (176)..(176): n is a, c, g, or t
gctagcntcccaagcccaanatctgtcccccaaggcnggaggcttcccggccctngacccatcagacncccaagtccttnaattttgggaacttgaactggctctccttgctcctcaggttgcagcctattgtgggaccttgtaatcatgtaagntaatacttaacaaactcccgnttatatctatgtatctatctatgtatctatgtatgtatgtatgtgtgtgtgtatctatctgtctgtctatctatctatctatctatctatctatctatctatctatctatctatctatctgtccatcttattagttacgtccctctaagagaaccctgactaatacacacacaatctcttaagattgagtcaggaagaaattgaaaccctgaagagaacagtattgagttctgacattgaatcagtaatttaaaacctaccaact

SEQ ID NO: 717603 - DNA, 114 bp, Homo sapiens
aatcctacctttcttttcccctttcttcccttctggccactattacattattactgtaactactgagatatatcatcaatcataaaattctagggatggggacacgaatgttca

SEQ ID NO: 717604 - DNA, 224 bp, Homo sapiens
attgtttttgtggaaaccaaaagaagatgtgatgagcttaccagaaaaatgaggagagatgggtggcctgccatgggtatcatgtgacagagtcacagagctactggtctaatgatcaacatgaaagctctatctgatgctacagatgtgctcagagctagatgtgagatgtatgtcatcatatactactactctaagatatcgatgagactagtacacagcag

SEQ ID NO: 717605 - DNA, 345 bp, Homo sapiens
ttcttgtgctggagaggggagaaaagaggaaggatggagggaggggagggctgacttgtctggtgggaacagcccattgagtccatggctggggaagggaattctcacaagtggctgaagacgtgaacgcaaagggaacacagagtgaaaatccacacccaacagcaaaggataaagagccaggggacagcagggacagacaaaccagcagggatgcctagagaacgatttcaaggcctgggatgcttcaacctttatttttttctcctttcctcagggagcaggtaggatgccaggatgggactcgcatctgctctggttgatgaggcgctgtgaggatggcag

SEQ ID NO: 717606 - DNA, 380 bp, Homo sapiens
tagacacgggagactcgttaacaagggcgggagcagatcaaaagggggcacatgtagatgagggtgcaatatatccatgtggtaacctttgtggatggcactagggtgtcaatccagaaactcttcaccggtcttagggtccaacagatggggtcatacctttgggccgaaaagttttataatgtgacacttaatatttaaggtatgagatccattggggagagttaattctgtataagtcatgaggtttatggttaagattagcttttttttatttttaacctagatgtccaatggttctagcactgttggttaaaaatgctgttcttcctcccttgagttacttttatgccatggtcaaaaatcttttaggcagctag

SEQ ID NO: 717607 - DNA, 442 bp, Homo sapiens
ataatgtttaagatgtgtattgtgtgtataaaatctaaactacttacatgcaaagttttcaaatcagtgatgatcggctgggcgtggtaactcaggcctgtaatcccagcactctgggaggctgaggcgggtggatcacttgaggtcagcagtccaagaccagcctggccaacataataaaacccagtctctactaaaaatttaaaaattagctggacctggtggtgggcacctgtaatcccagctactcgggaggctgaggcaggagaatcgcttgaacccgggaggtggaggttgcagtgagccaagatcacaccagtgcacccaagcctgggtgacagagcgaaactccatctcaaaaaataccaacacatttttgaccctttggagtgtcaatggtcccagtgagcaaaagcttggggttacccaggcatagggaatc

SEQ ID NO: 717608 - DNA, 308 bp, Homo sapiens
ttagtgcagtgaatgttactaacaggtcttatatcagcaatgctcttaaagaaaataatcgaaagaattacactaaaattaacataacaatgaatatttaatatactaaattttaaatacctgtcgggagggcacagtggctcatgcttgtaatcccaccactttgggaggccgaggtgggcgaatcatgaggtcaggagttcgagaccagcccagtgaacacggtaaaaccccgtctctaccaaaaatacaaaaaattagctgagtgtaatgacggtcgcctgtagtcccagctactctggaacgtg

SEQ ID NO: 717609 - DNA, 201 bp, Homo sapiens
ttgttagagaaatttgggagaagctcagctctgtgggatcactccgtctgactttgtgacctacttagttccgtgggatccattggaggcggattaattactggcaatcagaacccattccaaacacatcaaatgatagtggcttagacctagggaagaagcggttgagcgaagaacccccaacaggtatgatttgagagt

SEQ ID NO: 717610 - DNA, 120 bp, Homo sapiens
gggtcgacacggccgtgtattactgtgcaaaagccttagatggttcggggagttatgggctagggagtgcttttgatatctggggccaagggacaatggtcaccgtcacttcagggagtg

SEQ ID NO: 717611 - DNA, 1788 bp, Homo sapiens
agcaagtctgtacggtccaagcggtcggtgcagtgctgttctgaggaacctgagtgagctatgagcacgttgagggcgaggttgttacatgtgcgtacctagggcctactgtagtccagtgagccatacgcgtcatctttcgtatgcattgatgcatgcaccatattaaacagttgtattctgtggaaacgtgcgcaggatctgcaggatgggactacttgaagtactatcatcagtagcgtaaggcccagcacggaccagcgtgctggtcggtcatacactgctagatagagctcaggggagcttgaggaagcaaacgagacgctgggggcaataccacttgtgtcgaagatccacgtacaattgttcgtaggcaaaccaagacacttagcgaaacaacacaatagaagagaaaaagcgaacggtctcttgcctaccgacagaactcaccgaaaaaacaggagcacagcaaacatacagaggcagaggggccagaaaacacagaaaagagtaagcgatcaaaaaacacacaaaagcaagaacaccgccaaaaaaaagagggaacacccaagacagaatcaaacgcacgcaacgacacccgtgggcacacgaaacacaacagagaaaacaacgatcatacacaaaacgtcaatacaaaaagcggaaaacaagagagggcagaaaaccaaataacaaagtacaagcacaaacacagcgataaacaaacacagaaagacaacacagataggagaacacataacctgtagaaagacaaacaagaaacaccaaacacacaacaacgaaaatacaacagctagacaaaaaaaaaagctgagagtaacacacaagagaaaccacaaagaaccaccgaagaaaccaaaaaccgccaagaagaacacgagcaggccaaatcagaccaacacacaaccgaaaacaaaacacaccaaacaacacatacagaccaacaacacacgaagagagacaaaacacaaaaaagcagaccacgaataacaaatacaccaccacaagagtacaaaccacaacaaccaacaacacaacacaacagagaacaaaacaccacccaaagacaccacgaaagacaaagacacgaagaacactaaagtgcagaagcaaacagaacacacaaaaaaaacataacaacagccaacaaagacaaaacaaaaaaacaaactacagcaaaaacccagacagaacacacagagaaccaacacaccacacacgcccacagacacaccacgacacacaccaaaacactaacggaacaagcaacaaaacaacaaccaccaaacacaaaacaccaaaaccaaacaagatagacaagaaggagcagccgagaacaagcaggacaaacagaagagagtagaagagaaagtcgagaccatacagacaagcaacacagagtagcaaaagacaaaggacagacacagcacagataacaagacaaggagttgatacaaaacgaaagccacgaagccacacacgaagcacctaacaaaggagaactacacaacgagcacaacgaacgaacaacgagagcaaaagagaacgcacaaacgagacaaacagacaaggcacagaaaagagataaaatagaaaaagaaaaaaagaagacaagaagagaatacgaagagagaaagagtgaaatagagaaaagagacgagtaaaagcaagaaagaaaaagcaagaaataagaggaaagcaaaacaaagaagcagagaaagagtagctaagcatacgaaaagaaaagcaaccagctcgtaggcgagg

SEQ ID NO: 717612 - DNA, 176 bp, Homo sapiens
cgtatagacatatgcagcttaggatgtctgacaactagagattttgaaggtggtacaacactaatggtgctagacaataagtgaaactattcaccgtcatgtttgaaatactatagtgaactcaactaacagtactgaacaggtttatacagttcggccgctttgggactatggta

SEQ ID NO: 717613 - DNA, 252 bp, Homo sapiens
ccaaaaatgcaaatgattccagatgatcattcactgtaggaaaggaattgatgggccggggcgtggtggctcatgcctgtaatcccagcactttgggaggccgaggcattaggatcacaaggtcaggagattgagaccatcctggccaacatggtgaagcccggtctctactaaaaatacaaaaactttgctgggcgtggtggcgcacaccagtagtcccagctactcgggaggctaaggcaggagaattgc

SEQ ID NO: 717614 - DNA, 435 bp, Homo sapiens
aagtacctggacatgaagatcccagacatttttctatagagataaaatactacagcttgagtcaagctctctgcttgttttgaaatgtgctatgtatgtgctcattagctaataaactatacagtatgggttgtatgttcttaaactgtataattgcatcaaattgtccataccattctttgccatcatgaacattcacagcatatatgccatcattcacctgtctcagagtttctctagggtatagacctaggagtgcaataaccgaggtaaagggtggaagtgtaacttcttaagcctttttgagggtaatattctggtacttatttaaagtaactatttatacactgttggatgctgtaactgcactttcataaagctatactagggctgggcacggtggctcacaccggtaatcccagcattttgggaggc

SEQ ID NO: 717615 - DNA, 170 bp, Homo sapiens
  misc_feature (14)..(14): n is a, c, g, or t
  misc_feature (38)..(38): n is a, c, g, or t
  misc_feature (60)..(60): n is a, c, g, or t
  misc_feature (135)..(135): n is a, c, g, or t
  misc_feature (139)..(139): n is a, c, g, or t
gttgcgtaagtgcngcacgaggagttttcccggcagcnaggaggtcctgagcagcatggnccggaggagcgccttcctggcggcgcgctctggctctggagcatactcctgtgcctgctggcactttgggcggangccnggcccccccgaggagagcctgtacctatggg

SEQ ID NO: 717616 - DNA, 996 bp, Homo sapiens
atcttgtagcaggagagtataggttactctgaaatatgtgacaaaagaccatcctcctcccgagaagcttgttcctggtttgagtatatagcctaggctaggctggaaggtggggttcatgataggaatacagatcatggaaggccaagatcgagtgtacgaatcttcggattagcacctgcacgatttaatactacaggcctctcgtagatcgccgacattcttcgtgtgggcttgacttcacgtgtgtactagtgtggccatacatcacataatgttcaatagaaccgaagaccgattcaatgttgctcatagtccgtgggccttcgtggatatggtgcgcatagtgtgggtcacacagagtccctgagattcgggggtgaaattctgcttactcatctagtctctactaacccgaccattcgagatgcggacattcctcaggacataccggaatcctgacccgaaatctacgcggggtcgtccgagtaactatcatcaaggctcactgaatttagtggtctcccacattctgtccggggattaaagtattaggccgtactaccgggggaacctgttgggggctgcatattgtatcttgctctagtccatctaaacaggtggacgccgtaaaggcatgccttggaagatcactactaattgtttcctggctttgcctatgtgggcagcagagtgctcctccgtgaaaatggcattgttggatggcttgtgacctagatctgggctatgtcaactgtggcactgcttcctgggggccctggctaactatattgccagaagattggaatttcccttgagaaagggaacaggggtgccttgagcgagtcgcagcgttggtacaaacaattaagttgggctgctccggaacatagtggtaaacccctatactggacctatgggagaacaaacagtaagagcgttgtcgcgcaaaggagaggataggtacactcaggcggcaagggatataacatacac

SEQ ID NO: 717617 - DNA, 951 bp, Homo sapiens
  misc_feature (354)..(354): n is a, c, g, or t
agcggattgaaccttctcccttgatcccctgcgacctggcagaacctctgactacaatcggaagataaagcggataagatggggatgtggtcatgagctagtaaagagacccgccatgccataatcagctgcaacagttatccggcaacatagcatatgtgcataaacactgtggcatttgaagcgagcataaacatgccaattaatattatgagcttgaaacctcaggtttgcagatgatttcaactacagacgagaaatagtacgcagcatagtatcctcgaagtatcgagtagtacagcatcaaatggtgagcctctaggacaggttaaaatataggtggcccgaagctcnctccgctgagtcacgagtcacaactggcccgagtggttggcatccctaaggatcggtgatcgtagatagatggtccaatatatcttgtatacgatctattggcgcatcaacatgagcatcttcatgtcaaagctcttggaccagccatcgataatggagcaagatcgggaagaaggtagttcctaacgctatccttaaaggcattttacgcacaacagtggattcactgtgaagtatatcttggatcattgggcaacttatcgcagtaatgtgagttacagtgtagttaaaatggttggcaagcggatttgaacttacagatgggtgatgaggagagagtagggagtgtatgacgaaacgaccggtcagtaagtggagagaatcaagcgtagatgcgggccatagactgaacacaacgtagctagagacttcatatgaacttgacaactaggaaatcccatacggtggtaataaccaactataggtccattaattgaaatggtgcctccgtggctaagtgcaggaaggcatacccacatttacacaatggtctgcccagacgcttgggggggaacacgacaggggcgcgttgggact

SEQ ID NO: 717618 - DNA, 123 bp, Homo sapiens
tagattgaggtctcgcacatcctcgcacgcgtcatctgcacgcaaagaacacacacctcgcacgtgctcgcacgcgtcatcgcacgcagaaactcacctcgcacgtcctcgcacgcgtcatcg

SEQ ID NO: 717619 - DNA, 383 bp, Homo sapiens
  misc_feature (47)..(47): n is a, c, g, or t
tggtttgaagaaatccccctgttttaagaccaaagccacgggtgatntgccccccagtcatcaggaaggatgaaatctggcaaggaaaccgtaaggatcagattacaggaagggcttgctcagggagaggaaggaagcaaggaagaaattagtaactgaaaagaggcaaggaggaaggcctcttcatcaggaggtgggggagtgtggggcagtggataactaaaacaaaacagctgtggttgtcataaacacattttgtcagaaaataacctggtgtgttattttctgatgtttcagccattgtgtcttgattcaggaacagctcccttccgagtttctttttgtttgtttgttggtttttgagactctgtcttgaaaaaaaa

SEQ ID NO: 717620 - DNA, 697 bp, Homo sapiens
gacagtgctgacactacaaggctcggagctccgggcaccagacatcatgagtggtcctgcccccggaattatcctacttctatgtcttttattctctcttcaacatgtgtagcatatgtgctaccagagacaactgctgcatcttagatgacagatcggtagtatgtccctacctgtggcatgcagattcctgtctacttatcaaaccagtagacaggatctacgtcttggaagacatcttacatcagtgaaaacaaaacatcagaagtcacagtgataaaagcaatccctcacttatatcctgatgatcatcaaacaatatgatagacgctgtacttgaagtccaggaaaatgttagaagaaattatgaatatgaagcatcgattttaacacatgactcaagtatcgatattgcggaaatatatattcaataatcaaaagatgtaacctgaaagagaagtagccagcttgaagcaccaggccaggaacctgcagaccgggcaatcctatatcacggaagatgtccgacatgcaataagagtaacgagcgggcttactttattaaccttaaagctaacagaatcttagtctactgtgaatcgatgggctggaatggatggctgtgttcagaagagattgatgggtgtcgattcaagaaaaactggtcctatagcgaagggttgggcattgtctccta

SEQ ID NO: 717621 - DNA, 1315 bp, Homo sapiens
  misc_feature (1315)..(1315): n is a, c, g, or t
tgggtgctacacaagaaatatttattaatgtcctgtggtatttacagttttaacatagcaaaccaagattgaatttaccacttggggcagaaagcacattctatttctacatttaataacccacgtggttttcgtgcttaacacattgtgtaaaagcaagttagtacagttagtgtttagggactcattcttcaaaagtttcccaagcttacttctcttttctttgtgcctccttaagttaccttaattccttcttcctttactctcccgagaactttgtggccttaatccaccgagggagaacaaagaggcaaaatagagggcgggtgtggggcgtgtgggggtgtgggggtgttgaaagaaagcgctcttacactgtattagaaacagaagtgttgctcaaagaaatttacccttttacaggctaatttaagctcttccacttgggtaatccctaggtggccttttcgtggtgttatattaccagggtgacacaaaaccaacctttttagacacactcccctttgaggtttcccacactaagaggctaccccgcagacacattgtggggtgcaatttcacggggcctatatttaaacaaatattttaaagtggctttaagtattacttttacccccaatttttaaagagacaccttattatttttgtggggaacccaaaacacccttttacacagctgttattttcctgggggccaccttaagtgcaatttgtggcgccttctccacagggggtgtctgtccaaataacaccgcacaatttgcggacacataaacattttctccctcagcaagtgtaactgctgtgcatacccgcggccacaaatcttagtggcggacttccacttggctcgcccaacaaaacccaccgtgggttccatacacccccacaacgccggttttcaaacctctttcttggacggaaaaaaacaccccccccttttgttaaacactgggggccgccggcaatatttaattacaccatatcccttttcacccaaacatacttttaaacttccccccacgggtctccaactattgaggaacactgtcgtggcgacctgtcacaattaacggccaacaaatatggccaccccccttatagcgaaattcacaggcggccaccagtgggcctcacgtcgccaatcctttaaaagttgtggtctccccaaaccgcgattctttaagcggacgtatttcaactcagcctcgcacaggactctgtttttgcacagagtctttttcaacaatattttcccccatacagtgtgtcccacgaatcaccacactcttcn

SEQ ID NO: 717622 - DNA, 232 bp, Homo sapiens
acgctgtaatcccacactttggaggctgagcgggcagttcacgaggtcaggagttcaagaccagcctggccaacatggtgaaacccgtctctacctaaaatacaaaataagtgagctggtgccacacgcctgttaatccagctactcagaggctgaggcagagaatgcttgaaccgggcgagattgcgtagcagatgcgcactgtgctcagctggcacgagcagactcatct

SEQ ID NO: 717623 - DNA, 146 bp, Homo sapiens
ttttacatcacgagagaatcctggagctactttagaggtctaggactatagtgtatgcattagaagagaatctcgacagccaggggatatgagtcagcgctgagggcatttggctaccagaccagagcacaagtcctctgacagca

SEQ ID NO: 717624 - DNA, 173 bp, Homo sapiens
ttgcctcccagtgaccctgttgggaccccaggacaaggaaaacagttttccctctcgaaaaccccaactgcccctaggctggagctggaagggtgggtgaatccagcttgggcatccccaatgaactttgccccgcctgggactctatttattttgattaaaggggttttcca

SEQ ID NO: 717625 - DNA, 83 bp, Homo sapiens
gggactggggtggatgaaattttctttttgggtttttttatatccttttggttttaaaacccaataaatgccctttttccaga

SEQ ID NO: 717626 - DNA, 118 bp, Homo sapiens
tcacggttctggctatctatctggaggatcctttccagtggctgaaacaatttaaggccgggactccacccatggcggggagggtaaggaagggttgggcaaccccagggatctggcc

SEQ ID NO: 717627 - DNA, 554 bp, Homo sapiens
taagaggatccccgcagtcttgctccaatcagtttcaaaagcttttctcatatagcttcctggttgttcccacaataggaccaggattcactccgtatttcacaagctgatccaaaagatcttcattagtgagctctgttacaatctagatcatctttatcttcttgtctgggtttatcagttttttttgtggctttctgtaaacaaagtccagtaatcatttccatataaattaaagtgttcacttactagataataacctgtataacataaacatgcaaactcactaccaaattggcttatagtaatattaggccttagcaattccattaaattaagagcaactcattattggagaacactttctaagttgaactgtaatcatacaaaccgcacagccaagcaagtaacttaaagacattgttgttaaaatagtccattttggattacctatctaaaagagatagtaatggcatcaaaaatgcaaaagcgcaactaaaagtaaaactgactttgggtaacattttcttttaaataacctttttttttttttt

SEQ ID NO: 717628 - DNA, 123 bp, Homo sapiens
gcggccgcctactactactactgctcgaattcaagcttctaacgatgtacggggacatgagaaataccaagaaattggcttttagtttatcagtgaataaaaaatattatactcttgaaaaaa

SEQ ID NO: 717629 - DNA, 694 bp, Homo sapiens
agacagagagagagagagagagagagagagagagagacagcgcgagccagcgggcagtgacgtgagataaccagcaaaattaaaaaagaaaaaaaaaaagtgggtagcgcccaggcagagagcaacgggagtggcatcaagcgctccccactcgggctcgggcggggcgccagagagacagtgagtgcagcatccttctgagcggggggccaccgtgctgtggcgctccccaagctgggggctagtgtgtccccagcttttcgtgtgccttgacttttagtgtacttacagcaggggataatcagggaagcagccgcgtgcccctgacacaagtgggctcagccttacgcttcgggcccagtgggctcccccgcagaacgggtatccccgcgggaatacagggcccctcatccccaccccgcgccagagtacacagggccagaccagggttcccgagcacacatataaaccgtgtaccctcccgcacagacgcactccgagcagagccgggggacacgagcgctcagagcgtctctggcaccgccacacagacagatgacgcagacaccgaagggatgggccaagccccagacacaaccttctgaaaacacggaaaaacaagtctcagcccaagcggggcgtgtctccaatatcccctacaggtcccgggatccggactcagacaagtgtgggc

SEQ ID NO: 717630 - DNA, 246 bp, Homo sapiens
gattaataggacatgtattgtcatctgtctgtgctgaggacatagaccattcattaaatagtcttggtgataactgtgcatgtacttcttttaatcacttatgattcagatggcactgtaagatgactcgacacaagccattgcctgaaccccagagcttcctctgttgtatggccgttcaagtccaggcattgcaacacaaactcctcaaagattcaccacaacatgacaagcatttcctaactg

SEQ ID NO: 717631 - DNA, 412 bp, Homo sapiens
ctctttgctctgattgacacctattctccctctgtgagggcccctagtctgcagagtacagcctgcggcaccccttgcagaactaatctgctgtccatcaccccgagggtcctcacaggaatggcttcaggtgttgcagcccactgactgagacacactttcttcaacgaaaaagtcatttaataatgcatgacggaatcacaattggcaattaagaagcagtcctgccacaccacgtatggatattgaaaaagactccttcatttcaaagatggctttttttaaatctctcagaatagtaagtacacaagccaaggcacggagagattataaggatcatccaaggatatgcagcaagtctatgacagagtccagtggctgatcaaaattgcagaaggcacgcctgacaggt

SEQ ID NO: 717632 - DNA, 124 bp, Homo sapiens
tctcaaatgcgccagaaatcagtacctgcttagacgacatcggttcaggctgagctgagggatcataagacgtgcttttcatggtagtccgaatttctttgaaaatttctcttagaactctgga

SEQ ID NO: 717633 - DNA, 535 bp, Homo sapiens
cggcacgcgctgggtcgtgatccagtcttgggtgacacacggtacaccagccatggggttctgcggcttcagctccgtgcacaatgtccaccacctatggccaggaacgacgttgtccctcgtataacctgtgagcacgtagtcatattgtattcatgctcgttccacgcctcgaggtccttgagatacaactccatggtagctcatctgaattcagcacttggcccttccaggtgggcatagcctgctgtggtttgaacaactggacagagttcaccgcgtcaaatctcaaatcccaagaacctgcagcgggattcgtggccgcccggttgcccacgtagccgcggatgacgtggctctgtactggagagcacccggcactcctcctccatgccgggcctggccgtggcggctgcggggccgaaggctgggggcacggtctccgccgctcgctcgggcctccgggtcggctcgcggcgtcgggctccgtgccccggtttccccttcggttggactcctggctctggcgcgccgt

SEQ ID NO: 717634 - DNA, 1175 bp, Homo sapiens
cagtcatgaaacatacaggtctattcttagtcattctcaatattcagcttttgtaaacttaatcaatgcttccaaacaagcgtttatttgtttcaacaacacaacaacacatgcatcattctaagaaatgcactcataggtaggggaggtgtaaataagtcataccattcttcaaacaccagacaaatttcaagtaaagtcttttaaatgaaacctgtaaaagtattgactcttctaccaagtagggtatgatattccaggcagctcaatgattatcacatttgagaccctgagtttgaagcattaacaggcaacggtacagcaacagaggtacctcttggtgtatagctatttacatactctttaaggtagaagaggcaattaatacccttataacacatggattagaacatttaacagcaataatcattaacccaaggataaggatgtaacggccaactgtcgcaaggagctaagatactggcttcacagatacaaaaaatactaccaacttaacaatcccaataaatactctgcacagcactacggagaagccaaaaaaaataaaagcagactcgtcacagtgcatccaacataatccaagaatcacacacagagaatcaacaaactaacaacaaaaaacacaaaaaatacgaaacaggccaaaagacaaaacacaaacgaccaactaaaacaaatgtacaatcaaacaccacaaacaacaaaacactcaccaaaaagacatcaaaacagaagaacacaaaaaaaagagaaacaaaaatgaccaacataaaaaaatcaacaacccaaaaaaccaaaaaaaacacgcaagaaaacactgacaaaaaacaaacaacaaaaatcgaaacgacacacaaaaacaaaaaacaacaacaaaacaaaaaacagcagacacacaaatcagaaggcacgaagaaaaacaacacagaaacaacaacaaagaggacgggtagagacgaagcggaaacacgacagaacgacagaccgcataaatacaggaagaccacagccactccagagcaagggaaaaaaaaggaacaccacgagaaccaccgcgagagaccaaaccacaacaacgacgccaaaaacaaaacagcaacaaaaagcaaaaccaaaaggaacaagaaaaaaagaaagaagacaacaacaggcaa

SEQ ID NO: 717635 - DNA, 350 bp, Homo sapiens
  misc_feature (10)..(10): n is a, c, g, or t
tcagctgganccccaatgaaacaggtttttcattttcttttttcctggcttcctcaatcctttggcctctcagccccttacctttctatactttctcgtctctctcttttctttctttaaagagggagtctcgctcggtcacccaggcgggagtgcaggggggtgatctgggttaccaccctcggcctcccgggtccaagcaattctggcctcagcctcccatgtagcggggatcacgggcacacggccattatgccgggctaatccaggcttttaagtagcgagggggttacaccatgcgggccaggtgggtttggacatcgggccctggtgatttggccgcctcggcc

SEQ ID NO: 717636 - DNA, 127 bp, Homo sapiens
acacatcattctcatttacattcaacagatatttaggtagcaagcacgcagtgctaggtatgttatatatcaacctgaatgcctcacaggcagccaaactcaacatgtgcgagactagaactattat

SEQ ID NO: 717637 - DNA, 140 bp, Homo sapiens
gaggtcatttgatgttgtgcagttcgcttagtgcaggcaggtgctgatgtggatgcagcagataagccggaaaatcacacctcttatgtcagcatttcgcaagggtcatgtaaaagttgttcaatatttggtaaaggcag

SEQ ID NO: 717638 - DNA, 137 bp, Homo sapiens
ggtgactatacaggatctttaccgactagccctgacaggatacccacctcttagcatgtgacatcaccaaatggctatcagaaaggcatgctctttcttggtatctcgtgcgtgcaatggagaccatgaacgatggg

SEQ ID NO: 717639 - DNA, 227 bp, Homo sapiens
  misc_feature (32)..(32): n is a, c, g, or t
ctttcgattctcggagcattgttggcctactnggcaaaatatttcccgaaagaccaggagcagcatctccaccagcaagctgggctgctgggtgggtacttccttcaaagctgagggagcgtcctacgcccacgcgcgcaggagggcgccccccgcaaagcaacgtctaggagaccacagtggatgccacagcgggcccgaagcggatcagccttgtgggatggcag

SEQ ID NO: 717640 - DNA, 736 bp, Homo sapiens
tggtccccttgccactttctaactccacgtggctaccgaatgaattctcggtgctggctggattccgtttgcaccctgtagactgttcataggatatgattgatgcactggttaactaaacttacgatagtgcaagttctgggaagctgcgtcttagaagggagacactcgcacaaggactgcaccatgacgacacgatggccgtagaccgtctaagtccactgacggggcagtcccatataacgcctttactagtgaagagtgttgtacatcgattgcccctcacactgtaggtccacagctagaaagagagctcgccactcacctcactacctgtggagatccgtgaattcgtgccaggaattggcaggggaagccttggcactgaggttagcgagagaagcatccgtgcgcacatgcgctgtgtcgagagaacccgtggtctccggtggcacttagtaacatcaccgtgcatgtcttcataggtctagtgtgtcgttcattcaatgccagctctaaggcttcacggcaagagcacagggttcacactcaagaaagacggtctcccgcactccgccatctcgggtgctgacgatggggggctgatggctgcccttgcgtggcatgagtccctggtccctctagaggcagttgacggggcagtcagatttttaaagttttgtacaaagttttcctttgtaatcagctcccatttgtacgtattcccccacttgtt

SEQ ID NO: 717641 - DNA, 275 bp, Homo sapiens
ggtttccccacgggaaaaggggcagggagggcaacccaattaatgtggggaaggcccctccttaggcccccccgggtttaccctttaaggttccgggtggtatgtgggggggaaatgggaggggaaaccaattttccccagggaaaaggtaaggccaagattaccccaaacttgaaattaacccccccaaaaggggaaaaaaaaggggggtccccccgggggggggccgctttaaaaaaaagggatcccccggggggcaggaattgggcccgaga

SEQ ID NO: 717642 - DNA, 185 bp, Homo sapiens
atttactcattgatatgcttatacacttccactttggtgcgcaaatgtagggttagtctaatgttcacatggacatgatctatctttatcattctactttgagatgctgtctccactgtttgatgtctctgcagcaggttgctccacaggatagctctcaggagggctggcaaacttagaaggtg

SEQ ID NO: 717643 - DNA, 149 bp, Homo sapiens
atggcgtagcctgggttccttggtccacctggtctagtgtttcgggaggagtcatgccttctcaggtgtcaatgagctacgcgctctaccactgagctggattatgcagcgcaaaccactcgcctgagcgggacaaatagtattaactg

SEQ ID NO: 717644 - DNA, 101 bp, Homo sapiens
aggaggtgagtcagatgagaccatttgctttctgggagtcctggcgtttttattaaggctgtcatgtgaagccacgagatataggatgtcttgtgcaacca

SEQ ID NO: 717645 - DNA, 358 bp, Homo sapiens
gttcaagcacattgtgaccatcctgcctgctgagatccatatgtgggtgcgggaacagtgtgcaggacgtgtataatggatcagaatccagcttctatgacatgacatgatatcacttaagatgctatctacaagctgcctaatatatgtagaggtgtctcatttcgtagtgttgcctcaagagatactacttgtgcacatatgctcatagcctgggatgcatctgagccacattgtgagagaccaatcctgcacatactctgatctagccctgtatggctctgaggctgactaactggatgggctgattacagaccagcatctcagagcctcactggtcccaatggtacctgaggcg

SEQ ID NO: 717646 - DNA, 278 bp, Homo sapiens
  misc_feature (46)..(46): n is a, c, g, or t
  misc_feature (60)..(60): n is a, c, g, or t
  misc_feature (84)..(84): n is a, c, g, or t
  misc_feature (90)..(90): n is a, c, g, or t
  misc_feature (113)..(114): n is a, c, g, or t
  misc_feature (121)..(121): n is a, c, g, or t
  misc_feature (192)..(192): n is a, c, g, or t
  misc_feature (203)..(203): n is a, c, g, or t
  misc_feature (211)..(211): n is a, c, g, or t
aatataggccaggctgctggtttagtctccctcttcttccatctgnctggtctggtctcncccatgccttggggggctggatgnggtganatctattatacatgcatctctgnnctggggnacatggcttggggcctcctggactgttctggtccccttgctatccccctacttccctgactgctgctcgtnctgtttgggcncattgtcntcccactcggcctggttacacgtgccatcctccggggccctgatctcatactttttacggttggacg

SEQ ID NO: 717647 - DNA, 302 bp, Homo sapiens
tgtctatgcaattggaatatatctaagtccatgccatgtgtcttgtggtttccgtattaccaaaacggtgactgaagaaacgcttgctttcaaaatacatcgaattggccaggtgtgctggcacacacctgaaatcacaacacattgggaggcccaggcagaaggatcacttgagcccaggagtatcgagcctgggcaacatagtgagaccctgtctctacaaaaaatcaaaaaattagttggccatggtagtgggcgcctgtagtcccagctgcttggctaaggttagaggtttgcttgag

SEQ ID NO: 717648 - DNA, 213 bp, Homo sapiens
ttgctcgcctagaggatccccctgttctgcttcttgaaaggaagtatgctgttctctatcagcctctattttataagcgatttgaaattattaatgctattcatgaacctacggaagaagaatgtgaatggaataccagatgaagaagatgagatttcggaggaattgaaagaagcaggactggaggaactggtttcaagaagcaggaactgg

SEQ ID NO: 717649 - DNA, 951 bp, Homo sapiens
gtccttcgacctctgctgcgccccgtgccggcgccgcgtcttgggatacagaggaagcggtagagcgagccaaagtcgtctgtcagccagtatctccagacgcgcagtcccgagcgagtgtaatgatggtccgccgtgcgcgcatggctcggccgtgtatccacccatgctctgatgtccgagctgtatccgagagtatgcatacagacgaatattctggaatcatgggtgatcgtcgaccagagaggttagtagggcactggagagggcatctagcggtatttaaagtgggggcccaaacatggggtgtctcagggtaatccaaagggagtgcaagaccatgtgcatgtcccgcagtcgacattgggatgaggtgcattgcccaaatttgtatgtggtgcacggtgctgtggacaacgtaaggagtggctggttctggtggctggtattgcagcagactttgtccacgacttatcatggggtgtatgccagagaacccattcgttggaagcaccaatggtgtctcatatgctatcctgtggatttgctgtgcatgaagctatggggtcctctctggtgggatgcccgctgccctcgattcgtgggccatgtaaccaaaattagttggttgacattgtggattcaataatcaattacggagtgtagttctggtatcttactgggatccgaaaactgagtattggtgcatgcagacgtaggtattgcaacgcatatcatgcacggtggacacccagcagaaggtatggcaagaggcttgtttggcgagccggctaggaaagttacaacatcttggggggggccgggaaggcaggtcatggtccaaagccggccaaaggtggccccgaaaaacgcgggggcgcgctgcaaccagaggggcgtagaaacaggacgagtaagcacggggggacccacagctgggacaaggcaaac

SEQ ID NO: 717650 - DNA, 153 bp, Homo sapiens
gtggtgctgtacagtaaatacagcaagattggagagcatgttatcctgaaggccaagaccgggacgaatacctttctctcgtgagcaggctcattatccattgttcgagacattccccagctgcagctccagcaggtggcgctgcagcagcag

SEQ ID NO: 717651 - DNA, 192 bp, Homo sapiens
cgactctcagaggatcccgcgtctggggctccatgcagggggcccctagagaatataccttagctttccctgcttccgggcatccgggaaagggggatacgcggggggccttcctttcacttggaaagcttacaccctcatttggactacacctaatactaaaagctgggcatctggcttgagactagggtt

SEQ ID NO: 717652 - DNA, 538 bp, Homo sapiens
gagcggagtgggtccctagacgacggctgcggggcggagagctgcggctgtgcccagcgctgcccacctgaggaggcggcggggtccgcaggcgtcgcgggacgaggagatcggagcctgtggagactcgcgcagcgccatggacccccattggcctcaagagctgttgtcggatgagacgattatgcactgatgtgataaacgcaaggtcaagaagaacgggggaatggaaggtgctggtggtgtgatcagttaagcatgaggatgctgtcctcctgctgcaatgatgacatgacagtcatgaccgaggggcataacagattgtggaagatatcaaataagcgcagagagccgctccaccaggcctggaggcatgtgtatctcagtcaggtccaatcctgaggaagtcgcgtccgagcgtctctcattcagatgtacttatacgtgacccgcacgaatggcttaaataccgggggctgaacaagcgtcattctttcaactgagctctttgtcccagatgcccttgtgttaatgaacc

SEQ ID NO: 717653 - DNA, 1379 bp, Homo sapiens
  misc_feature (1230)..(1230): n is a, c, g, or t
gccttggcccagttggcaggctgagtcgccctcctctgggctggtcccgtctctcctgacctccttagtgctcgacgctgctacctgctgtccggacacatccagagctgtgcgacgggatgcgcggtgcagtggcggccggcaacacatgcccagggaaagcatgatcaagggggctctgatggtgcaagcgacctcgtgtattcattagccggacctctacctaggaccggctcgtgagaactaggtgacttgtccatcatgttcgccacgaagccatgcatcatcagaacagcccgacgaccaacttcttctagttcccatgtacgatccttaaaccctgggatgcagggcagacatgactgtcgagacctggacttgctcggaccggaagaggctacttctgtcgcacaggccttgtgagtgacgatcccttgggctgctcgctccatacctgtcatggcttgagctcgagctttcaaaggccagagagtccctagtcgctagggacccgacatgggctgtgcttgctgcctgtggccttccccagatgcgtgcgggcggcaggatgctttggtgcccagcgtgcagcccttttcgagcgcatggcccaaggttgttggccgttcttgccctttttcccctggcctggcccccccggcctttcgttagtcgcgacgggttgccttaacaaggtggacacctcccggaaccgcaggcccaagggacccccattatggaggcccgacacacagacgacacacgaggcttggttgccggccgccttggccaggacaacggccagaggttgggacaggccgttgggacgcacacggaaccaggaaaaggggcgggggaccaaaaacggcggggaacgccaggaggcactcccgggccggcgggcagaacccgcgcgcgggacgggggaaacgacaccgtgcctgcccggttagccatccctttctctgcaggacaagggcgtcaggccacacggggttccttaacttggaacgctggtggaaggctggggctggcctttttccaagatggccaacgcgaaatgcgcgggtgattaacccccttgggttccaggggggccccacccgggaaagacctgccggaaaccgcgattggcgtttgggccccaaagggctggttgccttgtgctaagacacttccaatctgtgttccaacacctgccaaggctgtgccaaacgagcaaatctagtntggttatcccccaaggaaaaacacatcgcggcagggcgtaccaaagaggtttggccaaagggctggagccaatgcgcgggcactggggacacccactgaaactttcttggggaaagcggcatagcgtatgggggaggctttggcaaccc

SEQ ID NO: 717654 - DNA, 465 bp, Homo sapiens
ctgttactttattatcatacccattgaatcagattttagaaagtgtgctggaggccgggcaaggttggctcacacctgtaattccagcactttgggaggtggaggcgggcagattacttgaggtcaggagtttgagaacagcctggccaacatggtgaaaccccatctctaccaaaaaatgcaaaaattagttgggcatggtggcacacacctgtagtcccagctacttgggaggctgaggtgggagaattgcttgaacttggaaggcagaggttgcagtgagctgagatagtgccactccactccagcctggatgaaagagtgagactgtgtctcagaaaaaaaaaaaagaaaaaaaatcaaatgaggacataggaatgatcatgggattggggaccatggagatcatggatcatagtgagagctgcgtgtgtgtgtgtgacgtgtgtgtgtgcgagtgcagaa

SEQ ID NO: 717655 - DNA, 954 bp, Homo sapiens
  misc_feature (389)..(389): n is a, c, g, or t
ggcttttatttctccccccgccctgattgtcgccttctttggaccgcgggtggagcaccctttttttcgcggaaattggcgcccgctgatgaaatgcggccgcggggggtcattcgcgtcggtcctcctccccgattggtgcctcctctcacccactccgtttgttggggtccgccgcggccctttttttttctgcccgggcgctctcaaccatactagtcgctccctctccggtcatattcaaggattgggccggctcttcacctcccccccgttcgggcccgcctttggtacagtccggcgcccccccgcgtcccgctcgggagaggaaaatattggtctgcatccgccccgtcgccccctttgtcgcgagcatttctccctaccgnccgcctccggggtgttcttcgccccccgccccacgaagaccgcccccctctctctctttgtaaggcaactctcccctgcgaaggccctcccccccctcccgctaacaaatgacagtgagacagaccagagacgtcccacatccacaaacaaaacagaggtggggaacacccccccggccccgccaagctcctcgccccgcagcccgaggtgggtgcctcgcccccggagcgaaggttaggggatcgggcgagaggagacaatatctcttcctgggaaacaatcgggccactcttctctcacgaccacgcacgctattaatagcgcgccctctttatgaccccacaccccagagatttttttagccagagcgccccccctcgcacacattctatatatcggcggtcttcttcgccggaacatagctccactatgcaccctcccccgcataatgtgcgccgcgttcctttctatcatctagatctcctatccccagacctctgtgaggccccaccaggagacacaatacaaaccttgctttagacatgccccaatcaataatcacaa

SEQ ID NO: 717656 - DNA, 909 bp, Homo sapiens
cagatcagtgattgagcggggagaacttttgctcaggagaatatcactgtcatagaaacaaaattgcagatctgtgccatacgtttcatcaaagatggagcgaccatattgactcacgcctactccagagctggtcctgagagtcctggaagcagccgtggtggccaaaaagcgatttagtgtatacgtcacagagtcacgagcctgatttgtcatgggcaagtacctttctgttcagttatgtgcccgagccataattttagcagagcaaactgcggattacagtcctaacatggatcatgaacctagaatgtgcccccagtcttgccagcagtcagccactgccgttacattgtaccttttcctgcctttggaagaaaaatcactgaatttgcatgcaggccggagtatatgatctagggggttgcacgttaaggtagttaactccgtggaagagcagagatggtgattgagtgaagcactctcttgtatcaaggaagtaggctaacttatatctccctctctctagacgataagtcaaagcaaaacttcctccttttttcctgaatttagcagtctcttacccgagagtctaagagctatagattattccaaagaatagttcttctctaaagaactcaaattctggttgccttagtccaaagtattgggatctgccccttaacccattaggcgtcaatgtgagtttcaatgctaacatccactgtccacgattaggtgacatacatcactgtggtactgtcttgtactttgctctaagcgttctcaaaaatgtcatcttcagtaaggaaaatggcaaagccctctggcacgtcacgtcctgtcactgtggtgctaaagctgatgtacgggtgagatggccttttccccaggaaataactcccggag

SEQ ID NO: 717657 - DNA, 331 bp, Homo sapiens
cgacatggtggctcacacctgtaatcccagcactttgggagccagagaagggaggatcacttgagccaaggagtttaagagcagcctgggcaacacgatgagaccctgtgtctacagacaacaacaacaacgacacaaagttattttttggagacagtcttgcccgttgcccagggcggagtgcagtggcacgatctcagctcactgcaacctctgcttcctgggttgaagtgattttcctgcctcagcctcccaaatagctgggattacagatccgcaccaccatgcctagctatgttttttgtgttttgtaggagagagagagtttcgt

SEQ ID NO: 717658 - DNA, 728 bp, Homo sapiens
  misc_feature (118)..(118): n is a, c, g, or t
  misc_feature (437)..(437): n is a, c, g, or t
gggactacaggtgcccgccaccacacccggctaattgttggtatttttagtagagacggggtttcaccgtgttagccaggatggtcttgatctcctgacctcatgatccgcctgcttnggcctcccaaagtgctgggattacaggcgtgagtcaccgcgcccggctcattttaaaattttgtagatcagtgtactgtagtaagaaaaaaaaaattaagaaaagataaaaaatagattgtggtagtgataggatcccactgaggccggagaatagggtctgggagacaaagggagcattcacttgcagcctctggagttgggtgggcgggccaagtcttgttacataggggtggtaagccaagatagggaaacgctctagaaggggtactgtaaacgcccagattttctacacagggcactggttgagcctcatcccngtttctggaatgtacttgtgcttcaaataaatctgggggcttaggtgcctggcgacaaaaaaaaagaaactccaacataccacaaacaacactggggcggggccgctactgggaccgcaagaaagaggtttgtacaacccatgccgcttgggggcgggggcgcccaatgatgggatcaaaggaacagcgtccgaaacacggtggcccggagagaaacccgcgctccagaccaaggcccggggttctcacccaataaaaaacgccgggcgggacccggggttggaacactcg

SEQ ID NO: 717659 - DNA, 1376 bp, Homo sapiens
  misc_feature (913)..(913): n is a, c, g, or t
  misc_feature (1104)..(1104): n is a, c, g, or t
  misc_feature (1354)..(1354): n is a, c, g, or t
ggtttaaggtgtgcgccccggtcaggatttcgccctgggggaggacctcgctgattcgccgaacgccgcgtcttttttggcacccttctgctgctttgtgagatagcctctccggggggctcccggatttcctcagggctcttcgcccgggactttgtgttatgtgcccttgaggggcccccggtccgcgggtgcctcggctggtttacacccgcgcgtgtgtgtcaaccaccccacggggttaccctactgcgtctaattgtgggcccccactttttgtattgggccccttacttttttttaaggggggtacccaccctaattttgtgagtagccaaaacaggtttttgggatacccctacagaaataagagccaacggcctttcggggataatacccgcggttccccgcgagaattttttcctcccgggggaagattatttctggcgtgcgcgaagcacccccaacaccgccgcggttcctcctgcaccgcgcttggtagtaccccccctcggtgggatgttgggggaccttggagaccttggggtgggttgttctccccacagggaggccacacacaacaatgccggggggcgcttctacaattgattcgcccagacaacacagaggcgttctccacaacccacacacattggatgattccggtgagagacacgatgcaaagacccttttgtggggtctcgacgcactctgtggctctgtctctggtgagatatgggcgagatctccctctgtgtgtcacactcggggggaagagtctctctcgggaagagtgttctcttgagagctctgttggtgtggagaaaagggtgaacccctctggccactgtcactgtctgataagaacactctctcgtggcctctttgtggggcctgagaccacggtgccccnctgtgggtcacgaggcctttctacatctttgtatatgagcccgggtttgtgtgttatattcttgggtctcccctgagaccctgcgtctcacatctatatcacctactcacactctcgaaagtttgttccacacacatattgtggcgctcttgtggatccctctttctcgcgccaatctcccatccagcgcncccatagccagtggggtggggcgcactgtggcgttcgtggtgtccctgggtctttggtccttgatagcccaagatttggggaaagaggagacttaagaaagaacacatccccacttagggaagaagaagaagaactacactcccacacatccaagagaataatttaagattatttatttccaaaccagtgacacattttttggggaaatggacttaataggaatatgggactgagttcccagtctttttnttaataaaataaaatcaagcca

SEQ ID NO: 717660 - DNA, 272 bp, Homo sapiens
aaggatccccaagcagtataagactcaaagttgactatttgtgtgggaagcaggaaccccaaatggagggactggctgaagcagtgcagaagaacataaattgtgaagatttcacggacatttattagttccccaaaattaatacttttataatttcttatgcctgtatttactgcaatctctgaacataaattgtgaagatttcatggacacttatcatttccccagtcaatacccttgtgatttcctgatgagtctgtataaactgcttg

SEQ ID NO: 717661 - DNA, 148 bp, Homo sapiens
agtcgctcaactcacgagaaaaaatacttatgctgagcagttcgatttgcagaaggaaacgaccgtgcacagagggctcagctctctgagtaccccacactgtgacacacatctggctactactcctacagtgctagtaagcacagat

SEQ ID NO: 717662 - DNA, 571 bp, Homo sapiens
cggccaccaactttattatactcctaaatatatctgggatggtattaaaaaatactcccacagctctcatcagctgatgtattcaatgaactgctagttgacgctgtctgtctatgacatcttgccaccattcattttccccagaactatttccggtgagaggcatttgagaagcctatattagtttccatgtccttactttttcctggatatctaagataaaacattataaaccccactactctcctacacagacattttaaagcatggacgtaactttaaggagactgagaaaacatcagtagttttcacaaagcttcaatgaacaccccaaggcacaagtgtagaaaacggcctgtacactaaaacgtcacttttggaggtacaggtatgctgtgcttgcagagagaggatgactttatccctacttaaaagcaccaggtgtcaagttcagcctccatttacacaggatgcaccaattatccctatgatagtgactgtttcaagtactatactacatttccaacatgtcttttgcctatttgcttagtcggtcctggggttcttttaa

SEQ ID NO: 717663 - DNA, 434 bp, Homo sapiens
  misc_feature (9)..(9): n is a, c, g, or t
  misc_feature (98)..(98): n is a, c, g, or t
  misc_feature (110)..(110): n is a, c, g, or t
  misc_feature (145)..(145): n is a, c, g, or t
  misc_feature (181)..(181): n is a, c, g, or t
  misc_feature (257)..(257): n is a, c, g, or t
  misc_feature (265)..(265): n is a, c, g, or t
  misc_feature (275)..(275): n is a, c, g, or t
  misc_feature (280)..(280): n is a, c, g, or t
  misc_feature (284)..(284): n is a, c, g, or t
  misc_feature (302)..(302): n is a, c, g, or t
  misc_feature (308)..(308): n is a, c, g, or t
  misc_feature (368)..(368): n is a, c, g, or t
  misc_feature (372)..(372): n is a, c, g, or t
  misc_feature (402)..(402): n is a, c, g, or t
ttacaaaanattgtgaacaaaggaaaagataatttttcagcttgtgaaaaaaatactattttaatacaaaagagactgtgtgatatagtatcaaagtncgattataaaanacattattacaagtggttttgaaatttcatttgcncactttaatgttttcagtgatgataaaatgtttaanataaatgtcatagtgctttataaaaaactaacttgaatttactttttaaccataataatgttttaccagagtaggnattttacnggctcatggnatgcnaatntccctttaagggactgcnagaaanactcaagagtcactgaaattgtgtacttaaaataataaatattcttgggaaacaattgantgtnatatgagatacaaaattgtggtttgaagcntcatcattaaacagttgcatagcaacaaaagg

SEQ ID NO: 717664 - DNA, 138 bp, Homo sapiens
atgtcatctctaacggctcatcttcaagaccccagactctatggtatacaagcccggctgtgtagaagaagtagtctgagaggcccaggtataaccatgcggtctataggcagcgggaaactaccaacatgatggacg

SEQ ID NO: 717665 - DNA, 206 bp, Homo sapiens
tccagaggattcgattcaatgggggtgagcatctcagccaacccattctcttttgatggagaaggtttctcgttagcacctatatggttaacctagcatatagttggtaaaggaaagatagttttttttgttttgcatatcattaggcaatcactgattttaaattattgaatgcgtttcagtccattgcagttcctcctcttact

SEQ ID NO: 717666 - DNA, 591 bp, Homo sapiens
  misc_feature (117)..(119): n is a, c, g, or t
  misc_feature (174)..(174): n is a, c, g, or t
ttaccagaatacagtttatttcgtgaattctaaaaaacaaaaagatgaatctgtcagtgatatgtgtgtattataacttattaatcttgctggttgagctggtataccagtgggttnnntaaaaaatagtactgtttaatggctaagtaaggcagcagtcatttgtggtattcncaggctttttaaaaatttaaaaaaattttaaaggaaggccctgggttaaaagggcacaacactgcaaaaagcccacaaattgcacagacatgttcttaaaatgcgaaggcattagtcagcgagggtaaatcctattaccactttaggaagtattcaaaaatattcttctaaagaatctctcgccgccacaccactttacaattttacactttttcgtctcccaactttaagcgcacacaaaggcttccccctttcgttaaattttccccaaacaaaaacttccaattattttgcgcaccaaggaatggttttccccccttttcaaaggcgggccaaaaccatttggggggtatcctaaaacagtctattgacaagtaagctggattctttacactcggaattcccagcaaacttaac

SEQ ID NO: 717667 - DNA, 298 bp, Homo sapiens
gcgttatgcagctctctctgatgctctcatgagtagaaggccagcatatacagctgctagctgtttctctatcaatgaataccggagttcagctcctttccatagtagggaccaaaagcctactggcatacttaggcgctctgtgcatagccacaaagccctcaaccaaaaccgtctgtggacacatgcacctccagctcaaacaggtgcccctggttacttacttgtagggcttgtggctgctgaatagcgcacctggctgtttagtacggcagtctcagccacaccatcccagtcc

SEQ ID NO: 717668 - DNA, 123 bp, Homo sapiens
tccagtacccgagcatgcatgccttgcttgccggtcggaccgtgtattcaccactgcggatgccattgcgtcccatgacaagtccgtcagacccgtgagcaccggtgctgacctccaatatcg

SEQ ID NO: 717669 - DNA, 226 bp, Homo sapiens
  misc_feature (218)..(218): n is a, c, g, or t
gtgaaacccctctagaagtttcttcctggtcctggtccgatattccaccgccagcacgtaaatcccctttgccaatagtatgcctcctcttccactcctagtaactctgaacttcctgcatttcttgtctagacgaagcctttcttacttcttgcattgatgaccattgtatggctatgtgtgtttcgtgcaatacgattttatccacaggatcatgngtcatcaa

SEQ ID NO: 717670 - DNA, 391 bp, Homo sapiens
gcaagttatctagctaagatctagctaagttatctagctaagatctagctaagataactaatgaaggtggccacaccatacaacaggttttcaatgtagatgaaatagcctattcgaagaagataacatctaggactttgatagctggagagaagtcagtgcttggcttcaaagcttcaaaggacaggctgattgttgttaagggctaatgtagctggtttaagttgaagtcagtgttcattaaccattctgaaaatcctagggcccttatgctaaatctactctgcctgtgctctataaagggacacgcaaagcctgaatgacagcacatctgtttactacatcatttactgaatatttgaagcctgctgttaaaacttagtgatcagga

SEQ ID NO: 717671 - DNA, 326 bp, Homo sapiens
tgcgatagagatacaccttcgttgcttacacagttcaaatattgaaagggccacatagtaaagaattttgaagcacagcaagaactatagctaactattatatctggaccttcctatataaataaaaacatgcaccgtcattgttgcaagaggacacaaaattcacaacattaaggaaaaaccaaaaaacagttagcttactaaaatcataccaaatcctcagcaaaatcaaggaaagcaattatggagtgtatactatccctagaccttgtaaattgacatatacattttaaagaaaagaacagtaattgcatagaaaatatctg

SEQ ID NO: 717672 - DNA, 322 bp, Homo sapiens
gtcattttctagctagatgatctgttacgatgggagtggggtgttgaagtcctcagctattattatactgaagtctgtctctccctttagatttaataatatttgcgtttatacatctgagtgctctggtgtagggtgcagatgtatgtagaagtgttatagcctcttgatgaattaatccctttgtgattatataatgagtctctttgtcttttactgtgtttgacttaaagtctgtgttatctgatataggtatagctggtcctgcttgcttttggtttttatttgcatggaatatcttttttcatccctgtgtgaaaag

SEQ ID NO: 717673 - DNA, 178 bp, Homo sapiens
ttttagtctatcccactgatggggttgccgtctgtgtaatgccaccagtaggctccttatatatctagcaacagctgtcatttgagttacaggaagtacagctgactactgcttgatcgatgatgtgtgtgtcgtgctttaactaaaccagtaggcagtgctttcagatgctggctag

SEQ ID NO: 717674 - DNA, 105 bp, Homo sapiens
gaccttacattcccattcacttaacagctctttgggatgggtgtttcattccatttctgcccactcgctctcctctcctctctggtaggtttaattttatgcttt

SEQ ID NO: 717675 - DNA, 241 bp, Homo sapiens
cgctattagaactgatagctcccatggatgggtgtaggtggctcacgcgtgtaataccagtactttgggaggcaagatgggcagacagagccaggaccctggcagagaagcaggatggcagccgtgaacagcagttggagcctgggtgcagatcctcagactgtggggggcagtagtaggtgctcaaaacatcacagcccggattgacgagccactggtgctgaagtgtaagggggccccc

SEQ ID NO: 717676 - DNA, 165 bp, Homo sapiens
ttagatcactgtttgggaagaactgtactttgatatatacttttcgagtatttacagcaacatattgatataatcagctgatcttggcatggctaaggacttgatgtatagtgaacctggcttcccagcctcagttgacgatgtgtattcttgttgacttatgaa

SEQ ID NO: 717677 - DNA, 80 bp, Homo sapiens
ccaaaaataaattgtacttccaaaatccttcttaagagttactctttccctagattgtaaattaagtttggcattattgt

SEQ ID NO: 717678 - DNA, 431 bp, Homo sapiens
  misc_feature (278)..(278): n is a, c, g, or t
  misc_feature (431)..(431): n is a, c, g, or t
tccctgagaatccaaaattctccgtgccacctatcacaccccaaaaaaaaaaaaaaaaaaaaaaaaaaattttggggcggcctctcgcgggccccaggaagaaaacatttcagaagaaccatccgcgtggggccgccggcgggccgcagttagggcaacagtcggcaacgggcggtcacaagaggcggtcccctagaagagagcatccgcggggtcaccggaaccaaggggcgcggggatatctcctcccgaccaatataaaaaaaaagcgccgcggnggggaacaaccccgaagcggtctctcgaacacaatctccgcaaaagaagagtcgccggggaggcacatacaagcgggaccttctaaccacaacaggggagtcacagcacgagacgctccgaattacacaaattacgcccccagccgagggacn

SEQ ID NO: 717679 - DNA, 254 bp, Homo sapiens
cggcacgattctattagagaaattgtgaaattatgttgcactgcgcagctcagccgagaatgggctagctgcacaatgaggcacagggctggaggcaagttttatagggtcctgaggaagggagctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 717680 - DNA, 138 bp, Homo sapiens
ccataaactgtccacgctcacaacaaatttgttgtaggaccaagataaagagccagatttaagccccctaatcctactgtatggcctccgcatagtattaacacatcaatttgtataaatcagtatctgacacgtcct

SEQ ID NO: 717681 - DNA, 485 bp, Homo sapiens
ggtcgggtgcggtgcttatgcctgtaattccagcactttgggaggccaaggcaggtggatcacctgaggtcaggatttcaagaccagcctgccagcataacatagtgaaactccatctctactaaaaatacaaaaaaattagctgggcttggtggcaggtgcctgtaatcccagctacttcggtaggctaaggcaagagaatagcttgaacccatgaggcggaggttgcagtgagccgagattgtgccattgcactctagcctgggtgacgagtgaaactgtctcaaaaataataataataataattaataagtaaatacaaataagaatcaaattaaaatacaagaagccaggataagccaggtgcagtagttcatgcctgtaatcccagcaatttgggaggctgaggcgggcagattgcttgagcccaggagtacaggaccagcctgggcaacatggcaaacccttgtctctactaaaaatac

SEQ ID NO: 717682 - DNA, 313 bp, Homo sapiens
gtgcacaacctagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 717683 - DNA, 214 bp, Homo sapiens
ttacagcggaccccaatgacggctgctgtctcctggagaaacttgtacaagaggagcaatgaattcgactacccatcggtggtgcagctggcgcacaagcttgctgaaaacaacatccagcccatcttcgcggagaccagtaggatggtgaagacctacgagaaactcaccgagatcatccccaagtcagccgtgggtgtgtccggctgtctga

SEQ ID NO: 717684 - DNA, 243 bp, Homo sapiens
  misc_feature (59)..(59): n is a, c, g, or t
cggtctactgatgcatcatcacgctgcatggaatccactgcattcaattggcatccatnttggccacacaacatggagtccactgcattcaatcaggatccattgggccaatcgtgcatgcaatccacgtgcattcactctgggatgcatttcacacgtgctgcatggactccagtgcattcaatcacactgcatggaatccactgcattcaatcggtatcaacggtaagagcgctcttaccg

SEQ ID NO: 717685 - DNA, 1640 bp, Homo sapiens
  misc_feature (540)..(540): n is a, c, g, or t
  misc_feature (778)..(778): n is a, c, g, or t
gggaggacagaaacctcccgtggagcctgaagggcaagaagctcgctgtgtactctatggagtattgtccaggtatcgcatatactaggaccgctgaacagtctggggccctcactggatcgcttcttgaccttgttgcgcgttggtaaagcacggatggtgtcatgataagagttaccatcgatgggcataactgtgcttgttggactggtccacagtcgcttgcatacgtcgaccgctcgcttctttgactccattcgtatgtcgcgctcttcctatcatatgtgagagccagactttcaccagagccgattcggaagttgttcgacctcatcctcacattagtgggacacccgtttgagctcggggagttaggaccagtcgctgcagaccacggtttacgttgtataccaccttacttgacttgcatgttgtctgcttggcccactggataaaattctctttggctacaggtaacgacggacgggaaaatcccggacatcgcgttctcccacggaaccattcttgggctgggtacanctgtttgaccttttgaggacttggatgggcaggtccctaaactggagagggccgggaaaaaggccgtaaccctacattcattggctgtggcgaaccttcaacttgaagcgtggaaaaaccgagacccttctttgagaggttccgggggatatctccccccgagggccccaagggtggcgcgggcaataatcggaaacttaagccgagggctcaaacgtaccggtccgctgcctgtggntaacggcccctttccgggggttttgggggccctcttacagcgcaatgagagctcctagggggttctctcgcgtcgcggcgctccgtgcggttctgctcatcttcctctggcggctctgtgtactcgtcccgtgcccacagtcgggcacactggagataatccacggacgacgggcacgctcccccccctgaagtcggctttctgctccatcttcgtgatgtcgccatgctagccccccgctcagtggttgtgaccctctcccgcgccctccgcgtcgtggcggcgcctacttgtctgcatttatccatttgtgctttgtactcgggcgcagcgtcctgtggcatccaggcctgcttccccgcatcatttgcctctgttcccactgctcacgaacaaccacctctcatgaactaaatacgactcccctttattctcccgaactaacaataaagtatcatcactgcactagacaactcttccaggccccacccatactacgcaacactcttaactcagaaccaacatctagccctccaaaaaatcgtcacactcatcttccggtggttcatgaccacctcgcgtgtccctcagtctcgtccacaacaaccaaacaattcgtcttcgatatcacctcccacaaccttagtcttagttctctatctatgtctcaccacgaatattctttatcgccgctacactccacttacatctgtcacatgacattgactagtccctccataaattcattatgaccagcataaattcacaataaacaccactccatcgctccttcttaccaaaacatactgatttgcaagatcattaacaactaactcacacaacaataccatatatacatcag

SEQ ID NO: 717686 - DNA, 500 bp, Homo sapiens
cttgggcacagggactatgggggtctgcttgaaacatgtaggtattggtaggattagtagctgtattagcactttgctgttggatggttcgtcagcagcccataaaacactggctatgcatcccagtgcctttgtaacttgttttctgttcctatgtttatgcaacagatcacggatacaatggaatagctcataaatgttcaaataaaacttgactgtaagcaggtgtaaagccatacaaacctgacaattaagggatatcacactttgcactttgaattgtagtatgtgcatccactgtacatccctgagtcaagtttgaacttttgctcttttttgttgctctttcccaaagttgttattgttaccaacctgtcgctgtatggccggggtgttttaatcaggtggggttagaggccagaggtgctatggggcggtagtcatttagacaatccagcttccctttatagtgttaatatggtgtcaggctgtgtcgacgc

SEQ ID NO: 717687 - DNA, 320 bp, Homo sapiens
ctttccctgtccagtgacgttacacctgtccacaagcatggaaaacaacttcgtcaacctctccgagggcctttatgctgaaaacgaaacgcgcatcctcatagaggacctgcatgctgcagggaagaccactatcgtgtacaagcttaaactgatccagatcgtgaccaccattcccaccataggctacaacgtgggaaccgaggcgtacaagagcatcagcttcactgtgtgtgaacatccaggccaggacaagatccggcccctgtggcgccactactttcagaacacacaaggcctgatcttagtggggagcagca

SEQ ID NO: 717688 - DNA, 696 bp, Homo sapiens
ccctccaggaccagcactgcgagagcctgtccctgtgccagcaacatctcagtgactgcagtgcaactgcatcctgtggacctcattggcacctgctggccccgcagccctgcttggtggcatgctagtggttctggccctgccctgcctttttctatgtgtgtcctgctacaataccacaaacaatgtgctacctgggatgtgcctggccaatggcagctgggcctgccctgctgtgaattactcctgatgtgccatggatgatcctcaagtgatgtgatgaaaaaaacgcaatggtgcactaccatgtctgcatgtcatcatcaactacctgggccacttgtatctccctgtgtggccctcctggtggcctttgtcctctttcttgctggctcaggagcatcctggtgccttgctgaaacatcatccactggaacctcatctcctgccttcatcctgctgcaactgccacctggttctgtggtccagctaaccatgagccccgaggtccaccagagcaactgtgggcttgtgtgcaggttggtgacagcctgcctacaactacttccattgtgaccgaacttcttctggatgtcggcgagggctggtacctgcacacagccatcgttgctcacatatccatgaccggctgcgcaaatggatgtccatctgaattgctgtgtttgtgccttccca

SEQ ID NO: 717689 - DNA, 236 bp, Homo sapiens
aaacatgagcgcaacacaaacctacaagcataaacacacagctgcacacacatgcacaaacacagcacacaaacaacacacacacatgcacacacacaaacacacatgcacacacacgaacacaagcacaacacacaaacacatgcagaaacacacatacaagcagaaacacccatgcacacacatgcacaaacatatacacacaatcacacacaagcacacacaaacatatgcac

SEQ ID NO: 717690 - DNA, 232 bp, Homo sapiens
gctattcagggtttcttttcctgataaaccctttgaaaattttttttggggttttgtttccctttttgaaactgttcccccctttaaaaatttttaatccccttgataaaatttatccttccccccctcgggttttacaaaagttgatttttattttaaatgtttaattgtatttgattaaccccttaactggattttggaataataaaactttcgtccaatttggctttta

SEQ ID NO: 717691 - DNA, 129 bp, Homo sapiens
ccggggttaaaaggataaaaggttgttttggaaaaattatttgttttgtcctaaggggtcctgcccacccctaattttttggccgccccgggggggggtttggttttttaacccgctttgtttccggga

SEQ ID NO: 717692 - DNA, 495 bp, Homo sapiens
ctcagtctgtcatatgtagtgaggtgctttcacgagagaaatgaaacctaaattaaaacaacatttagaaaccagacatcccagttgcagggaacctgtggactattttctaagacgactccaatagctgagggcatcacaaaagtgccgaacatcttcatgttcaaaacaagtacaagtacatcttactgtgctcaccttgtagcaatggccaagaaagcccacacaaaagcagaacagcaaataactgctgataattataaaatggttatgattattttaataattttacttcagtttgctggtttctgttcagttcaaccagatcagtgttaatgttttataaacagttcagtttagttaatggtaacttaacttttccttaccctaaccactgtttacagtatttgtcatttttactctgtaatatttctataatttgatacattttgttaaatgacagcaataaaatattgtttatttgtaaaaaaaaaa

SEQ ID NO: 717693 - DNA, 386 bp, Homo sapiens
gttccaagtggaagattaccttccaagaaccccgcacttaaggtcttaaaagcccgccatttacgacgacgaacgtcgatacggacgtagccgacgtcgaaaaccaagcggaatcggaggaataattaagatccaccaactaagcgccggaatcttaatatatatccgaagactctctcgtaagagcagacgtagccaaggaagaaaacccgaagtcaaaactagaaaattaagcctccggataacacacacaaaactctacgctagtcctcagcgccccctaaataatcgatatacaaagcaaaagaaagcaagggaccgatatttcctcgccccacggccgtcgtcgactacacccctcccatcccggacagaccttgccatgc

SEQ ID NO: 717694 - DNA, 291 bp, Homo sapiens
gctcaggatacctaccactacctgcccttcaggctgacgcaccggaggccacactggttaactaccaagaacagcatcgagcgtagcttgaaggccttgtcttcgtacgagcccctgaacttccacgccatgttccaggcctttcttgagatgatacatgaggctagtggctatgggggatccatgagagtcaatctgccagcacgttaactaggtactgcccgcatgtactacaacaaagcgactgggaaaacatacgccgatcccccatttaattcctatgcatcaacc

SEQ ID NO: 717695 - DNA, 131 bp, Homo sapiens
  misc_feature (22)..(22): n is a, c, g, or t
  misc_feature (88)..(88): n is a, c, g, or t
  misc_feature (106)..(106): n is a, c, g, or t
acatttctactatgatcagaanaacatgattttacaagtataacagttttgagtaattcaagcctcctaaacagacaggaatttaganaaagtcaatgtacttgtntgaatatttgttttaataccacagc

SEQ ID NO: 717696 - DNA, 317 bp, Homo sapiens
  misc_feature (129)..(129): n is a, c, g, or t
ctctctccacagctaggcaggcggtgcttctaatactggtgatgctagaggtgatgtttttggtaaacatggcggggtagagatttgccgatgtatccttttacttttttttaaccttttccttatgangcatgcctagtgtatgggattgacatgtgaggtgtaataagtgacttgtgtggttgatatgtagaatattgggctggttaatttgtcatgttacagtgttttacatctagacgcaggctttatgccggaggagaaatgttttcatggttactttatactaaacattagttcttctataggggtgatag

SEQ ID NO: 717697 - DNA, 902 bp, Homo sapiens
  misc_feature (1)..(1): n is a, c, g, or t
nggcagcggctggctcgcgcaagagtctgccacagagtgggacctccgggactaggagcaaacaaagaactctcaggagctcacgaacgctgggggcaccgaaagcccccacgggccgcgccccccccgggagatcccctgtccccccgcgcatataacccccgcgattcccccgtagtggagtcccgaacgcggcaaaacaaacaagctcgtctgggtggacaaaaaaccgactcccccgtcctcggcaacccggggcgccgcgcaatcttgtaaagcatgcgggcacaccccgcaggtaaaaacagtccctcgaagagcggcaaccctgcccggggggcgaccctttcccccaagcagccacccactccgggggcacgccaccactgctgcggtgagatgggacccccgaacacgccacccgcggggggagtacagtaccacacacgccgctcgggggcgcacccaatcgattggcactaggtccagcaggcacgcagcgtcccccccaatgcttcccccgagcccacctacgcgagagggccatcggcgtagatttctcacccccaacgcgcccgccccccccccccatacacaagcatcggcgggacatacgcgggtttgagaccctttgtgcattctcagccggcctcccttatcttagtggtcaaagaattcggggttgatcgagacccacagcgcatcttattagactccccgccctcgaacagataagtagaaagatctttcgcggcaccccacgtgttctatgtcggcgatgtggcaccatgagtacagttacggggtgctccaataaagcccagcacagtggtagtcgggcacgacagccccccgccaaaagtcggccaaaacttgggaaccccaaaaccagactacatgac

SEQ ID NO: 717698 - DNA, 1744 bp, Homo sapiens
  misc_feature (322)..(322): n is a, c, g, or t
  misc_feature (683)..(683): n is a, c, g, or t
ataatgattgttgttgtatgtccctcacgacgtcggtcgtgtggaagattattcgtcccgccgcggacgtgtgttgaccgctgagttctcctccccgcgataaaaaatactgccctcttggtgggaataaaaacaaagggggtatgctgctttcctgacgcctcctatctgtaatataccctacacattgtgggcgctttgctctacataaggggggttgttattaacttcgcgctggtgctggtggcgcaagcaccagccaccgaaagataatatgtgtcgttagcacccagcgtttacggagggctatattatataacgntcgcgtgattggaaacacaacataccacctgatgctgtcaataatatgtgttgtgtcacacacctgcttccctcgcggctcgtcgccacgaatgtatgataattgctgttcctgcgcgccattataattctcccccactcaacaccgagggcggcgcgtcccacaaaagagtgatatttttttatatagcccggtggtaatatctgttcgggccgtacaagacaagcgcttgctcgctgcccggcggggaaggcccacaacaatatttgtggacagaaagatgggaggtattcctgtggcacggctggacgaacaagttggccctttctccgtgggaagagccccccttcatggggggagngtctgctactatacctcggtgttcccctgtgtgtggcaccgccccgcccttatggggttggggggccctctcggagactttggggggccaacattcgtggtttagaatatatgggccacgacaaaaccgtgttcaatttgtctcacccttgattgaacaccatcttccgggtattgccttataccacgccggaaacaacacggcgtaagcataacaaccgcgtttcgataataggcctgcaacactcttctcccacaccatgatatgggttgcgccctagatgcaccacttataggggagagcccttggttaataatgtctggtcgccaacatactaacataataagggagaggaggcgctttacagatgtgtgcaaccgcttggagatgtttctcccccgctgatgatttgcgcttacacagggggggataatacaacaccctccgttataggagcccacaaaataccccttaagacgcggcgccacaaaaatatctccacatggtttcctacgcgtatatacaaataatatttcacaatcgcgggcgcgtagaaagatctgtaaaacgttgtgttttgtgcacgcacacacaaacacgcatgttgttgtgcggggccgcatatatctcggggaaaatgtccaccccgcacacgggttatactctgggagcatatactcccgccgagatggcgacataaacacgccacacacatgagaaaacacatccgctatatacacatctcgataagggctacaattctacatgttctgtttagaacacagcacagtgataataatgtaaataaatgtcttcacatggagatttgaggagaagccttcgcttctgaaagcgagaaagtcctaacataagtatgagagaacgcctccaaagaaacctggaggggagactaataatggagatgccccccacccctaggcacacacacacattcgagagaaacccggtaataacaatataaaatttagacaaaaaaggaaagaatcgaaccccccaaaactggtttcaagccaaccccccggcctccatgacatttttca

SEQ ID NO: 717699 - DNA, 125 bp, Homo sapiens
atttcatatttaacagtacaacatgtttacaaaacataaattttttttcaagtattaaaaccgtgtaactttaggaggccgaggcggatggattacctgaggtcagtgagttcgatgaccagcct

SEQ ID NO: 717700 - DNA, 202 bp, Homo sapiens
aatacacgatcataagctaaacaaaaactaaaactaagaattctcaaaagagggggtgccaaacagggaaagactgatgaaaagtaaaatggactacttttgtaacttacctgtttgttaggaaatggaatggtttctttgatttaaaatgaataaaaatagattattacgtctttggtattgagtctgtattaactgcttg

SEQ ID NO: 717701 - DNA, 1007 bp, Homo sapiens
gacgcaaaactgattgcaatataagtgtgataacgttctttaataagaggtaagagcaatgctgctttgcgagagcagcacaagagggactaaaggcatacatcttgccctgggatgaggccagggggacgcggaatatcaattccccattatctcattgtatagtcatttacgaagcgtctcttgcaagaaggattcccctgggttgtttgaaaatactacttgatgatatggctcgatggaatggtccacgtaatcgaatcctccctatcgtagacttttgcaaaccaaaggttgtacctggagtcgtgtgcactccgtttctaacctaggggagtaggcattggatcttgacggtttcatgcttacgaaggatgagtgcttctggggtatacgggccccggaatgtgttccctggtgtactcggcgagctttcgcattgcccctcgcgctgagtgcctcctcgtggtgcccctttgccgctttgctcaattggctcgtcctcttcaggaggtgcgtcccagctggtcctttgcattttggggtgttcttgggaccgactgttgcgcaaatggcatcttcgcgcgccgtggacaacaaactcttgctagtacctggcaataaagcacatctttattatcccgaggtccaaagcgatgggaagactgtatagaggaaatccttcgtacagagacccttctactgccatgtgatttctttgtcagagtacattgaacatattgaccatagatgtttgtcccctagagcagtcatgtggagcactcttcgggagaaaaggttctggaaagcagatctttgtaatactgttcgccaagaaattacaattgtagaaagggcctatttggccctaggaatagacactgtcgtcgaagaaacattcttcaaggagcctgcagttgccctattgaggaaattgaggtatccaccacaaggtgggggacacggtttacctttacaagggacctgtaaccaatactggttggtcg

SEQ ID NO: 717702 - DNA, 883 bp, Homo sapiens
  misc_feature (11)..(12): n is a, c, g, or t
  misc_feature (24)..(24): n is a, c, g, or t
  misc_feature (168)..(168): n is a, c, g, or t
  misc_feature (219)..(220): n is a, c, g, or t
  misc_feature (275)..(275): n is a, c, g, or t
  misc_feature (485)..(485): n is a, c, g, or t
  misc_feature (847)..(847): n is a, c, g, or t
catcatacccnnctattatacttnactcctcttacacatcttacccctccctttatcatccttttttcacaccatcaatttcaccactactcctatttatccacctcttctaaccacctcctttgacccgctaaatacaaattctgcccaccttcccctccactcctnccaaacgtgtgaatcctaaccgtcttttttacttgggtgatgacggtcccnnactaaccccaccaaccacccacttattctaagctaccgtaccccttttttacccncggttctaaaatctatctttacatatttcccaaaccaaccccaattcacattcttacccccctttatataaacaacctaaattctccctttgttagccttccatctataaaagtacccccaaacttttccccctattttttccaaaaaacctcactctccttaccactattacccattttctatcccaattcccttccacaccaatatcnccattccctcccaaaaaataccccctcttttcccttattctaccctatttttccctcaactcccctttcttcccccctgactttttattacaaagcccacctcttctccacacgccttgtcttttatcctttaaattaccatatccttctaagacacccgccctcattactcctttgatatacttcaccgcccctctaactccgcttttctcttcctcattttaatatagaaccgctccctcctatcccaatgaccttttgtgatataaacagctcaatccaagcttcccctattctctaaagaagagcatacattttattcaccaaagccctttttccaataccaccctcacaacccactnatctttatagcataataatctcttttcaacatcgct

SEQ ID NO: 717703 - DNA, 1829 bp, Homo sapiens
  misc_feature (351)..(351): n is a, c, g, or t
cgagcgacctgcggcggggcggaacgatgagccgggtgatcgcaaggatggatgggcttgcaggcgtcatcatgattcggtctggccttggagctcttcggagacaccggcgagggcggcagttatatggttccatgagggcacgacgtgtggcctctgcggcgacgttctcgtggtggcgcatggacgcgggcggtaatgtaggtggcgtgcgctggggcctacgagcgacggtagacgctgcgtcacgacacctactgtacaccctgggagtgagcgagtgtacggcaacaatccactgagcacatgcgaatgccaccatcacgctatccgctggcggcaacccctacntgctccgacgtacaccgcgttctcgtcttcggggtgcgtgctcttcggcggcctgtgtggatccatgggaacagtgcccatgacatctccaagggagtctctggagcctgctttggagccccgggtcatgcacagcgagccactcggggcatgttcaccatgagcgaggcagggcgcctggcctgatcactgctgtgccaagcgatgcagagaacggcacggacgctggcctctgataggagtgcccgttgacacaggcccagaggcgctcattcgctgggcgctagtcagacccccacaggcgaggctcgaggcgttctgggaaagcggcccgacatgtggggcagtaaggcgcccagatacataataggagaccgcggtggccgcggcaccacatggggcttcccaaggggcatccgcagagaatgggccacagcggcacaggtccggtgcagcacacgcgacaaccattgcgcggaaaacggccgcacttctgacacgaccatacgcctcggaccaatttgctggcacatgctatagcgttctcggaccgggcccggacacaggattagggacactttgcgcgccccacgcaacggcataggcgtcgcggacgatggcaagaacttaaccaccagaaaggagtaacgtaacgcacagacagcgcaatttcacacgtgggaaccctcaccgttgggcgcgacccccatgaacaggggcacaaacaccgcagaaagcggttaaaaccgaacattccaagggaccataggtccgcctacagagattgtgtcagcaccaggggtacgctctccggcgcacccaacgagggagccatctcgggcacccaaacacggagccgaccggagcaggagactcgccccagtgcagctggaggcgctcccaccacgagaggcgctgtcgaacagcgcgctcacaacagcatacaggggggcagcaccaatcggagacagcgccccagagagaaggaacgccaaacgcaccggacacacaacgggcgcaccagcgctgggcaagcaccaaggcgagacggggacaagccgccatgaaaaccagagacgctgagccacaactggggagctcaccacatcgctgcagacacagacacagagtagggagatcaagaccaggggaaacgacacacccggagatgtgcgccacgagaaaccagaacgagcacctggcgggccacatcgggacagacacacacaccccaaaagcgacaaacaacaagagggccccatagcaacggacagataagcccacggaacagggcgccagaccagaactcatagggaaacccacaggacggagaagtacaccgacagacaaggagagaacaacacagtgaccagctggcacaactcaagcaaacaagaggcaataacagcacagacaacgacgcgccagaacagacagcaaactgaataagcaaagcaaaaaccagagccaacaacccg

SEQ ID NO: 717704 - DNA, 132 bp, Homo sapiens
atctgagatccagcaccgtctagaatcgggcgtgtctagccacttcaatctccgtctcccaggttcaagtattctcccacctcagcctctagagtagcttggactacagtgctacaccaccatgccacgcgt

SEQ ID NO: 717705 - DNA, 207 bp, Homo sapiens
atgatctactcccctaatattaacataaaaacccaatgggaactatagaaattcaaatagaagtacataaacctgtcatcaatcgtaacaaaaaactatttgtggaacagacatggatgacaaatggactactgtgtcaattttagaatgaggcagacacaagttggaaggccggttacttttcccctccttctcatgcttcagttt

SEQ ID NO: 717706 - DNA, 841 bp, Homo sapiens
  misc_feature (36)..(36): n is a, c, g, or t
  misc_feature (122)..(122): n is a, c, g, or t
  misc_feature (222)..(222): n is a, c, g, or t
  misc_feature (236)..(236): n is a, c, g, or t
  misc_feature (298)..(298): n is a, c, g, or t
  misc_feature (306)..(306): n is a, c, g, or t
  misc_feature (393)..(393): n is a, c, g, or t
  misc_feature (415)..(415): n is a, c, g, or t
  misc_feature (539)..(539): n is a, c, g, or t
  misc_feature (615)..(615): n is a, c, g, or t
  misc_feature (630)..(630): n is a, c, g, or t
  misc_feature (650)..(650): n is a, c, g, or t
  misc_feature (655)..(655): n is a, c, g, or t
  misc_feature (692)..(692): n is a, c, g, or t
  misc_feature (702)..(702): n is a, c, g, or t
  misc_feature (706)..(706): n is a, c, g, or t
  misc_feature (745)..(745): n is a, c, g, or t
  misc_feature (747)..(747): n is a, c, g, or t
  misc_feature (756)..(756): n is a, c, g, or t
  misc_feature (773)..(773): n is a, c, g, or t
  misc_feature (781)..(781): n is a, c, g, or t
  misc_feature (802)..(802): n is a, c, g, or t
ttggatttaatgatctaaagctcaaagatgcatgcnacaactagctaaaagtacataaaaagcgcacctctggaaaaaacagcccttcctctggctgaagactgaaaagcattaaggatgcntctggattgctgcagcggcagggcaggggtttgcacaggcctgaactggtgtggctggagcccgggatcccctcctgggtgcggccccgaaaggcagggngggaggggcttgcnggggtgtgccatgggagcgctgccaaccaagtttgggtttctaaaagccaccctcagtttanaccaactnaacaggaaaaaggtggcgacagggccttgaagggtacatgccggcttcccttaagttgattagatgggaaaccaaaaaccgtctttnaagtttaaaggtgttccaagcnccctcagggaggaggggcgcggggtctgatcagggctgcctctcccctaaccagccggcagaggtaaacaggagaacagcaccagaaaggctgggggttggcagcggcccaagacagaatagcngacctgcagcagaacggctgtgggtgaaccggacagtcaggccctccacaagcactgtactggagtatcgtctgantaggtgaaccctctngcttttcgaagacgcagggnacccnactgccaccagccagttagccgactaggacacctctngacagggaantcanctcaaaatcggaggacaacctgatgcacccaagttacantngacccaggnagctgttcacaccaggnggggaggngtttggaacagttagactcancagttgataggtttctctagcacaaatggaatgtggtgt

SEQ ID NO: 717707 - DNA, 304 bp, Homo sapiens
tgcatgctgtgtaagctgctgtctcaagggcgtacaactagatgatggagaagtctttggcaaagtcaggcctcctaattgttcataggacagaaccaactctccttcacacacatgggaactagatagttggttcttgattgggagacaatttcctcaatgataggctaaggaaaacctctacctaccaaagtgggcgggtttttaaatatcttttttacaaaagaaaatcctctcttggcaaatatccaatctcttacttccacaaaggatttgaaatattaggttaaaatttatttaattt

SEQ ID NO: 717708 - DNA, 568 bp, Homo sapiens
  misc_feature (6)..(6): n is a, c, g, or t
  misc_feature (135)..(135): n is a, c, g, or t
ctgccnaatgggcatgaccagatgccattgcagcaaaatatcttcgaagtgatggataagctacgtgagatctaccctcaacgtaagtttgtgatgagccgctttgaagaggtatttgagaagatcgaagcgcancggataatctggcaaccctgaaagggaatttattgatggcaaatatatgcgcgtgcatcgcaccatcggttctacgcgtatggatatcaaaattgcccacgcgcgtattgaaaataagattgttaatctgctggaaccgctggcaacactggcctggacgttgggttttgaataccaccacggcttgctggagaaaatgtggaaagagatcttaaaaaatcatgcccacgacagtatcggctgctgctgtagtgacaaagttcatcgcgaaatcgtcgccgcttcgaactggctgaagacatggcggataatctgattcgtttctacatgcgcaaaattgccgacaacatgccgcagagcgacgccgacaaactcgtcctgtttaacctgatgccctggccgcgtgaagaagttatcaacaccactgtgcggc

SEQ ID NO: 717709 - DNA, 301 bp, Homo sapiens
ccatcgacattgccctattgggccatgttgcggagccatctacttttagtgtagttgtgttgttctcatattaagttttagtataatttgaattttataattgactaataggatttaatgctaaaggttgattacttaatgctgaatttaatgtcaaatgagttgaatgaaatcaaaaatggatcgggagccctagatctcaaaagggaaatgtgaaaagagaaaaagtaggttctcgttatacagagggtttatttataccctcttggaaataactgtttcaaatagggcaatgtcgatg

SEQ ID NO: 717710 - DNA, 918 bp, Homo sapiens
gaataggctaggtacgaggcttgtggtatatctggccgaggaagagaccttagcttaatgcagggtggtggagaacgagagacaaaacgctgtctccttttcagaagggaaactgaaagaaacgaggggaatgagtattagagaccattactggctgggcatggacactctcagcagctcaactgcccagatgtgaccagtggccacctctgaagatgtcttccacaaactggtcttgactcgtctgctgaacaaatcctctgacctcaggcctggactgtgaacgtagttcctgagagatagcaaacatgcccaacagtgagcccgcatctctgctggagctgttcaacagcatcgcacacacaatggggagctcgtaaggtccctcaacagcgggaaatgcgtcacaaggatgaaatagattctgcatgtaaagatgtaggtagtcattaaaaatgagctacaaagctgacgctgagggaggattacaaaggctgactgtcctccagggaacccaagcacctaccagtaatcatggcccagatgccaccagaaggcttgcaagaggatatagtggacccatggaacagtacagacaagccagtgcaaaaggctagactacgataaagctccatgtacgagatagaaagtagtaaaaattgcacaacagcagctaataaaacccgaatagaagaggagccaacgtgcaaggaccacaccaattccatgcgcaaaggcatctacttcctcagcaagagatatgaatagtgtctagactgcctaatgacaatatagaagcaataaatctgacacgggacggagcctctactgaaccaagcataaggctcatatacaataaatacacaatggcaagattataacggcctgaaacaaagaagcagatatagtagctgcagc

SEQ ID NO: 717711 - DNA, 184 bp, Homo sapiens
tggttttgggggtttttcatgttttagcctttggaaaaaaaaactgggccatgtaaaaactttccatgtttttttttcaaatgtttaaccccctagttgatgtatgggatctttaaaaatttgcccgtctgtttgctcaaaattgcttttaaaccaaaaaaaatttttttattttttaaggcca

SEQ ID NO: 717712 - DNA, 459 bp, Homo sapiens
agctcaccgtgtagcttacaattgttttaattatgtatttgccaagtgtgcatataagtacacttttttagtgtgatatgcgtagtttctgctacgtgtgatattcctggaggttgataactttgcttgcagtagattttctttagtaagaactgggcagttacatgcaatacattcagaagtattttcctgtgcaaaataacccagttatttaggtttggttggctatctaaattatggtgtgtatatctttgatgtgggcgacatttgtataattgtatcgtatagctgtattgaatcatgtccgtatcaaatattagatgtgatttccctagtgttaatcgaatttaaacccattttagtcacttttttttttccaaaaaaatactgcgcaaatgctgatgttcagcgtaatttcttggcctgttcagtccgggaagggggtgctcagttgtagaa

SEQ ID NO: 717713 - DNA, 291 bp, Homo sapiens
gacgttcgggaggcaaggcgggcagatcatgaggtcaggaaatggagaccatcctggctaacacggtgagggcccatctttactaaaaatacaaaagattagacgggcgtggaggcacgcgcctgtagtcccagctactagggaggctgaggcaggagaatcgcttgaacccaggaggcagaggttgcagtgagccgagatcgtgccactgcgggccagcctgggcagcagaatgagactctgtctcaaaagaaaaaaaacaaaacagtaaactcataaactctcaaaaaa

SEQ ID NO: 717714 - DNA, 202 bp, Homo sapiens
aggatctttgcgagtcatggtcaggagtcgatacagcctgtgcacatgtgaaacctgtctctactaaaatgcgcacaaaaaatagcggcgtgtggcatgtactgtagtccagctacttagaggctaggaggagaatatgcttgaaccgggagttgaggttgcagtgatccaggattgtgcactgcactccaggctggcaaca

SEQ ID NO: 717715 - DNA, 838 bp, Homo sapiens
tggggtcttgcccccggattaaaaaatcgggaacggtaaaggtaaccccagccggtgggagcgaactccccccaaattccacaaggtgcccagaaagacttttgattgcgcccatttgttgtttttattaaatattctcattcccaaatatttagaagatcgctgtgggtacacagagagtaggctccctgtgtgcacactcctatataaacgcccacccccattatcctctctctataaggagaaacatgtgcgcccgagtcctctctctctccccagatgtctcaccacccgagtggtgggagtgtgtgtatatcacgcattgccgcctgtctcgctggttgttctacacttatatgtgtctcgatgtgcccacaacatttcttcctttatatatctctctctccgccctctatatacatactttttctactatctctgtgtgtattctactattctgtgcggcacatgtgtagatgccacgccctttctggtgtgtggcccccccctctatctccccctcttctttctgtgctccccccccacacattatttgcgaaatagtgtttattgcaagaggggctttgtggtgctctccccgctgtggaaaacagtgtggggtttcagtcagcgccaacgcccgagggggtcatatcccgcctggcttaccccggtgccgcttcatgaaaaccacgccgttgtgaaaataaccaagggtcgcccaccctcttttaaaaaaagaatacaaaaccaaactaaataaaacgacaacacaaatcacaccaaccaggcgaggaccctaaactaaatagcggcggcaggcacaacaaacaaacag

SEQ ID NO: 717716 - DNA, 297 bp, Homo sapiens
ggggggggggggggggggggggggggtttttttaaccaagccttttttttttaccccccattttcccggggagcccccccccccttttttttccccccttaaaaaacccggggggggtccccccccccggttttttttttgggccgggggggggttttcttttttccccgggaaacccttttgccccttgggccctttttggggccccttttaacccgttttttccaaaaaaaggggggggggcggggggggtttttccggggtttttttgccccccggggcccccccggggcccca

SEQ ID NO: 717717 - DNA, 336 bp, Homo sapiens
tggtgggtagcagcaacctagggatcagttagcaggtggttacagccatttaccaagatagttcgtcagttacgaagggcagatttattagagcaaatggtgaaacatatgttgcatgctgggcagcttcagcagagaaggggctactcgtgccgggaggccagcgtctaggaggacagttttatagggtcctgtgtgaagggtgctacgtgtgaaatgaggtcgattgtgcccgcaggttgtttgtgattagctgtttctaacaattgttcatacaataatcgttcattatcgttctcaacttggggctctccccaacctggggacccttcctta

SEQ ID NO: 717718 - DNA, 1381 bp, Homo sapiens
  misc_feature (836)..(836): n is a, c, g, or t
  misc_feature (852)..(854): n is a, c, g, or t
  misc_feature (875)..(875): n is a, c, g, or t
  misc_feature (879)..(879): n is a, c, g, or t
  misc_feature (881)..(882): n is a, c, g, or t
  misc_feature (885)..(885): n is a, c, g, or t
  misc_feature (891)..(893): n is a, c, g, or t
  misc_feature (918)..(918): n is a, c, g, or t
  misc_feature (920)..(920): n is a, c, g, or t
  misc_feature (1081)..(1081): n is a, c, g, or t
gaattcgagacagtcgtagtccaagttaatatcttaccgcttgttggggtatacttgattgttaatgttcttgtatctccatcataatcaactgtaaaatcatgaaattggccgtgtacgtcagacttacttaacgcttgggaagttccatcaacatctttagcccaccatctttgaacttttattccatccttagtagcaacttcttcattttcagtatcaacaaatgtgccatatggagcattcatagaatccccattccaaccaaaatcattagagttagttgaatcgatttggctaccatctttatcagactgtggagcttgatgaccatttgaccatgtatcaagcttaaatcccagagcattttgcaagccaccaatacccaagttgccaccagcattaccaatatctgtggtattaccgttatgaaaagcaaagctaataccgtcagctccattaggattggatcctaaattaaccttaccagttaaagtaaaactagtattcatatcaattttactcttgagagtgaaatttccaactttattatattcatctggtgtaatagtcacaataccagtattttgatcataagtggctgatccgtttaatgaaaagtaagcaagaaaattatccttagtaacatgtgttagaacttctttatcagtcgccaaagccttacttccactggttgaatcggccttcgttgcactactacttgcgccgattgaatcggcctttactgcactactacttgcaccggttgaatcggcctttactgcactactacttgcaccggttgaatcggcctttactgcactactacttgcacnggttgaatcggccttnnntgcactgctactacttgcacnggtngnntcngccttnnntgcactgctactacttgcactggtngnttcagcctttactgcactactgttatttgcactggttgaatcagccttcactgcaccactacttgcaccggtcgtttcagcttttactgcactgctactacttgcattggttgaatcgtccttcgctgcactgctgctacttgcactggttgaatcggtcnttactgcactactgctacttgcactggttgaatcggtctttactgcactactgctacttgcactggtcgtttcagcccttactgcactacttgaggtactggtagctgccacatcagctgacactggccgacttgtaactggcacccctaatccaagtgcaaacattgatgcaccgataactagccatcctttgtgagatttaaccatttggaatcgagttgtttccttcctacataatgtactttattttttcttaccgatggattttacgcatgttttgttgtctccttccggaattc

SEQ ID NO: 717719 - DNA, 124 bp, Homo sapiens
atagaataaacagcataatcaggcactgttttagttggtttttggttatttttagagacaatctgctctgtggcccgcactgaagtgcagtggccgatcacggcttactgctggcttgaactcc

SEQ ID NO: 717720 - DNA, 304 bp, Homo sapiens
gggatgggtgtgtgtgccggaggttatatccttacgcgatacgtgactccgacgtgagcggataggatagggggcgtaagtctgtcataatcttctggtgcagctgtatcccgataagcccagattcagcgggtttccatctaccagtaacattggcggaataattgtcaaagacagtagggatatattctccaggaaatgcattggttgtgtaagtgatcagtaggcgagtttgacctacaggtccgtctcccaccaccacgcacttgatggcctgcatcagggccggttggttggtccgctg

SEQ ID NO: 717721 - DNA, 541 bp, Homo sapiens
atgaggagtgtcagagtagccagaagaccatgaagagtttcatccaagaagggagcccacctgacttggtgtgtccatgtgcagcactcaccataccctgcccgggctggcccctccaccacctccaggcccacgagacaaaccatcgaggttgctttcaatcttgaccccgcgttcttcgaggaccatctgtggactggcggccggctggcgtctgttgtccatgtgctgctggaaggttcttacgaaggattatcttcaacagctcatcttcatggtgctgttttcagcctcgtcagggcagcctggaggctggaggggaagtgcagggccaggtggttgcaagctggttcctgttccttggacacctgctggggccctgcctgggcctgtgggctgctgtccagatctgcaccggttacagcgccttgcccaggaatgtgcattggatgtgacgtgtggcaatgtaacatgtatttgtttccatgagatgctggcgacaatgctccatttttcttttttgtataaagtcgtctggtgt

SEQ ID NO: 717722 - DNA, 155 bp, Homo sapiens
  misc_feature (75)..(75): n is a, c, g, or t
  misc_feature (94)..(94): n is a, c, g, or t
ccagcagttcagtggtaatcaaaactctgctagagcagaaggaaactcctaataatcacgtctcgtccgtttggntccatatctccatgcatgncggatacagtgaaatctcgagcatgcatcttctcggtgagccagtccaccttcctccgggt

SEQ ID NO: 717723 - DNA, 774 bp, Homo sapiens
  misc_feature (254)..(254): n is a, c, g, or t
  misc_feature (261)..(261): n is a, c, g, or t
  misc_feature (360)..(360): n is a, c, g, or t
ttgtgccaaaaagggttggatgcttcaaaattaagaattatattttttggtggtaggtaaagtttgggtactgcaaaattttaagggtactcccaaggaaggtagatggctgaggcaagaatttaaggtgtgaagtcaaggccaagaatattgaacagatgttttctgtccatttctaatgtttttgctttcacatatcttaaaatttttttgaaatactacgcaccctctcacatatataagttgacctctanaatgttntgctataaacttcatgaattacaacaaatgtaatttcccgtatattgtctatactgtcttttttgtttttcttttcagacagagtcttgctctgtcacncaggctggagaacagtggcgtgatctcggctcactgcaacctccacctcccaggttcaagcgattctcctgcctcaacctcccgagtagctgggactacaggcatgcatcatgagacctggctaatttttgtatttttagtagaaatggagttttgtcatgttggccaggctggtctcaaactcctgacctcaagtgatccacctgcctcggcctcccaaagtgctgggattagagctgtgagccactgcacctggcctatactgtcatttttaaataaaaaatttaaatattacatggctcaaataagttcaatggaatctaagtgctataccacatatttttttaaatacctacaataagagttttaacattgcttttcccctaaaattgtatttccattccacttccccca

SEQ ID NO: 717724 - DNA, 330 bp, Homo sapiens
tgatagtcgattcctagaggtatcccgggaacttcccgggggcacacatctcactcatactcctactcgatgacgcttcccagtctctggctttttgaaagcaaagatgagcaacactcgaagctgagaaggtccataatatggcatgatgcgacatgtttcacaacatacactcagacgtgatgacagagattgataagccaagcctgcatgacgatgatgaagagagaacttccccgaacttccttacgtgcgctgtgacaaacaagggcacagacttaccatcgcctgatgctctttgtagaaataaggacagagaatgacggataa

SEQ ID NO: 717725 - DNA, 508 bp, Homo sapiens
  misc_feature (18)..(18): n is a, c, g, or t
  misc_feature (200)..(200): n is a, c, g, or t
  misc_feature (252)..(253): n is a, c, g, or t
  misc_feature (276)..(276): n is a, c, g, or t
  misc_feature (337)..(337): n is a, c, g, or t
tcccctgttacttagctnggacttagggcagctgagaggcagatcatcatgcctctactttcttagcagagacaaggaagactggggctgtttgttaatgaggaaggggaaaatgggacaaaatactcctctttcaaatgaacactgtggagaaaatctttctgggtttggggatgtctttgtgaagacttaggggagtnataaagccagagacccccctttttttcctttccctgccttggatctaaggcnngtgagccaaatttggaagagggngttggaatttaagcttaaggctgcttaatgtcttcctgggggctggtgttttgggagggcngactaagagaaacaggtcaacctcaaagctggtctgctcatcctcttagaagaggtctggtttcttgggggttgagccaagagaggcccccctgtgagcacagtttcccaatctgaagtattaaccgggttcttttttttcagcagttttcaaaagcatgttttccggggt

SEQ ID NO: 717726 - DNA, 379 bp, Homo sapiens
  misc_feature (378)..(378): n is a, c, g, or t
gcagaacgaataccgttacggggttgaatcggcagcacaggcgcctgcaaccgctggaacgcgcagagtgtgtcgttctcgtcgacatcgagccgcgccggaatcgtcggcaccgagatcgacgcgttcggtaaccacggcgtcgtttgcgctgtaccagcgcacgaccgtgctcgtgcgcagccgcagcacggtgcggtgacgccgcccgtgttggtcgcgcgttggcgagccccgccgcgatcgcgaatcccgatccaaagcaggcgaccgaatgggaggccgtcggtgaccgcttgcggttccgtgcggggcaaccttacgacgcggcgagcgaattcgtgttcgcatcaccgcacgttgcttgcgatcccgaanc

SEQ ID NO: 717727 - DNA, 150 bp, Homo sapiens
gcggcatggccatcctgagcatgctgcaggacatgaatttcatgaacaactacaaaattgactgcccgagcctggcccgggtctgtttgatgataaagaaggcctaccgctatcccccctaccacaactggccattcaacgcctacgagg

SEQ ID NO: 717728 - DNA, 377 bp, Homo sapiens
  misc_feature (320)..(320): n is a, c, g, or t
  misc_feature (364)..(364): n is a, c, g, or t
ttggataacagtaatttttaacaataaatttcaactaagggtgtgggggcaggtattcttgcagattgacttacttataggttctctcactattacttcagaacctcgtctaaggcaagggtcagcaaaatatggctgttttgtaaataaagctttattggaacatagccacagccattcacatgtatatcattccatagctgctttctggaaagatagagtttgagtagttgtggcagaaactgcaaaacctaaaatatttactgtttggctccttactgaaggagtttgctgacccatgatctaagggtacctattgngtcaattagtcactggatgtcattagggaagagacataaggtgngcaagcccaacat

SEQ ID NO: 717729 - DNA, 404 bp, Homo sapiens
  misc_feature (90)..(90): n is a, c, g, or t
  misc_feature (102)..(102): n is a, c, g, or t
  misc_feature (113)..(113): n is a, c, g, or t
  misc_feature (148)..(148): n is a, c, g, or t
  misc_feature (330)..(330): n is a, c, g, or t
  misc_feature (396)..(396): n is a, c, g, or t
ggccatattagcagcggttattcggtgagcggtggtgggtttaaattcttccgcggagttaagggctccgtggacatctcaggtcttcangggtcttcccantctgggaaacnctatactaacagttcagaaaacatgtctcgaaganctatgactcccagggaacccaacttacttatttttcctccaggaacgggtccgcttattaccaagggttgaacttattggccccatttgggggcaaaacgggcctttaattttgggggggaaccaaattttgccagggggcaaacccttggtttgtgggggaacatttcttccgccaaaaanaattggaaattggggggtggaataattgggcattttgccacgcacgaagagacgcaacatccacanagcttcct

SEQ ID NO: 717730 - DNA, 344 bp, Homo sapiens
  misc_feature (144)..(144): n is a, c, g, or t
ccggggggttttttccccccctttcccgggtccccccttaggtttgggggggggggttccaattttttttcttccccaaatttggggcctttttggggccaagggtttttttcccttcctttttgggggcccgggcccccacanaaggggtggggcccccggtaaggccccccggggaattttttggggaacccttttggggttttttttaccctttttggaggggctttggggggttttttttggtttttttgggctcccctttttttttttgggggcccccccggggtttcccccccccccctggggccccgggggttttttgggttcttttgcccctggga

SEQ ID NO: 717731 - DNA, 812 bp, Homo sapiens
gccacaccattttgtgtcccccacagtgagagatcggggagaccacatttggtgtggggacacccgctaggcccccgcttgtcagcaccgccccgcgccctttcggggggggaaatccccccctcggcgggggacacacccctcgttttgccacccaccctgcggccccctcctccagaagttgtggcccccaaccccccgtcgcacagaatctcttcttttttctgggggttacccccttctctctaggcgccctctctcttttagatacgccgcgcgagagagtgttccccccccccccctcctatctcatcatctcatcggagagtctctctctcgcgcgcgagcggcgtctcatcttatcttctctcttctcgtgtcgtccccccgttttttttcctcccccgcgcgggtttctcgcccccccccgccccgctcttttctctccccccacacagctgtcttttttttgtgagtccacatcaccaccccccccactggggggggcttctctggcttcatcttttcgggccccttctctcctcctcagcgggccaccccctctgaccccccgcttgttgtggcaccaagcttccttagtgttctcttcctgccccccccactggtcttccttgccgcgagagaaatttcccgcggtctcttcttttttttcgtgagggggtatctctcttacgagggttgttgtcccgcggggtccgcggacgattatcccaaagggggggcgccccccccccccttggggaaacccccctcctttaaaaaaaaggggccaccccccccgcccccccaca

SEQ ID NO: 717732 - DNA, 462 bp, Homo sapiens
accggctccactggttgctgagccaggtcttgaaatctgagcttgtgatccgccagtctcggcctcccacagtgctgaaatttcaggcatgagcactgcacctggcctaaaaatacaaaaattgactgggcatggtggtgaacacctgtaatcccagctacttgagtctgaggcatgaaaattgctttgactgatgaggcagagattgcactaagtcaagatcttgccactgtactccagcatgggttacagagtaagactctgtctcaaaggaaaaaaaaaaaggctggacaccgctggtgggtcacacctgtaaccccagcacttggggaggtcaaggcgggcggatcatgaggtcaggagttcgagaccagccgggccaacatggtgaaaccctgtctctactaaaaataccacaattagccaggtgtggctactggggattacacacctgtaatccca

SEQ ID NO: 717733 - DNA, 283 bp, Homo sapiens
agaccactctctactttcactaacaaccactccgtactgtaggtactacagttagtcttcctttgttgccttctctttagactactcgtctcttcatgtccctgaaatatcttgtttttttttttccccagagaaaggaaccctggcttttcctttcacactttgcaaagcgagaattccaccactttttaacaacctcaaatactacaatcctactcgaactccttaaaaaaacagaaaagaggggaacacttccttcaccttctgccatgattgaaagttc

SEQ ID NO: 717734 - DNA, 88 bp, Homo sapiens
ggtcactcttatgaatggatgttggttatacttttaatggacattaacattcctaataaagtattagtttcttaattcaaaaaaaaaa

SEQ ID NO: 717735 - DNA, 144 bp, Homo sapiens
  misc_feature (124)..(124): n is a, c, g, or t
  misc_feature (129)..(129): n is a, c, g, or t
cactggcctccaaatgccccaagtgcgacaagaccgtgtacttcgcatgacgggaagccgttctgccacaagccgtgctacgccacccctgtttggaacccaaaggcgtttaacatcgggggcncgggnctcctacatctacga

SEQ ID NO: 717736 - DNA, 256 bp, Homo sapiens
gtatacaggaagagactgtgctgtccaaggacactagagcccaggccctccagacacattctatttctcactgtacattagtaacatgggagctcatatgtacatcagctttaagagccaatttaacaatgagtctagttctacggcagggagccactctgagtgtagtcaaatcaggatttatagcccctcaggttaaaggttacacaccagacgctagggcagcagtcccccgggtcggcaccagggaaagaca

SEQ ID NO: 717737 - DNA, 292 bp, Homo sapiens
cccttctcaggatggtctagagtcaaaggcagacatctccgcatcctctcctagccaaggggacaaacagatactacctgaatccatcatcaatgtcatacctcgctgatagtcgaactcttcaagattggcctcgattacatcatcgaccgctaggtagtcagctatacttaacagcaaacagcaccggatgccagcaactccccatccttgactagggattcaacggtggcacaggcaacagcaatgtactctcactggctggcagcatatgaaagcggttgcacacctc

SEQ ID NO: 717738 - DNA, 770 bp, Homo sapiens
agagagcgtttactctaggagagagccagtcgctgagctgtctatgttttttagagtgccccacatcatgcactatcgacacgatatgttggcagacagatggctatgccagaatcacagcctatggcaaggcaaagcaggattatcttcagcacttattacataaagactgggctgtccatcatgatgaaaccggatctcctactagatatgtgatgctatagcacggctcaaggatgctctgcatttcaatgccattggaggcatgtatatctagacttggacaggcttatgtatacggccgcaactcgggctcactaggacacatgatgctataaggcttcagatttcatttaatgggccctggtgttacaaactactgactgctttatccctggtgtgacacaacttaattgatttatcacttatccgccttggacaggtttgctgatatcagaagccgcccggacccttggatgctatcaatgatggtaacatcctgaaagcaaatgtgtactggctgctgaaactctattgtcaaaaagcaggcctaatacctgaacaataacgtgatttttcaaccaatatgctataatactgaaaatgcgctatacatgaaactacttacacgcatcgggggaaagggggttctcgccttggacctgagacacttcaaaaatcttgggcgcaaaagcaaaggtttaaaaactgtttttggttaagggccaataagggaacgtaacattaatagttttatgggccccggcccc

SEQ ID NO: 717739 - DNA, 1101 bp, Homo sapiens
  misc_feature (1101)..(1101): n is a, c, g, or t
ggatgacacagcggaatcctctctgatgcatgatcgtccttccagaagtgggtgtagtattataaatcgtgttaggagctgcacatgacatccatctctgattctcatgagtatactcatcccgttttggaatctacaaggtggacccatgctcaacattggtgacgccatgatacgatgacttcttaaggacaagcttgccaatctttgccgatgttatagaaagtttatgcttcgctctcattgtcacaacgaccaaactttatagggtaccgcttatgtacgaacccatgagaatatccatcgtatcgtagccaagtagctgaacgatacaggagctgcgttcagagctcttgactctcggttggcctaggcatactaatcagcgtactcgtggtaaatgctgtggcgtcacgattctgacgattcagaagaaaaattgatggtccgctatccaagggcaacaatgtctcacatatactttgctacaccatcgtgggtctaatggatgagtccagagaagggacatatttccccaacgtgtaccctaatacttgacaatcgtcgcatcagagcgagcgctgcaccaaactatgggtggaaatcaccaatctgtaagttaaacaataacagaaagctttaaccatgcccttgagtggctgtaaacgcctgtaacatcgcagctgaattggggaggcttgaagcgcaggacgaattagcgatgaaaccggcagtgaggaggttgccagtgagcaaacgaaacccatgcggaacccaaacctgggaaacagcgagaccaacgcacaaacccggacgcgtctccgaaccggacatccaggcgaattgcagcagaacctcgagcggcaaagcacacgcgggcacaggaggaagtaaagagtgaaacgccaagcaacaatccccgcgcccacagcgcgatccccacccaccagggcagtgtcaacaaccaacgcacccagaacgagtcaacacaaccacagaacgcgccggcaagacaccacacggagcagagaaaagcgaacacgcaccaagcacacacacccagcgaaccaagaagcacgccgacacacagcgccacgcgcn

SEQ ID NO: 717740 - DNA, 296 bp, Homo sapiens
ccctcccaaacctgcttgggaggccaaaaaggccaaaaaaaccgaaaaccccttctgttgtgggcaacctgggtttgcaggcctgcaaaggctggggaatcctcaggaccttaggaccttcatccaagggctgggcttcgggtcttcaggaatgggccttggctggtgctggtgccatggactctgcccagaaccttcttgtttatgaacagctccagctacctgggcaattgtggtggggtggatgggaaggcccaaagcccaagggatccataataaaaaatgcttggccagca

SEQ ID NO: 717741 - DNA, 138 bp, Homo sapiens
actacgacggactcccacgtgccattgtgggactaacatatggcggtggacttcacgggacggacgtacgggggacggcttcgtggcagttaagctatcccacggacacactacgcttgacaacacggctctacaacg

SEQ ID NO: 717742 - DNA, 366 bp, Homo sapiens
cgtcgacacagtttgtgaggtgtgtccccagtgagatgggaagcaagactggcaagggcctctctaagtttggagtggtatgcagatttttttttaaagagtatcacaatccacagaaaacatatttactaggattactcaaaattacttaatctatccagcacatattgagaattcaccctccagtccttggacttctccaaggtagaagctttaatgaccagtacagtagagtgtgcttggatgcttgatgctggagttgtgaaatatgtcatgagaagagagagaggggagggtgcccagtctgcagatacaaatatacagtgagaaggtgagagggatgcttgctgggttgttcgtcgacgc

SEQ ID NO: 717743 - DNA, 191 bp, Homo sapiens
aagagtgagttccaggcccatgcacgggcagggcaggtccgcacacgacttgattcatatctccgtactctgtcatgagatcagcacacaggcaactgagccagccattaatgtccaaatcacacagcatccataaggctgcacagcaatcagcaccctttgctggcccatcaccacaattattcgtcaag

SEQ ID NO: 717744 - DNA, 158 bp, Homo sapiens
taccagagggtcgtgtaacagatgctactgagaccaacatcaccagacgctggagaaccaagactgatacgatcactggctaccaagattgatgccgttccagccaatggccagaatccaatccagagaaccatcaagccagatgtcagaagctaaaa

SEQ ID NO: 717745 - DNA, 252 bp, Homo sapiens
cgcctgctgagatggtggcgcccccctcgcttgttatgcaccgcacgttcgtgcgggaacctggtgctcctccattctgtagtgagcacgcatacgcctgtatatgtcacatgcactcgccggggtctgcgtgcttacttacgtgcccatggcccatttctgacagccccaccaccttcactgaggcggctccgaagctccgttccctgctgctccttacagacagtgggaggcagatatacacaaacgcct

SEQ ID NO: 717746 - DNA, 370 bp, Homo sapiens
  misc_feature (128)..(128): n is a, c, g, or t
  misc_feature (230)..(230): n is a, c, g, or t
  misc_feature (236)..(236): n is a, c, g, or t
  misc_feature (323)..(323): n is a, c, g, or t
  misc_feature (340)..(340): n is a, c, g, or t
aggaagcagcaaccagtttttgaaaaaaatatcccaacagggagttttcagttagcccaattcgtctggcacatttctcaagctcaaaagagggtatagccgttggttcttatgattcaggggctgtngcagcttatgggttcctcccagccctatattccagattctgtgagccgctcccaccaagccaaaggatcatggacgtcttttaacatatctgtgcccattanccaganctcgggacacaatgggccacaccccagtgtgcagcaaggcatcccttatatatgatcttgattttaagtttcagtatctgaacttcnggtaattagtaactttntagctgggaaagtatagcatgaaaccagag

SEQ ID NO: 717747 - DNA, 590 bp, Homo sapiens
gaagtgtggtggatgtgttttcatgcccgttctgaaccccttgggaacatctgtcctatctgcccagatcttcaagtaacgtctgagccatcttcctcctgctcttcctcctccctcagttctgattcatagtttttcccggcagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcgactctgaggcctccctgctctcagccgactcctccagccaggcttttataggagaggaggtcctggaagtgaagacagagtcgctgtccccttcaggatgcctcctgtgggatgtcccagccccctcacttggagctgtccagatcagcatgggcccatcccttgatggctcctcaggcaaagccctgcccacccggaagccgccactgaagcccaaacctgtagtgctaccactgtccaattgcatcca

SEQ ID NO: 717748 - DNA, 432 bp, Homo sapiens
aaaatgatgatgaaagaattaaagaaagacatggcgcaaaatcaagaaaacaatgtacaaacaatgtaaatatcaataaagagatagtaaacctaaaaagaagccagaaagaaattccataaataaaaagtacaaaactgaaatgaaaaattcactagagggattcataagccgatctatgcaggcggaagaaagaatacacgtctgaagaccggacaattgaaactgttaagtccgacgaacagaaagaaaaaagactgaataaaagtcaacagggcctggaggacatgtgggaaacctatcagtggaccaacatatgcactacaggggccccatatgtagaaaaagaaaaagaggctgaaagatttttgaaaaaataatggttgaaaaatccccaattttgatgaaaaacatgattgtaaatctccaaga

SEQ ID NO: 717749 - DNA, 360 bp, Homo sapiens
ctagtggtttgggaccccccggaggggatttggggtgggccccggccctgggccggggttccaacaagtgggcgcccccccaagggtttggtccccttaagggggcccattttcccccccccccccaaaaccttttggggtttttcccagggcccgggggttctggccgcccaaacggggttttcctttttttttgggggcccggtaggtttggccccaaccccgggtttttgggttggccccggtttttttaagggggccctttggttccccccgggacccccgccctttggtttggttttaaaccccccccgggggaaggtttttcccttttttccattaaaggccggccctttttta

SEQ ID NO: 717750 - DNA, 267 bp, Homo sapiens
agctgtgattacaggagcatgccaccacgccccgcctagcttttgctagagatgatatttcaccatgatgttcaggctgctcttgaactctgtgcatcaagttatccatccgcatatggcctcccaaagcgcggggattacaggcatgagccacttgacctgttcaactttataagtgacatgtaaacaagctaaaagcgtttagtggcgacgtgtcgaagctgtctctagccgattcctttatgaatggcttaattcaggtgccaa

SEQ ID NO: 717751 - DNA, 203 bp, Homo sapiens
ccatgataaaggagaggccaagaaaaggtagcaaagacctattcttgtccttctgcaggcccctggacgactccaggtacctctgcgggcctagtcttgacccctcacgaggccacgtgtcttgcttctttcaaagcggaagctcccaggggatctgtgagctggcttctcgtctttctcgtcacgttgttagaacggcactg

SEQ ID NO: 717752 - DNA, 406 bp, Homo sapiens
ttgcagaggcagaaaagcaaaacctcagcaaaacaaagaactccatccctttaatgtcttctcattaaacatcatggattttacccacacaacagacaggaaaaggcagtctttcatccaaaataccgaggaatgccagctacatacagagcagaaaccctcttcacgtgacacacacttagccttccagaacgcagtggcccggtgtcagcagctcctgctgcacctgccaacctcgacggtccccaggcacagcgacccaccgcgggtagagaaacgtcagggagctgcccacacgggtgtctgtgcagatgctcagaacacagcctgcacagtctcagggggcgctcaatgccaccagccagtaaaacaaatccatacttcaactatgttatcaaccctttcg

SEQ ID NO: 717753 - DNA, 1737 bp, Homo sapiens
  misc_feature (1512)..(1512): n is a, c, g, or t
gaagtgactcattactacagatgatgatgaccattgcaagttcccgtcacttagtgaagacgatcttacagggcatggaagagcgaggcagtgaatgcagcacttgcagtgaagatgacacggtgagtgggctcagcagtcccttctgtagcaagctgcacacgagcctaggacaggacgcgatgatagctgtgagcgaaaaccaatgcaggaggcagcgcaggcggcgaagacgtgaggaggcccgggaggaaggtagagcagtcctactctttgagcatatcgacgacagctactgaactcatcaattgggagatcggtccaagccattaggtgattagatatgatgctaggctatgcgatagttgttcgaaggagcctggaaattgaccattgcctggatgagtggagcccagtccgctattggaacctaaagcaggaacgcaagttgcgggtggcaaaagaagcaaacgactacacgttcaaaagtggaaaatcaccagtggactggagtgctaaggggtgtacccttgcacagtgcggctcgacagatctgtgccccgcgctaccaataccaaactgagaaaacctgacgggaaatagaagggaagcaaatcatcaaccgtgcgtgccggggtgggaaacattggaacataccgtgatttccttcccatgttgtgaacgcgtatgtggatccaaccccgccctggggttgggcatccgttaatgcgaggaacaatagattggggataccccctttccgctaattggtttcgaagagcccctatagtatggccgcaacaacagccccaagagctatatattatcccttgtgcgaaggatacgaagaggtttcccacagcggccttggttggtagttccatatgggattgggcaatatggagaatccagatggaacattggcgtgggggcttttccatcagaggaaaaggattatcccgattcttggccggtaggcaaccaaattgtgggggcttacgtgttaacgtctccgcttggaacgcagtggccaaggcgctcgcacaacaggcacaagcaaacaaggtttgtgccaaaggggactcaagattgtgcgacacactaacatacacctatttgctaaaagggggacatgcaacattctgtcgtgacgcgcggatcacactgtgacagcttccggacaacgggacatggtccttatggtgcgacaacgttagcaaactctttcgtgctgtacatctgcacatgcggggcaaacgctacgaccgagcaggatgtgggacaccgacaccaatccacagagagcaaaatccacacactgcgaacgggaggcataccacaaagccacgacaaacgagcatgccagacggcacagaacacgactcgctagaagcacattaaggcgcatacaaagataaaaactaggaaatgagaaagacccccgtcgaagagtcacgaacagagtaacagggcaagaacagtgatagtacactacaggaggaagcactggangaaaacgaacactccaaggagacgaaccaccgtgagcacgcgacgtcaccacaaaggagatacgaaaaacggaacacagcaaccagagcggcgccccacacgagagacacactagcggagacagagttagcgtaacaccagccaaagacacaaaggagaggcacaaccgcaacgagaccacaagtggacgcccacaagcgtcgacgcactgaggagcaccaagag

SEQ ID NO: 717754 - DNA, 111 bp, Homo sapiens
gcagtgtgcctgaccgagtactgggcggctcccactccatgaggtatttccacacctccgtgtacctggccctggccgcggggtagacccgcttcatctcagtggtgctac

SEQ ID NO: 717755 - DNA, 1304 bp, Homo sapiens
  misc_feature (212)..(212): n is a, c, g, or t
  misc_feature (239)..(239): n is a, c, g, or t
  misc_feature (491)..(491): n is a, c, g, or t
  misc_feature (520)..(520): n is a, c, g, or t
  misc_feature (709)..(709): n is a, c, g, or t
  misc_feature (1291)..(1291): n is a, c, g, or t
  misc_feature (1298)..(1298): n is a, c, g, or t
cccgcccacgtcatggcgcctgaggagaacgcgggtaccaaactcttgctgcagagtttcgagcgccgcttcctagcggcgcgcacactgcgctccttcccctggcaggtgggcggcggggcgagcggagaggcctgcggggcttgcggaagtccagggcagacgggatgggtctccctgctgaaacccccggcgctcctgccacgtgagtncctgggctctcccggtcaggccacganacccggtccccgtccctggggcctggccagagtcgctctcacccctcctgccccgcgagctggcggcggaagctgggggcgtctccacagtcttggggggcagacgcgcgctcgtgtgtggggtacagttcacgatcattttcatgactttttaaaggcagtaatcgttctggtcactgggacacagctgccctcgcccattctaaaaagtcagcaccctcaggcccgcgggtaaccacctcctcctgagcncggtgaccaggtcaaaggctgtccctcgngcctcagtgttctcatctgtatgtcgagcactgcacagaatcagctcatgcgctgaggctttcactcctgtgatggaagagacagagaagggggtggcctctcctctccctggggacctgccattctcagcacaggcgcatggcaggcagcagcctcccttctgccagcagaggggcttaatgcacccngctccatttgtaattcatgtgcggtgagctcactgggatgagtcagtttggatatatattcctccctgggtctgccccattttatggggtgttgcttaatcatttgcgttattccattgacataaaatatttagcactcagagatcatttctggtcaggagaaatttgtgcatttttaacccaaaatagaaaccttcataaaagcatcataggtctccattcaatattgactataattgttcacatgcccacgctgaatgctaacttgggctcaccctcaacacccacgaggtgggtactattattatcactcacatttgaccagagggattgtttgattagggtgaagtagttgagagttcagacccaggagacagcctgcctgcttcgaatcctggcccaacccctggccctgtgtgaccttgggcaagtgactgcatctctctgtgctattgttttcttattaataaaatgggggatataatgatacctacctcttagggttgttgtcagcgttgagtacaaaagcctgtgggatcagtggcctggctcatggggaaatgcatgtcggtttttagccantgttttntatttc

SEQ ID NO: 717756 - DNA, 475 bp, Homo sapiens
  misc_feature (3)..(3): n is a, c, g, or t
  misc_feature (9)..(9): n is a, c, g, or t
  misc_feature (34)..(34): n is a, c, g, or t
  misc_feature (41)..(41): n is a, c, g, or t
  misc_feature (71)..(71): n is a, c, g, or t
  misc_feature (254)..(254): n is a, c, g, or t
  misc_feature (430)..(430): n is a, c, g, or t
aangaaggngcttttttagttaatggccaacctncggattnattggatgtcaaaggtcaggtgcacttaantattcttccaccggtaagtatggatttactggttttatatatctgggtgttgtacttaacagtgttccagaattctgtccctcttacccacatgcatcaaaaatcaccacgggatagttgttaaaaatgttaacgttggccgggcacagcggctcaagtctataatcctagcactttgggagncaaggcagtcaggagctggagaccagcctggccaacatagtgaaatcccatctctactgaaaatacaaaaattagccaggcgtggtggtgcatcctgtggccccagctactcaggaagctgaggcaggagaatcgcctgaacccaagaggcagaggttgcagtgagacgagattgngccactgcactccagcctgggtgacagagcgagaactcatctcaa

SEQ ID NO: 717757 - DNA, 374 bp, Homo sapiens
gaggcagacagagtttcaccatgttgtccaggctggtctctgactcctgacctctggtgatctacccatcttgtcctcctcatgtgtctggtattactggcataagccaccgcgcccagcctgattacttttagtatacagcattctaagcatgatccatgacagaaataattgattggccagacttcattaaaattaataaactgctttgcgacatatactgtctagagaatgaaaagtcacaaactaggaacaaatatttgcaaaagacacatttgataacggactgttaatccaaatatatcaagaactcttaaaactcaagaataggagaacactttcccactcgagaaggtgtggcaggtgcctggcac

SEQ ID NO: 717758 - DNA, 575 bp, Homo sapiens
agatctattcagcaggttaatggataaactgtggaacatccagaaagcttaaacattcttcaaagaaatagaaaacacaatcctaaaatttatatgggacccacaaaagacttagaatagtcagctatcctgagcaaaaggaatcaacctggaggactcatattacctgacttccaattattcaacagagctaaagtaaccaaaacagcatgatactggcataacaacagacacataggaacagtatagacaacccagaaacaaattcatacatctatggtgaccactttggacaaaggaatgaagaacatacacgggggaaacgataatgtctttaaataaatggtagtgggaaaacctggatattccatatgcagaagaatgaacagtagaccccccaatcttctttagcatataacaaattcagaattaattaacaggttaaatctaagacctcaaactatgaaacagttaaaagaaaacattcggggaatctctccaggacattggagtgggccaaagatttcttgtgtaaatacctgaaaaaaaggcaaccaaagcaaaggtgcacaatg

SEQ ID NO: 717759 - DNA, 337 bp, Homo sapiens
gccgctttatctgggggtgtcggggcgtgcatccaatgcagtctttccgggggaaggtttcagcctgtggtctggcgattggttttctgatcctcccaggtgtctctgttccttttggtggctgttattttacaccttcctctggattaatggaatattttggtgactcctttttattttctttctcaaggtggtttgggctatttaggatccttggagattttatataattttacaatgatgtttttttatctgcaaaaaatgccattagggtttggatagtgatggcattgaagatgtagatggcttggggtagtacagatattttaacagtctt

SEQ ID NO: 717760 - DNA, 169 bp, Homo sapiens
ccccccccctttttttggccccccccccttttttcctttggggggttggggaatttttggccccccccagtgggttttttgggggggccaggccccccccccctttttggttgggggggggggggggccccccggtttaagggggcccttttttccccttggggcccca

SEQ ID NO: 717761 - DNA, 157 bp, Homo sapiens
gcattgggagtctgaccaggtaggacttgaatgattcggctaccactagttcagaaggtgcagacaagaggtggcgagagcccgcatcatgcccctcaacctatcccgttccttctgcctacaaagtaaaaagtgcaggctggaactgatctcagct

SEQ ID NO: 717762 - DNA, 436 bp, Homo sapiens
  misc_feature (49)..(49): n is a, c, g, or t
  misc_feature (320)..(320): n is a, c, g, or t
  misc_feature (369)..(369): n is a, c, g, or t
cacatggtgcagcaggactatttccccaaggcccttgcacccctgctgntggcgtcttgaccaagcccaacagcgcgctcgaatcctcctctttcgccctccacagtctgctgcagacgctgtacaaggtctagactcaaaccctctcccatccttttgtcttggaccagtgagctggggagggactcggatgaactggagcgcagcctacgccattgccttggacaggactttcgccacaggcagggcgggtctgtgtcccatgtgtcctgtcactcccctgagtatgtgtgtgggtgtggcgcatgtgcaggtctgtncctctgtcgggatttgggttttaacgtcttctgctgcccagccctgctntgttgtggggagttggccccaggggaaagggctgtgagcctgccgccattaaactcacctccacctg

SEQ ID NO: 717763 - DNA, 439 bp, Homo sapiens
cctctgcaagggtgtgccaggagcaagggcacgagctacaactagcagccggacatgtacatcacttcttctaccctaaaggtagggccacagtgccatctgcttttcctaaggcctctgttccatcagcaattaggtggcagccaatcaagctgtgggaagctggccatccccacttccttgtgtggctgaggtgactggttgctttttgagccagcttggccttggccggcatgcccaagcttcagtgcaacaactgtgctacaaatggagccatatagaaacgagcagcaggctcaggagcagggtgtgcactgcctttggggctccagtccatgcctcaggcatcatatgtcactgcgggcttcttggtagccacgaggcagatcacaggtcctcttgaggaggactttacgttcaggtgtagaaagcagccagg

SEQ ID NO: 717764 - DNA, 475 bp, Homo sapiens
ctagaggtctcggtcgagatgacgtgaaatagaaaaagaagctagatgatccatggtcacccctctcatatcctcaagtcaactacccaccctatcagagaaggacaggctgactacatagactggccgccgctgctgacaagaaagaaacacctacttggagacagtcttcaagatctcggccaagaaaacaaaagccggggcccaacttgtaagtcacgtggaacaagagctgtattgtgttcatggaacccaagctctccagacagtcaaaaaaaaaaaaaatggcctggcaggtgtgtccagttagtctacacattttttccatacttctttttttttcccgttccggggaaaggggggtcttggaatatgtggcccggggggggtcctgaaagccggggccacaccactccctccattctcgtcccccccaaggtgtgcggcacaacgggcataaccaacggcaccgggc

SEQ ID NO: 717765 - DNA, 856 bp, Homo sapiens
ggcggccgcgcgggtcggttccgggcggttgggagcgcgcgagctagcgagcgagaggcagccggcccgcgcgcccctgtctgtatgccgtctctcccgggcggcgccgcgatcacagcagaggagccacgcgccgggtggatgtggttgggcggggttgaggaggccgccaagatgccgagtccaagtccggaagatcgcgatcctgggcataccggtctgtggggaaatcctcatgtgagattcattgtgttgacggccattgtgtggactcctacgatcaaccatagaaaacatttttacaaagtgtgatcacggtatctggacaagattatcatctccaattttgtagacacagcgggcacgatgattattctatctttcctcagaatatccatagatataatggctatatctgggtgtatctgtacatcaatcaaaagtttggaagtgattaacgttatccatggcaaatgtgtgggatatgggtggggaaagtacaattacctattatgtgggttgggaataagaaagactgatatggaaggggtgatcaagttctgaagaaggaaagctttgagaatctgtgaatgcagtttggggatcttctgtaagaaatcagatggtggggtgttttcgaaggatattggggggcgaaaaatggcgggacgttcaccaggagtttcatgccgggaggatttgtgaagcgtgggacgggataatttacgggaggcagggccggcctgaaaaaagtctttttccggaccgacaatggggagcgcccctatatttatgtgtgcagagtcctctatgccactattatttttttacaaacgctgggggggacaactctcat

SEQ ID NO: 717766 - DNA, 852 bp, Homo sapiens
  misc_feature (580)..(580): n is a, c, g, or t
  misc_feature (586)..(586): n is a, c, g, or t
  misc_feature (621)..(621): n is a, c, g, or t
  misc_feature (635)..(635): n is a, c, g, or t
  misc_feature (647)..(647): n is a, c, g, or t
gtgggcgaaagccctgccacaacgacgcgcatctccttcccgcggagatcatccacaggcgtcgctgaaagctcccaactagtgcggacccatcgaccactgcgagttggctcaggtgcctccgttgttacgggatgggggctatgcaaccgagttcaccgtgaatgcagccctccacggagttggcactcctgtcaccccgacgaggggacacaaggtgctgactgcagctaagtcaatcttcggaagctcatggtctcagcccaacactctaccttgaaggctcagagcgtgcagacttcctggcggaataccgaggcgtcagtctgtcgtgcgcctgcatcacgatcgcttctcgtgagcgtttacccatgatgcgatggacccgagatatggagtgagatctcttcatcacagctgaccacagccgatgtctcgattgcatggaagggctcccatgtgaggcccacatcttggcgcaagcttgaggaagatcgtgtgtccgttgcccccgaattcaccatctagaccaaggctgcaagtggccctccattcgtgtgtgtatttagggggtctgggnaggggnaggggcagagcttggaccttggtactcctcagctnagggtggtgacaanccccttccattngtcagcactttccagcctgccaattgcttcccctctgtgatctcatttcatctgcactgccatacgtggagtgagcaagacagggcttaccatcctgtctaccagatgaggaaatggcagttctgagaagtcactggtctagatcccgcaggtggcacatgacagctagggttcaaaacgttcatcaccaaatccaatgctccta

SEQ ID NO: 717767 - DNA, 392 bp, Homo sapiens
ccacggacaggtgtgtagaagctgctgggctgaaacttgggctgaacttccgctgcaggctgacttattcccatcagcaccaaagccgctggagggggtcatccactagcaaatgaagtgggggcacggattggaggctgtttcagaaggtcccactgagccacggactcaaggcctggccacagccctcccaagcgaggcccagatcatatttcaccacgctcagaaaaccttgccagctcatttcagtccacagtgactttgctttctttaggatctctcttgcactgtccaactcagagaatttcaaatcttgatggattccaatgatggagctaaatcaggcctcacctcagttttttaattacaatcaatagggctgcgtcccagca

SEQ ID NO: 717768 - DNA, 85 bp, Homo sapiens
tttctggatggatttgtatcctatattgtagctgtaattgtataaatgtaccatctgatgtcattaaaaaaagtgttgtagtgct

SEQ ID NO: 717769 - DNA, 478 bp, Homo sapiens
ctatacatcctttaaatcccgggcagagagccctcgcgggggtgaaatctcctgccctcactccccagaagagctaaccagtcctccctcgggactaacctccctttggagcacattctaatacctgcccatgggccagcgttcccttttccacagcaaatccttaaaggaagcgttcacgatgaagggctggcccatagaaaatgctacccaaatatttgttgcattaaaccgacaaaagttgacagcccttttgagaaccctgggagggggttctttcaatcctaagttttttagtaaacaggtgctctgacaatattcactcatcttaacgtttccatttcctttgatccaagttggggccacccctctttctttaacagatgtattagcctgttctaacgctgttaataaagacatacccaagactgggtaatttataacggaaagagttttaatggactcacaattccacatg

SEQ ID NO: 717770 - DNA, 1582 bp, Homo sapiens; identical to SEQ ID NO: 697926

SEQ ID NO: 717771 - DNA, 1582 bp, Homo sapiens; identical to SEQ ID NO: 697926

SEQ ID NO: 717772 - DNA, 200 bp, Homo sapiens
gcacccacagatacctataatgattatacacacctctgtatatacctcataacacctccctcactactatctaaagactacagagtacactacaaccccaagctccatagtctaggcctatcaggactattacataatactcagctctagcatgaccttctccaatagctgtacataagataacggacatacttaaggcc

SEQ ID NO: 717773 - DNA, 101 bp, Homo sapiens
gccgcgcctagcttttgattaaataataatagaagcaatcctttcacctaaccttccgaacaacaatttgtaatcaagaatttctttaggtagaaccttgg

SEQ ID NO: 717774 - DNA, 1949 bp, Homo sapiens
  misc_feature (1588)..(1588): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctagcagttgtggtcatcggagctgtggtcgctactgtgatgtgtaggaggaagagctcaggtggaaaaggagggagctgctctcaggctgcgtccagcaacagtgcccagggctctgatgtgtctctcacagcttgaaaagcctgagacagctgtcttgtgagggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccagaaaaaaaanaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggcccctttggccaaaaggattttaaaattgggaaagtttaaaaatggggcccaaattgggggcaatttggcaaaattcccctaaaggggggcgtttaaaaaataaaggggcggggtttaaaaaaggtggaatgggaaaaaaccgggggttcccaaaataaaaccctttggaaaaaaacccctttttgcaaaggggggaaaaagcaaaaaggccccaaccgaaggccttttaaa

SEQ ID NO: 717775 - DNA, 201 bp, Homo sapiens
  misc_feature (12)..(12): n is a, c, g, or t
  misc_feature (42)..(42): n is a, c, g, or t
taacactttaancatctctccaagccaaggaggctatgacantgtagcttttatactgtccccatcggccacaataacaaacttttaaccctcataaaatgaatgaaatcatctttctaagaatctatacctacaattctctgaactaatcaatgaaaaagatgatcaattctgactaacaaagatatatcgattccattt

SEQ ID NO: 717776 - DNA, 1582 bp, Homo sapiens
  misc_feature (968)..(968): n is a, c, g, or t
  misc_feature (973)..(973): n is a, c, g, or t
  misc_feature (981)..(982): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttnccagnccaccatnnccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717777 - DNA, 488 bp, Homo sapiens
  misc_feature (49)..(49): n is a, c, g, or t
tttaaaatgaactgttacttagagaattactgtaatcggagcggaacgnttaacgctttttcaccccggcacaaagcacgccccttctgccttcctttcccagtcattcttcaggcgtgcgggaaaccgcggacaagcagagcacggggaccagcacgatcctcctgccaccactccagtctctgcaggtgccagcatagaagaaaaccacggtctcgcctccctctccgccactgcggtgcggtcccggggtggagccacggcgcgccccatcctgagaaccccacctggaggggagcagggacgcaggaagggcaccgttgggaggcatcactgggttcgctgaaggcacaatcgcgcgcgcacacacatacacagacacacatacacacacgcacgcacacacacacacacacacacagcgtcggtggcgcgggcgctggcgcgttacctgttctgccagccctggaggaggttggtgtatttgc

SEQ ID NO: 717778 - DNA, 1582 bp, Homo sapiens
  misc_feature (976)..(976): n is a, c, g, or t
  misc_feature (979)..(979): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccnccntccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717779 - DNA, 300 bp, Homo sapiens
cgcacttccccctcccctcacccgccgcggacttgacgccccttttcgatgggttacgcgcaggagcggccgttagagactatcgaccgacagcggaaacgcctggtcgagacgctgcacgcggactcgcaactgctgttggacgcgctgctgacgcggtacgtgctcaccgggccagagtacgaggcattggatgcactgcctgatgccgagcgcacagcgcgccagactactggtgctggtgcagctcacgggcaaagcctgcctggccgagctgctacactgtgcccagagcaccgc

SEQ ID NO: 717780 - DNA, 1399 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgtgtctctcacagcttgaaaagcctgagacagctgtcttgtgagggactgagatgcaggatttcttcacacctctcctttgtgacttcaagagcctctggcatctctttctgcaaaggcatctgaatgtgtctgcgttcctgttagcataatgtgaggaggtggagagacagcccacctttgtggcaattgggacccctggttccaacgccaatttggtttttccttccccaaatttttttttttcacaaagaggggcggtg

SEQ ID NO: 717781 - DNA, 457 bp, Homo sapiens
cctcggtaccaccaacattggctcgacccaccgggactcagtgtcgacgagagtaccgtcgaaatcccacaagacagcggcgaaaaaacggtcggcggtcgctgtgtgcgtctcacgtggcattgaaatagtttgcctccgggtgatggacgacgaaggcgtcggtggactggccaggatgaagctggaactcctctgacagttgtacaccgaatcctcgtcggatcgagtagtttcaccaccttgacgcgatcttcgaggttcggacaggtggcgtaaccgaaactgtaccggcagccacgagaggtttggtgatcgatggcgccaatgccaagggattcaccgtcaaggcggcaccggtttccgaccccatgagcatggtcccagtaagcgtcgtggactccggaaatgacgtcgagccaatgttgctggtggatactcaggaacagctatgaca

SEQ ID NO: 717782 - DNA, 1609 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccagtcttcccagccctctatccccatcgtgggcatcgttgctggcctggctgtcctggctgtcctagctgtcctaggagctgtggtggctgttgtgtatgtgttaggtaggtagtagctctagggctattttcttcaaacaggtggataaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717783 - DNA, 430 bp, Homo sapiens
  misc_feature (414)..(414): n is a, c, g, or t
cctcggtaccaccaacattggctcgacccaccgggactcagtgtcgacgagagtaccgtcgaaatcccacaagacagcggcgaaaaaacggtcggcggtcgctgtgtgcgtctcacgtggcattgaaatagtttgcctccgggtgatggacgacgaaggcgtcggtggactggccaggatgaagctggaactcctctgacagttgtacaccgaatcctcgtcggatcgagtagtttcaccaccttgacgcgatcttcgaggttcggacaggtggcgtaaccgaaactgtaccggcagccacgagaggtttggtgatcgatggcgccaatgccaagggattcaccgtcaaggcggcaccggtttccgaccccatgagcatggtcccagtaagcgtcgtggactccggaaatactnagccagtgtgtcgcag

SEQ ID NO: 717784 - DNA, 915 bp, Homo sapiens
tagagttggcgcgagtcattcaagaaaggaggctcgagcgatcagaactctgcatgggaaagttggagaaagatgaacatgcttccgatgattagacatgtaccaatacgctgtgtgtgcttccacagaggccgagtgagatcacgtgactggaagcatatccgatcggtattgtggacaagcaggtggcataagaagaactgtagaagatgagatgacaaagctcctccaacgatgggcagaatagtccacgtgtatgaaatctttacaagtgtcataacgagagtcgaggtgctttcatacacttcgcaagtggagcaacgcacttattagagcaaataacgaaaaacgattgttcatttcacaggcagtttggatagagacccgacgcttaaatctgagaaatcgatatagccactctaatgaccgattggatgcagtattcccagggaagctccttcggtgtgtagatgaacctaaagcagccaaaggacgtcctcgtagctccaaaacaagccaatgttcaggatttccagttctttcctccagcgtatattgtgaagttactggaaaaagaaattctgctttgacagaagaagacttttgggtacaaggtaccctcgaaaatgctgaggctgtctatatgcagcacaggccaacgtgtgactgtaacctggttacaacttgatgacgtctgaatccttagttgatcaacagttacagctagaagagaagcttctacagaggcattaccattggacctcacagaattacccagtacatcaagctaaggaagtgggccggaatacatgaagttccagcaaagcatgccaatcacaaaggtatgaatccgggttgacgtgagaccagacaaaacaattgcactcacgaggggtcaagaaacaaccgcaaacc

SEQ ID NO: 717785 - DNA, 1580 bp, Homo sapiens
  misc_feature (968)..(968): n is a, c, g, or t
  misc_feature (973)..(973): n is a, c, g, or t
  misc_feature (981)..(982): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttnccagnccaccatnnccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717786 - DNA, 328 bp, Homo sapiens
cctcggtaccaccaacattggctcgacccaccgggactcagtgtcgacgagagtaccgtcgaaatcccacaagacagcggcgaaaaaacggtcggcggtcgctgtgtgcgtctcacgtggcattgaaatagtttgcctccgggtgatggacgacgaaggcgtcggtggactggccaggatgaagctggaactcctctgacagttgtacaccgaatcctcgtcggattgatgattataaccatcttccacgcgatatccgtggttccaatagctaccgtgtacgacgacggcccagggacacacgagaaggccggctaattcggactca

SEQ ID NO: 717787 - DNA, 1586 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccaaagccgtcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717788 - DNA, 192 bp, Homo sapiens
tcgacttctgctctcacctcatcagctttgaccagtgtggccaaagtggtcagggtggctctgcctctgctgtagttttgcccctggccagtgattgctacaggttgtgattggccggagttgtggccatggcggttgtgcccatggtgctcagtgccatgggcttcacatgcggcggggaatcggcctcgt

SEQ ID NO: 717789 - DNA, 1653 bp, Homo sapiens
  misc_feature (1079)..(1079): n is a, c, g, or t
  misc_feature (1082)..(1082): n is a, c, g, or t
  misc_feature (1084)..(1087): n is a, c, g, or t
  misc_feature (1090)..(1091): n is a, c, g, or t
  misc_feature (1093)..(1094): n is a, c, g, or t
  misc_feature (1108)..(1108): n is a, c, g, or t
  misc_feature (1112)..(1112): n is a, c, g, or t
  misc_feature (1211)..(1211): n is a, c, g, or t
  misc_feature (1550)..(1553): n is a, c, g, or t
  misc_feature (1558)..(1558): n is a, c, g, or t
  misc_feature (1561)..(1561): n is a, c, g, or t
  misc_feature (1564)..(1564): n is a, c, g, or t
  misc_feature (1567)..(1567): n is a, c, g, or t
  misc_feature (1569)..(1569): n is a, c, g, or t
  misc_feature (1572)..(1575): n is a, c, g, or t
  misc_feature (1578)..(1578): n is a, c, g, or t
  misc_feature (1581)..(1581): n is a, c, g, or t
  misc_feature (1587)..(1587): n is a, c, g, or t
  misc_feature (1593)..(1593): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctttctctttggagctgtgatcactggagctgtggtcgctgctgtgatgtggacggaggaagtangtntnnnnttnntnnatatggatgggagntacnctcaggctgcaagcagtgacagtgcccagggctctgatatgtctctcacagcttgtaaagtgtgagacagctgccttgtgtgggactgagaggcaaganttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattctctgccatgagaggttgatgagttaattaaaggagaannnncctanaanttnagngncannnnaantgnaacacntgaaanaacacactatattacgggggccagaacgcttcccccccccctgggcgcacggtaaccccc

SEQ ID NO: 717790 - DNA, 800 bp, Homo sapiens
  misc_feature (453)..(453): n is a, c, g, or t
  misc_feature (547)..(547): n is a, c, g, or t
  misc_feature (704)..(704): n is a, c, g, or t
  misc_feature (709)..(709): n is a, c, g, or t
  misc_feature (711)..(711): n is a, c, g, or t
ggcttctttcccgagcttggaacttcgttatccgcgatgcgtttcctggcagctacattcctgctcctggcgctcagcaccgctgcccaggccgaaccggtgcagttcaaggactgcggttctgtggatggagttataaaggaagtgaatgtgagcccatgccccacaccaaccctgccagctgagcaaaggacagtccttacagcgtcaatgtccaccttcaccagcaatattcagtctaaaagcagcaaggcccgtggctgcatggcgatcctgatggggcgtcccagttccctttcccattcctgagcctgatggttgtaacgcggtggaattaactgccctatccaaaaaagacaagacctatagctacctgaataaaactaccagtgacaacagcgaataatccctctataacaactggtggtgggacgtggcaacttcaggatgacncaaaagccaaagtctcttctgctggggaaatcccagtacagatcgttcctcatctctaagtgcctcattgagctccggtgcatctggccaatgnagctctgctgagactcttgacagcgacctccagctctgctgcttcaacaacagtgacttgctctccaatggtatccagtgattcgtcgaagaggaggtgctctgtagcagaaactgagctccgggtggctggttctcagtggttgtctcatgtctcntttcngnctaggtggtttcttcatgcagcacttggttgcgatgttccttttttaccccttctttggccctttcccctggatttctgggttttacct

SEQ ID NO: 717791 - DNA, 178 bp, Homo sapiens
gcgcaagtaggtctacaagacgctacttcccctatcatagaagagcttatcaccttcatgatcagcctcataatccattttcctatctgcttcctagtcctgtatgcccttttcctaacatacaacaaacttactatacttacacctcagaggttcaggaattagaaccgtcttgact

SEQ ID NO: 717792 - DNA, 182 bp, Homo sapiens
caggatccttggaatcgtggtgctgctacaaagggattctttgaaggtttgggtccagcagaacctagggtctgcctgttaggctgtagtgattactttgggtaggtggttttatattgataattgttgtgatgaaatttgatggcccctatagatagaggagacacctagctagggtgtaa

SEQ ID NO: 717793 - DNA, 880 bp, Homo sapiens
tgttttgttaattttttataaagtgagggagtaggattttaattaaggcattacatcctcaagagttatcaccaacccctcagtataaaaaattttcaagttatattcagcatatacactggggtggtgctatcatttacaactcaggtgcctcaacagtggattacaggtgaagacacacaccaagggttccccctaagtggtgatgtgcatatgtgtcattttaacccagcttctcagaatcttacacactttttcagagggctttgtgcacacgtgcaacactatgtggcagtgcacagaggtggttccataaggtctccacaccttcacgtgcacacttcacgaggggtgcttggagtattccagaaagtgtttattgtgggtagaacatattacaaatttacacacctgtgtggtgcaacaaaaataagggtggcaatctatacacgtgtgcgctcttacactcacacccaaataccactgtgcaacagtgggtatacggggtccccacacacgggggcgctacacactacaggcactatatagggagggtggtccccacctctctacagagtttcccctataaaaaaagatagtgcactccaccattatttgtgggtataacgtctcaccgaagacactgatatttacaatcaacagtgtggggagttggccacccagccggggttaaaactttccagggttgtgggcgtgctactttcagacccaaaaaaatagtgtgtccgcttttatttacccagagaacaaaggggcctatattttcccaaaaaacaataatatttagcggatagctataaggatagggtatcttttatccttgggggagggtttaaaagaacagatttaccaccccaac

SEQ ID NO: 717794 - DNA, 202 bp, Homo sapiens
cagacacatacgcacacacgtgcacacatgtacacacggatacacacacacacacacacacacactgcatatctgagcgcgcccctcgcactgggtctcgccttgcaccttcttcaggattttatatgtgaagagatttttatatagatttttttcctttttttcggaggccctttattcttataaaaaacccaccccaagg

SEQ ID NO: 717795 - DNA, 176 bp, Homo sapiens
tggtatcctgctacacaacacacacacacacacacacacacacacaaaccctccccgccgcaccctctgttcacttgctatctccaccctgtataccccaaacaatgtggtgttgtaagtaagatttcataatcacataaactagcaaagatccctaagaggaaagtgtagaaagt

SEQ ID NO: 717796 - DNA, 163 bp, Homo sapiens
gaagcgtgtactgggagatggtcatattcaccgtgcaaaatctgctggaatcctttgctggtctccttcagcgagtaccagcttacccatatgacctgtgaagcactcagcaacctggaatggctgagacaatgaaatgctgtattttcctgtgcacggtgac

SEQ ID NO: 717797 - DNA, 114 bp, Homo sapiens
cctgacggggttactacttgactaactgtgtgactgacaatgactggccctaagactagacggacgacacctgctacggtgtaacggacgacacgactggttacggtctaccgg

SEQ ID NO: 717798 - DNA, 135 bp, Homo sapiens
gtcaggcaggcagatcatctaggtcgggagacgagaccactgatcacatggtgaaaaccgtgtctactacaaaattagcaggcgtggtgggcctgcctgtaaatccagctactccagaaagggtgaggggggaga

SEQ ID NO: 717799 - DNA, 618 bp, Homo sapiens
tttactagaatggaatgataggcgtcataaacacgtcatatgccactatagagtgtgcacagacaccttcaataaagtgacattcatttgagatgttacaatacagttatgcatgtgcttaataccacaggatgttaaggggtaagccatccaggatctccatgggaaagttggagcccagatatatttaggatttttcacttagaacacaagacaataaactgttgatttttacaaatggtatataaatccagagattaaacatgtacattattataataacaacaacttgctaaaaaacaacaattttcaaactaaatggaagcagatccctctgctgtatcctgaagtccatgatcatctcctttgtatggttgacattgagtgtgaggttattttcctgacaccacactccgagggccctcatctcctccctgtaggccgtctcgtcgaagttggtaatcagggctaccactgtagtgccgtctgcaaacttgatgattgagttggaagcgtggatggccacgcagtcaggggttaacaggcagtacaggagagggctagaaacgcacccttgtggggccccagtgttgaagatcagcagggtggcccgtcaga

SEQ ID NO: 717800 - DNA, 133 bp, Homo sapiens
cgcacgcggtgaagccgaagcgggttatccactggtgatcaatcacgccttgccgcattacctcactctgctggatcaggggttagatcctgaactggcattgctcgataccttgctcctactgatggcgatc

SEQ ID NO: 717801 - DNA, 1369 bp, Homo sapiens
taatgtgcaaaatggaaggattttattgtggtgaataccagtttaaaaaaccattattttacattctgctagcccacccaggaaacctgagttcagatacgtgctgattcacattatttcatttggaacttaatgtggaggatggtttctgacggcactttccaccagtaatcagcaagtgatttggaatttagataggttcccctttaaactctcgtggtatgtgaatctcccattactacagttagggaaatagttctctctcacgtggacactagacatattgacagaaagcttgacaaacttcctccagttcatccctccacaatcttttgtggcgtgtcttcacactcgtgacctatcccttcacattcattcgcgtgggaaattcattcctcatatctattcacaacatttcgttatctcccgggtggaatcttctctcgaagggcaagagatatgtgtcgtgctctgtgtgttcccccggtgaaaaagacaattatgtggaccagagcccccagtttatacgccccaaagtctcccattttcgtggctccttatttgaaacagtgcgtatatttcaatgtctataccagaaatataacggtctacaaaacattactacacataggggcattctccggagaaaaccctcttaaaatattgctggcgtctttccctttgaccatttccattaaacactaaacatgtgtcaacactaccttagtcgcgtgtgttggtttctctgggtgaaaaacccacgccccattttttaacatcttacacaaagcatcttctggtatattatgcgcccatcgggttcctttaaaggctcccatcatacattactaccccactggtacacgtctccccgtgggaaaacttttacttattaaacgcgacaaggtctatacatcttcttcattcggcaacactttcaacttgcccagacaaacagggttccaaatacaacattttgtgggcacaaaaaacgccccacgcaagatttataaccaaatgccccaagataatgtgacgcccaaaacatttcaattcttgcacccctttctatcgttgaactaactcatctcacctcgggaacattgttcaacaattccaaggaaggcataagtgggaaaaacaaagtgggccacacgtatacaaggacgccccatagggggaataaagaaccaaaacatgtaaacagggggtgaatacgccccccctcacagaacaaaccgacgagacagcaagaccaggccaccacaacggtggagctcccacaagcaagacacgcaccagaaacacacgcccacacgcacacatatacgcaacgaacgcgtcaaaaatcagacaataacgcacagga

SEQ ID NO: 717802 - DNA, 446 bp, Homo sapiens
ggtcggggctctgaggctccggcctgacctctccaccggctcgacagcaacgtctcaggatgccactagtcacaaaaggccgaccaggaggaggaaaccacaggcggagtccggggcaagcagcaccgcatcccagcctcaggactgcccgagggtgttggcgagagtctctgcaaaagtcgtgccgccgtgatctcgaggacaggtcggcctgcgtgttcctgggctgctctctcagacgagggtggttctcgtggagagcagaacctctttgctcctctggtaggcatttgaaaacgtgttttgggtcaggcataggcccccaaccaaacgggtcccaggtgttctttgattttccttggcattgagggaaaggtcactcgttccccccttccactggagcatgcctggacaccactgttttttcgccgtcgccccatatgcct

SEQ ID NO: 717803 - DNA, 119 bp, Homo sapiens
ttccacagcaagacttcaagacaaagtccacatgtgcacccgaggaccacctagaacatgctttctagtcacacctctttccacctccttatgaattctcatggctatccctagtgcca

SEQ ID NO: 717804 - DNA, 919 bp, Homo sapiens
tgttacgctgagtgatggccaagtttatttactctggacaggaatgtaaatgtcttactggaacatgacaagtttcagcttgatactcatcttctatatattaaaccacaaaaatgcacaatataacaagacaaacttatgataccagtactatagtacatatgtagatcaggtgttctccgtctcagtactacaatacaacattacttacacatgcacaccctaggacccatcccacagacaaagtccactagctaccattatcagtaaaagagtcgagagtctcaaattactgctccataggtatggcagtgcacacccctagtagtaccataggacgaacaggtataatcacagactctagatccacagtagtttgtctctagaagacaaacacagatacctcgtgaaagcttcaccaatagaatgaatgtgacctaaccgtacaaacatcaacatggctcccaggaccagacaacacaagaattacaacaccctgtgactaccaccaagaacattgttgacgcccatcaagacacgggatataactcggcgtacaacgttacagagaacttctgccaacctccggagagaggtaggcacacgaaactcgtatccaccacaagagagaccaccaaatgatccctttttcaccacaagatcctgtatctaaaccgccgcttagcgcccacgcaggtacttacaccagggaacagtaggatgcacatttataaaccaccaacaagagtaactgttatcaccgcaacccctggggttatccttaatgaaccacacgtgtatagtattcaagggacaactcaacacgtcaggggatactacaaagcactgtgtacgcgcttagaacccaaacttatataccctataccgttggcccacgcgacacccacgacgcactctg

SEQ ID NO: 717805 - DNA, 698 bp, Homo sapiens
  misc_feature (310)..(310): n is a, c, g, or t
gcaatttttaattctcggttaatatcaacagcaaaagcctagtgcatatgggagatgtgcaacctccctgaaaatcttctctgtatctggagtacttcaggggtgagcctctggccccagagcctttgccacagtgctcccaccagcccccacctcataccgtctgtattgcagagcactcatctacaggtccccactgctgccattcttatactacacttctgcgacttgggccagtcttatgattactttgcgctataagtcctaccattcgggcaggaaagtacacgtgttgcacaagaagtgctgntgattcacttcgagccccttccactcagaggccacaccagcgatgcagtgaaggggcacagctctcttcagttctcctgactgtgatctcactggggtagaattcccctgagagaattccctcactcacggtccctttgccagagtcagttcatcaggtctgatgtgagcaatttacacacttgtctcagaaagtccctcagggtatgtagaggactgcagggtggcatcgtgcgactcagctttactgcgcatcctgcagtgggggtgagcggcacaggctgagaactgctcttgggtgtggcccggtgtcacgtgcagtctccgacgagagaatagaaatatactcaatagggaaacaatataacaataactcaaaaatctactga

SEQ ID NO: 717806 - DNA, 361 bp, Homo sapiens
ctttgggtgccggggctgcgggttttgggtgcaacctctccggcacccgactgcattaaccaaagttttcccctaatggtatcatcccccagtgcccaatcatttatttatgttttgccaggggccagggctcggggtgggggagggcttgttttatttacatacaacccagcatgctaatggggtacccccttgacttcatttgtacttagttatgttggtcagtgttaaaggatccattttgggttcatctttcttgagtggagtattggttttaagtaaaaaaagttaaatgatcccttaatttgctaattggttgcctatgaaatcccattttttgttattaaagctttttccccta

SEQ ID NO: 717807 - DNA, 166 bp, Homo sapiens
aatcatagaatcccaggagaatgtggcagagatgaagatgggttttaggtccaggatagctagagtagtggcgtaagaatcgagtaagtcacaagcactctcaggaaggttgaggcggcagagatgcaagatcgcagcacttataccacgcgggcaacggaacctc

SEQ ID NO: 717808 - DNA, 207 bp, Homo sapiens
tggccaaagcgatacccaaatgctgaaatactagtgaggggtcgggtgtggtgacgcttgcctgaaatcccagcactttggaggccaaggcggacggatcacttaaggccagcatggtgaaagccatccctactaaaaatataaaaattagcagggcgtggaggtgcatgcctgtagtcccagttacttgggtactacgctttggca

SEQ ID NO: 717809 - DNA, 252 bp, Homo sapiens
gtctcctcagcctcttgagtagtagtcccccaactcatccttttggttcattctcctatatacgttttcatttaaaagatatacatttattcattcattcagggagtatgggagtgtctggtcatataccaggcacagtttcaagggttggaggtgtagcagtgaataaaatagttttctctctgtagttaaggttctagtagaggaaagcagataaatgaataaatctgaagaaaaatagcaggtgaaggg

SEQ ID NO: 717810 - DNA, 1215 bp, Homo sapiens
gcaacctcgtggacagcaatctgcagaagaagagagcttcaaaatggagccaactatgtaagcgaacatgcacgatgaagtaaaatgagaggggcctccgtcaggaaagaagacagctggtcctacaggagaagaatcgttgaaccagcttctccctaggagagatggggtggtcgctctgcagagaaccccgcttcaggatccggtgaggaagaccatgaaagaacaagctagaacgactcctgagaaaacggatggatggctggcagtaccagcgaagcacctcagagcccctcggaagaagagggcccgtggcagatcctcactgttgaagagtgaggatggcgatttaagaagtagaatggaggttaatagtgaagattccatgagggagtgaaagacctatggtcttgatggcaggacatgggactatagttaccaggctagaagcatgctgtctgcacacgtccctgtccaggacataatgtgcgatgcaattcgtggaggagctatgcaaatggccagacaatcgcagggaaatgtggataatcaggagatatgcggttaatgcagtgggcaggcgagagcagatagaacagaaatactgacaatgtgaactgataggagcactcagcttgagctagaaatataggagagcgcccagcatggctgacagtccatcgggggctcaccccggatgcatccaaatggtcaccaggttgatgtgaagccaccgacacgtactggccatttacgtggcaagaaattgaaagcaaaagatgtggcatataagccccgttgaatggaaaaagacatggacctaatatgacggcgaattgccatgcaatactaaacaactggaaaaaacaatgaacaacacaaacggcaatgagtgacgaacagggatccaagagaaacaacgagaacagtatagtgacgggaaacaaaacacaaaatatacgggggtacgagtccccatgaatgcacaaagcaacggaggaacagggcagctaacacacaacagaaaacaggagaaagacgcaggaggccacaacagatgaaaagagtaggagcaatagcacacaaacaaagcgacagagaaagaagacaacagtagatccagagacagcaggagacgcaaaaacaaaagagaggacgagctagcgagcaaaggaggggacacgagcgcttcacgagagtagttagatccgaaac

SEQ ID NO: 717811 - DNA, 274 bp, Homo sapiens
aattttttttcccccttttggggtccccccccccggggtctaaaggggaaaaaaaaatggggccccaataaagggcccaatttttttttcccccggcccccggttaaaggggggggccccgggggtttaaaaattttttttgggggggttcccccccccccccaagggtttaggggggggttccccccaggggggttttttggggggccccccctttgggttcctttttttttttttgggggataaaaaacccccgtttttttgggggccccga

SEQ ID NO: 717812 - DNA, 178 bp, Homo sapiens
ccgggtaatttttgtattgagcggagacggggtttcacgtgtgttagccaggatgatctctatctcctgacctcggtgatccggcgggcgtggccttccaaagtgctgggattacaggcatgagccacccggtgcccggccgagaaggaaacactaactcattctatgaggacagcat

SEQ ID NO: 717813 - DNA, 263 bp, Homo sapiens
  misc_feature (11)..(11): n is a, c, g, or t
accaacttgtnattaatttttttaatggtaaagggaaatatgtactttttctcacttaatttttctttatttattccccactaaagaaacggtttcctaaggtctgagctgtttcccagggtgggctagagtgggtgggcaggagctgccgacattttgtgtactatacctaaccctcctcgccttctccgtttgcctcaccacccggctccagggccctgaggggagttgtattaaataaaattgatttttactcttcagta

SEQ ID NO: 717814 - DNA, 525 bp, Homo sapiens
ttgagtagaataacagaggaaggggtgaagcacttgtctcatccccagtctggaacttgaaacttcttttctcttcactttgccctaccccacaaataatatgtacaaagtgtctgtatccattgagcactacctccctattccttccacctccccagcccctggcaaccactgttctacgttctgtctctacgaatttgacttctctaggtccctcatacaagtggaaaagtacagcatgtctttttgtgaccggcttatttcacttagcataatgtcctcaaggttcatccatgctgtagcatgtgtcagaattgccttcttgcttgaggctgctgatacctcctcatgtgtatataccgtattttgtttaatcactcatctgttggtggacacttgggttgcctccacctcttggctgttgcaaataacgctgtgaacatggatatacagatatctgaggccaggccaggcgttcacacctgtaatcccaatacgttgggaggccgaggcgggcagatcatc

SEQ ID NO: 717815 - DNA, 116 bp, Homo sapiens
ataccgatttctctctgtggggggtcacatagaggattcagaagtgcaggacatggagaggcagatggagcccagaagcacagatgtacacccaggatgagcatccgcaagacaga

SEQ ID NO: 717816 - DNA, 167 bp, Homo sapiens
ggggcccccccctgggcccccccccccccccggtttgggccccctttttttgggggggtttttgtgggaaaattttgggcccccctttgggttttccctgggggggggggttggttcccctttttcccgggttttttttggcgggttttttaaaaggggggttttta

SEQ ID NO: 717817 - DNA, 1063 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccaaagattgtgaagttgtggatcttgagatgggaagattaccctggtgggcctgatgtaatcacaatggtccttataagaag

SEQ ID NO: 717818 - DNA, 159 bp, Homo sapiens
gggtcgatctagaggtcccagcgggaacaatcacttgaggtagattcaagacaagccggggtaacacagtgagaccccacctctaccaaaaaaatttaaaaattaggcaggcatggtagcatgtgtctgtagtcctagctgctggggaggctgaggtgg

SEQ ID NO: 717819 - DNA, 150 bp, Homo sapiens
  misc_feature (21)..(21): n is a, c, g, or t
cttacgactagcccgacaggnctagcgaggggttatggaacaattatggcctgtgccacaagcggcagtgccaaccatattttagcaaaagctaggagtagcttctatgctaaaacacatcaacccccaacactgtcgggctagtcgggg

SEQ ID NO: 717820 - DNA, 1440 bp, Homo sapiens
  misc_feature (977)..(977): n is a, c, g, or t
  misc_feature (980)..(980): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccaagaagtgggcagctgtggtggtgccttctggagaagagcagagatacacgtgccatgtgcagcacgaggggctgccggagcccctcaccctgagatgggagccatcttcccagcccnccntccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttcccaagacagcccacccccctgtccacaggggacctctagatcaccacagcaacactcc

SEQ ID NO: 717821 - DNA, 242 bp, Homo sapiens
ccctctcttgtgttgtgtgtgtgtgtgtgcgagactctctctctctcccccaccccctctctctctctctcccccccccccccccccccccctctctcacactagcgcactctctctctctccccctctcgcgctctctctatctagagtgtgtccccccccgcgcgcgagagagagagagagagagagagagagagagagagagagagagagagagagagagagagagagagcggcccgag

SEQ ID NO: 717822 - DNA, 1570 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgccatctctgaccatgaggtcaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717823 - DNA, 1522 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggggaggaccagacccaggacacggagctcgtggagaccaggcctgcaggggatggaaccttagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggagtctctcatcgcttgtaaagcctgagacagctgcctgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717824 - DNA, 1575 bp, Homo sapiens
  misc_feature (1133)..(1133): n is a, c, g, or t
  misc_feature (1472)..(1475): n is a, c, g, or t
  misc_feature (1480)..(1480): n is a, c, g, or t
  misc_feature (1483)..(1483): n is a, c, g, or t
  misc_feature (1486)..(1486): n is a, c, g, or t
  misc_feature (1489)..(1489): n is a, c, g, or t
  misc_feature (1491)..(1491): n is a, c, g, or t
  misc_feature (1494)..(1497): n is a, c, g, or t
  misc_feature (1500)..(1500): n is a, c, g, or t
  misc_feature (1503)..(1503): n is a, c, g, or t
  misc_feature (1509)..(1509): n is a, c, g, or t
  misc_feature (1515)..(1515): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtgacccaccaccccgtctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtctgcccaagcccctcaccctgagatgggagccagtcttcccagccacacaatcccaatcgtgggcatcattgctggcctagttctctttggagctgtgatcactggagctgtggtcgctgctgtgatgtggacggaggaagtatgtctctcacagcttgtaaagtgtgagacagctgccttgtgtgggactgagaggcaaganttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattctctgccatgagaggttgatgagttaattaaaggagaannnncctanaanttnagngncannnnaantgnaacacntgaaanaacacactatattacgggggccagaacgcttcccccccccctgggcgcacggtaaccccc

SEQ ID NO: 717825 - DNA, 1317 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggaccccccaaagacacacgtcttcccagcccaccatccccatcgtgggcatcgttgctggcctggctgtcctagcagttgtggtcatcggagctgtggtcgctactgtgatgtgtaggaggaagagctcaggtggaaaaggagggagctgctctcaggctgcgtccagcaacagtgcccagggctctgatgtgtctctcacagcttgaaaagcctgagacagctgtcttgtgagggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717826 - DNA, 182 bp, Homo sapiens
cagaaaaattatcatttatttatttatttattatttagagacagggtcttgctctgtcacccaggctggagtgcaggggcacagtcatagctcattgcagcccccaactcctgagctcaagtgatcctcttgcctcagcaagtagccaggactataggcatgttccaacaccatgcccagtg

SEQ ID NO: 717827 - DNA, 224 bp, Homo sapiens
  misc_feature (21)..(21): n is a, c, g, or t
ggggatttgggttttttaaanttggggggggcccctttccccccaccccccttttgggggaaactttcccttgccggttgcccccctttgccccggggaaccaaaaaaaaggccctttcctttttttttttttaccgtggcccccccccccaaagttaggtttttattttttggctggtggaaattttttattttcttttccccaaaaaaatttttttggggga

SEQ ID NO: 717828 - DNA, 1593 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggacccccaaagacacatgtgacccaacacctgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717829 - DNA, 1704 bp, Homo sapiens
  misc_feature (240)..(240): n is a, c, g, or t
  misc_feature (877)..(877): n is a, c, g, or t
  misc_feature (879)..(879): n is a, c, g, or t
tctgccgtggctggccccctataatcgcccggcggtgttttctttttttgtgttggcgccgccgtctttccaaggagtgtgggccgccgctgctctggcgtggcctcaccaccgtcgtgccttgtcgtggtggggaacacccaacgaaggtgggggggcgtccttctgcccccccgttgtcgtgggccccccctccgctcgttccccccccccggaaggtgtgtgggccccccccgcctnatatatggtgccctccaggcgtccccttttttctcctcgctggcggcgtcgttacaacaccctcttttgttgcgaccacaattccccctttttgttttccgtcggggggtcccatcttcttctcgggagaggggctcctttctatattgggcgccccaccgcccccacaagggtgggggtcccccccggtctccccctccttcgtggggggggccttttgcgctggcccccaacatgattgtcacccgcacgtgtctcctattttgtcatctccggggggcgtgtttcttcctcggcggctctaccacaatacttgttgtgttcccggcgttcctcaccccgccccaagacgaccctccgagagggtttccctttggtggtccccccctcctcctgggggaaccccctcttgtgtgatgataagaccccccccgccacgacccaccaaaggggggccccccacataatttagggggtccttcttcccccgacaaaattaggggggggacgcccgggcccgccttggttttcgtcttgtggggagcaccaccaaccacggcggggggttccctaatattcttatcgcccaagatcctccaagggggccgccgtagacctccccgtgggtgttcccccngncggttcttgccccgacgaaaccccgcggagggtgtgtcgcacaacagttggcgccccttggcgggccccgacaacactcctcgctctcacacggcgtctcctcgcggctttcgcaggggggtgacaccgcctcggttatgctcggtgcacgcggaatcacgcgggtggctccctcatccacggggtgatcatatttgccgcacacgctcgtgtgtttctcccccacaatttgggggcccaaatctcccccacggagtgcctttgcggcggccccccttgtctcgtgtgggtcttttctctgtgtgtaggcccgcccctcccgcgtctgcgtctgtgtgcgcctgtgagaaattgcgcccgcgcttttataacaaaggggagatcttccccgctgtggacatctctctgcgcccggtccttcttgtgttctcataaacagccccacataatattttatattgttaatatgtgggtgtgacgcgatctgtgatatgctttgctggacacctacacaatattttgtgggttcttacacaccacaatatacaccgcgcgtcccgcggagatggagaccaactcccgcgttcgtgtccagatagcctacatccccaatagttacccagaacggatgcacccaaaggggggaaccctcttatatttttccaccagattaaatagcaccagattgttagaattgataacacccacattgtgccatgggaagggggaacacccccagctttatttacctgctaaagatggaatttccggaaggccttgtgtgcaacccttgcgccataaattaaccccttttccccgggccca

SEQ ID NO: 717830 - DNA, 1595 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcacggacgcccccaaaacgcatatgactcaccaccctgacccaccaccccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717831 - DNA, 116 bp, Homo sapiens
tcgctcggtaccaggctatttcacaaaagttaccaactgtttctctttctagaatgaagcaatgaagttaagaaattccttgaattagctgcctggtgtgtcttgtctgggagctt

SEQ ID NO: 717832 - DNA, 1582 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggacccccaaagacacatgtgacccaacaccccatctctgaccatgaggtcaccctgaggtgctgggccctgggcttctaccctgcggagatcacactgacctggcagcgggatggcgaggaccaaactcaggacaccgagcttgtggagaccagaccagcaggagatagaaccttccaagaagtgggcagctgtggtggtgccttctggagaagagcagagatacacgtgccatgtgcagcacgaggggctgccggagcccctcaccctgagatgggagccatcttcccagcccaccatccccatcgtgggcatcgttgctggcctggctgtcctggctgtcctagctgtcctaggagctgtggtggctgttgtgatgtgtaggaggaagagctcaggtggaaaaggagggagctgctctcaggctgcgtccagcaacagtgcccagggctctgatgagtctctcatcgcttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717833 - DNA, 1464 bp, Homo sapiens
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcgcggacccccaaagacacatgtgacccaacacctgacccaccaccccgtctctgaccatgaggccaccctgaggtgctgggccctgggcttctaccctgcggagatcacactgacctggcagcgggatggcgaggaccaaactcaggacaccgagcttgtggagaccagaccagcaggagatagaaccttccagtgggcatcgttgctggcctggctgtcctagcagttgtggtcatcggagctgtggtcgctactgtgatgtgtaggaggaagagctcaggtggaaaaggagggagctgctctcaggctgcgtccagcaacagtgcccagggctctgatgtgtctctcacagcttgaaaagcctgagacagctgtcttgtgagggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaacttcatggtgcactgagctgcaacttcttacttccctaatgaagttaagaacctgaatataaatttgttttctcaaatatttgctatgaagggttgatggattaattaaataagtcaattcctggaagttgagagagcaaataaagacctgagaaccttccaga

SEQ ID NO: 717834 - DNA, 673 bp, Homo sapiens
aaataagcagccttgttgctcacacaaaacctgttggtggtctcttcacagcaacgcgaatgaaatttggtgccatcactcggatcaggggacctcccttgggagatcaatcccctgtcctcctgctcttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgacccccaatcctgcctaacagagaacaatcccctttgactgtatttcccactacctacccaaatcctataaaagggcccacccctatctccattcactgactcttttggactcagcccaactgcaccaggtgaaatacacagcttgtgctcacaaaa

SEQ ID NO: 717835 - DNA, 368 bp, Homo sapiens
tcgatcacaggagtcgagacagccaggccatatggtgaaaccccatctctactgaaaatacaaaaaaattagctgggcgtgatggtgcatgcccgtgatcccggctactctggaggctgaggcaggagtatggcttgaacttgggagggggaggttgcagtgagccgagagttacgccactgcactccagcctgggcgacacagcaagactgtcccaaaaaaaaaaaaaaaaaaaaaagggaattttgggggaatttttggaaattttgtgtttttatctccttgaatgtggggtggaattggtattttaagggttaacttaaaattttgttttcaaggggtgtgtcataggggttataggatattta

SEQ ID NO: 717836 - DNA, 623 bp, Homo sapiens
  misc_feature (99)..(99): n is a, c, g, or t
atgccgccgccgtgccgccttccgatggctgcgtcctgggaagcccggttccccgagcgctccggcctggcccggtgccccggactgagtgcgtccccnatggatgtgctgccctgggctgtgcccaggctggccgctgtgcggtgagagcgactccctgcaaggtgtggcggagggagacccccggacgggccgcccggggcttctgccccaagcccttgaggcgcatgtcggccgggagcccggccttgttgtacagccctgcacggactttggacaacgctggccaccggtggggcaactgggagaccagtaccgggggcgaggtgcaccctaggttgacaacggaagaaagaacatgccaaggcatttttctttcggccccttccaaagcggtgcatgaatgcaatttccccggagcgggtcaattccggggccttaaaaacggccatgagagcaaaacaactggttaccaaccagagtggagggacacggtcttggtcccctggaaaggggaactcgtcaaggcgcagaccccgggtttcccttcaattcaaggggccgtgggtcccttgggaaccgttgggcaatttgaccggaaggcacggctttccctcataaag

SEQ ID NO: 717837 - DNA, 599 bp, Homo sapiens
caatacggcaggtacaggcggtgttactcggacaggggagcactggacctatgcctgcacatggtgtggcatcactcagcccctacccctgcctgctctaagggtagaaaactccaggtcccctgccaccgactgcccagccactccaagccccctggcagctcgcccctcctgcgagcagaaagtgcctttatctcagccatccgcagacttgcttggccatgatgcggggacaggctcggaattgagggaggctgtcttcatctccctgccatccccctctcacgccacccccgccccactgggctgaggtgctgctgatgcgctgggatctgattgaggatcacaagtgaatcgagagatgacccctacccccatcatccacccagtcttttgaaaccggtctaagcaaacctgacttctcgtgttggacggagctgacgtggacggcgagccatggacacgtgccacgaaggacacggttgagcgggcggcggcacgctgtggtgccgtggcctctgggcttggtcacgacgttggcgttgagctcgccctgtggcgccttgaccttgcccaccgtgatccagggaacgtgtgtg

SEQ ID NO: 717838 - DNA, 288 bp, Homo sapiens
gcctctttcagagagggtttctggatccagattaagccacaattgagaaggatcaatgcatatagctcttcagaccatagaatcacagatgagagcagaaactaagaagcatccatctctatttctctctgcctctgtgtaaatatctccgaaagaggaacatcaatcatgggctctgaagcttactagagataagaatatctacctcatttgctctagtgactttgttcttggtggatccaggttgtgtggaacctgaagttttcacaattatggggttctttttta

SEQ ID NO: 717839 - DNA, 113 bp, Homo sapiens
tctcagcaaggtagaagggaggtgcatggggtaatcagtgctttggaaggcgaatttccttgctgtgaaataggcttgggttactgggtcaggacaaccattcagactgacag

SEQ ID NO: 717840 - DNA, 272 bp, Homo sapiens
gaatcgaatggcatcgaatggaatggaatggaatgcaatgcaatggaatgtattagaatgtaatgaactttaatggaatgtactcgaatggattcgacaggaatggaatgttctgaaagtgaatgaactccaatggaatggattgaaaaggaatgaaatcgtacaaaatggaatctaatggaatggaattaaatgaaaatgaatgaaatcgaatagtacagaatagaatgaaatgcaagcaaaaggaaaggaatggattggaatggaatgaa

SEQ ID NO: 717841 - DNA, 153 bp, Homo sapiens
gaacgggtatgcggttgagggataggaggagaatgggggataggtgtatgaacatgagtgatgtttactcgatgtgaatgcagggttttcatgttgttcacatgtggttgggtgcagtgcagcccgcattgttgttgttggtcaaatatgtag

SEQ ID NO: 717842 - DNA, 264 bp, Homo sapiens
gagagaacccaccatggagctgtctcctgccgacaagaccaacgtcaaggccgcctggggtaaggtaggcgcgcacaatggcgagtatggtcgcagaggccctggaaaggatgctcctgtccttccccaccatgtgagacctactccacacacttcgacctgagccacgcctctgccaggttaagggccacggcaagaaggtgcccgacgcgctgaccaacgccgtgcgcacgtggacgacatgcccaacgcgctgtccccctg

SEQ ID NO: 717843 - DNA, 257 bp, Homo sapiens
attaggtctcgcagagtaggcccaggctagtctccaagctcctggactcaagtggtccttcctacctaggcctccaaaagtgcttggataacaggcgtaacccactgcccctggcctaaatttcccttttttttttttctttggaaatggatttccacccctgtggtccgggcgggagttgcaagtgttcagctcctcagcctcagtaacaacctctccaccttctcggggttcaggcaattctgccctcagctttt

SEQ ID NO: 717844 - DNA, 233 bp, Homo sapiens
ttattagaggatgcttagaagattgtttcggtaattgttagtgtagacaggtgtggtggtggttgttctgtgagtcttggcctcttgttagctatcagggcatgaaagtaactccatgggttagtgaaagtgttatccagttaggtccaaaggacacagcagcagtgttttgcccctgtcatttctcacttatggacagtgtagggtcttctgtagaagaatgactcttgaac

SEQ ID NO: 717845 - DNA, 653 bp, Homo sapiens
ccgaagaagagacgggataaaagaggtgccgctaccagaaacagcccctcttcttgttcccggaaggtgggggctctaacctggggcacagggaccagtaaaatgaagtcagaatgtctccagagagaagtcgtttcttttaaagtgtgacaagagtcccatacccgcagccattaagatctgtttggggctcagtggttagttcaagttccacggttacccacacttagtatcacaagactgctggttaagtctgtcaagaacttttcagtctttagtactgtgtaaaaacattgatgaaggctctgatacttgcactagtccacgccaatagagcctgtaaagcctaacgcgggtaattttgtttaatcagatccagattttgtaggaatctcatcttcccaaatgtcccgcaagtgtctagagtatagaaatcttcgcattcgaatcagaatatgttgatcacagcctgtgtccaggtccgcacagatgtcactgcggtggggcaagccttgacactagaaatcactttagcccaggcacagtggctcacacctgtaatcccagcacttcaggatctaaaggtagaacaatctcttgaacccaggagtttgagactagcctgatcaacatagctaaaccctagccccatt

SEQ ID NO: 717846 - DNA, 450 bp, Homo sapiens
gggggggggggggggggcggcgggggggggggggggggggggcgggggggggggggcggggggagagggggggagggcagcggcgggggggagagagggggggggtgtggggagaggaggaggtggagggtcagggtgtggggcgagggagggggcagcggggggaggggaagtgggggcgctgggggggggagaatggtggacgggggggaggggcgcgggcgcggggagggggcgccgagagggggggagcgggcagggggaagggggtggggggcgagtgcgggcgggcgggcgaggggcggaagggaggagaagaagggttcgcagcgaagcacgggaggaggaagcgcgcgcgggcacggcgcgcgcgcagggcggccgcagtggtgcgggagagagaagcacacacgggagacgagcacacgaacaaagaacagaagaagaaag

SEQ ID NO: 717847 - DNA, 304 bp, Homo sapiens
  misc_feature (179)..(179): n is a, c, g, or t
tgataggtgcatgggtctgtggcgtgctctgccctacacgtatgaagcaaagcatcagtactgtgtctctggaggggccagaatggcgcgcccctgctgtgacacgagggtggttaggccagtacgaggcgctctcctgctggaggagcaggcaacggcacttcactgtcatcctcaancagctcaccagccgggacgccggcttctactggtgtctgaccaacggcgatactctctggaggaccaccgtggagatcaagattatcgaaggagaaccaaacctcaaggtaccagggaatgtcac

SEQ ID NO: 717848 - DNA, 469 bp, Homo sapiens
ctgctggtcatctctaagatccccgctcagccaacgtatgcaaacgtcactttcagatcattctgataaatttagtatttgctgacgtctttctattcatctgatacatctttgattcactacttgagtctatcaaggataacctgcccataatacaacccatagtatcttcaataacatctcgattatcaccattctctgcaaaaccttgctacaacaattttccgttcttatccatttcttcacacatttcctttatgtctttggcaagaatctcttggtttaaaagaccagtctctttttcttctgtgtaaagtgctgtggcaaacaaattaacgttcttctaacgtcatccaaccgagtttatgtggctgagactccatcatactaattctgctccatgtgtttactctgcctctttttccctccactctgggattaaacctcctcgaaggctttgttcagtcca

SEQ ID NO: 717849 - DNA, 976 bp, Homo sapiens
  misc_feature (107)..(107): n is a, c, g, or t
  misc_feature (151)..(151): n is a, c, g, or t
  misc_feature (159)..(159): n is a, c, g, or t
cacagaaggattaagaatcaaaaagctcaagtgaaaagcaggtattccaaccatggattcactttaacaaagaatgcttcacagcagatctgtccaatgcaaaactncatgtcaaactaacttcactacccaaacaccacaccaaaatatngtcccacnagtagttccaaaaacagtaccataaaccagtatttggaacccatgcaaacctgtaagtccatgacaagacttaggtaccaggtggatagtgtaattttgtgaaaacgcggtaggtgtaaatattgatgccattaagtgctacattagaactgcatttgtgatcgtcacatttaagagtgtgtttaggcttaccaaaattaccttagcttggcccacacttcaaccccaaaattttaaattttgaaactgttagtaaaaccatttaaaggtgataggattcaacaaatttttgccagaaaagctaatctgttagagatattaaaatttttagtttggcatcttgcacatgcaaataagtttcacttgaaggcctagttacattacgagttccctatcacccttaaaagtttttcaagcaatatatatgtacgttaccattcaattatgcacagccagcctttgatccagaaaaaagaattactttaagccgcttactccttattttaaccagcagtaaactgtataagcaggaaaaacttactagttttgggtttcaacaagctagaaatggtgaggtgaggctgccggactgaccatttctagcttattctaaccagcagtaaactgtataagcaggaaaaacttactagttttgggtttcaacaagccagaaatggtgaggtgaggctgccggactgacggccaggaagaatttgctgaaaaggttttgccagatgttgcgttggatttagttggttggcgaagggggtgttgtggatttttcctgcttttttgttagccgaaggcagctgctgta

SEQ ID NO: 717850 - DNA, 336 bp, Homo sapiens
  misc_feature (189)..(189): n is a, c, g, or t
tcatacttgacctaaaaaaataaacaaaatgtcataatgatcaaacactaatgtactttggcttggtcacatgcactgcttagtgagcgtggtgccagaagtctgagctcctttaaaagtattttagtgtgagcaaaccctcatgtccttagtagtttgtaaggatggagctcctttccaattcccaancagtaatattccaaagactgtctttttttctataccagctcccaaaacagaagcaccacagttgatgccatagtcaatataagcagttaatggtaaaaattacaattagttgtaaagaaaacctcatctcccctatatacataataa

SEQ ID NO: 717851 - DNA, 346 bp, Homo sapiens
cagagcagtggtggggcacgagcagtgggggggtcgtggggcactgtttggcacttgaatggcgttcgccacacatgggcactgtccgaggcgccctgtgtacttgctgagatacttaggacctgtgcagtggagggtgcccgtatcacagctggggaagctgaggacgtgtggctcacagtcctgggcttggtggctttgctgatgcttcgggtggcccaggtcttggccttgggcaggaaggctccctggtcaccctgagtctgtggccctgcatgtgagtcaggtgaggtggggcccctgggttgtgctggctcgagacattcggtcccacaagtgcctcgta

SEQ ID NO: 717852 - DNA, 115 bp, Homo sapiens
ctggaagtggtgcgtttcccttttgctcacattccacctgctagaactctgttaaatggctataacctaactgcacaggaggctggaaatgtcatctagttgagctgtgtgccca

SEQ ID NO: 717853 - DNA, 119 bp, Homo sapiens
tgatcgtcatactgactctctcaagtctgggtggacgaagttgttgctgcacactgccgagggaccacaccacacgcgcgcgcgccgcgggctgccccggcgcgctcctgtccactctc

SEQ ID NO: 717854 - DNA, 359 bp, Homo sapiens
  misc_feature (334)..(334): n is a, c, g, or t
gtggtgaacacctacagtcgatttcaccgggggatcatccttgagaatgagggcggccctcatcctatcagctgaaagctttaagagcaaaacccgaggtgtcccagagagggaattctgccttgagacggcggcttcccactcccactggatgtccagcccgcggccccacgggtgggtgagcccgtcctctcctcgtttctgtctcctatttgttctgtctctggacccaccgtgtggccccagaccctccagtgaggacctcccgtatttcttcagagcagcccttgcgtgctggaggcctgggcttcagagtgtccctgggtgccctggngcatgttctgtgacctcccagctcc

SEQ ID NO: 717855 - DNA, 910 bp, Homo sapiens
  misc_feature (449)..(449): n is a, c, g, or t
  misc_feature (537)..(537): n is a, c, g, or t
ctctataagaaaccaaacagctgctagtcctaggaaaatgctgtgaacagatccagccacgtcagtggaagccagctatatagagagaagaacacgcggctcccattctggttaaaggccagtctgtcatccatccaggcaagaactgcggtcacatggctgactggtgctagagagcgtaggacagatatcgactggcaaccagtggagatcaacctcaggatcaaggcctagacaacaagacaacgtcagagttgggcgacgtgaaactctgatcccactgctcattgcactaatgggtcgtaagtgccctggaaacatgataggccgagatctgtccgatgcgttttccccggtgaaggacttggtgaggagcacgaaggcgttcatcagctccgtgatagccccatcctttatgccaatggccagttccccgtcgtactcgcagnccctatgtgcttcaactccgctgaggtaaaaccactcgatgccgctacggtcgagacttacattgcaagaataggccccgtcactganagcagagaattgggtgtctcctggtaattccgtcatcgccaagtagcgagaccagctcgactgttttacatgacgagtctccagggtgtccctccactgggcggtcaagtggcccggtgagacgtttggaggttctcctgctgacactggctgctagtgccccctgagggccaggaccaagcttccctctgtctgatgtcccatgactttgctctcttctgcccctgtgaccccaaggataatgagtgcgcctccccatgccgtcataccatgctctcgaaagaccatatgtgagaccggagaaccgtcaaccaagaagggggagtcagggtctatccagcgtatatcagaactggccctgttatcccaccct

SEQ ID NO: 717856 - DNA, 1666 bp, Homo sapiens
  misc_feature (1092)..(1092): n is a, c, g, or t
  misc_feature (1095)..(1095): n is a, c, g, or t
  misc_feature (1097)..(1100): n is a, c, g, or t
  misc_feature (1103)..(1104): n is a, c, g, or t
  misc_feature (1106)..(1107): n is a, c, g, or t
  misc_feature (1121)..(1121): n is a, c, g, or t
  misc_feature (1125)..(1125): n is a, c, g, or t
  misc_feature (1224)..(1224): n is a, c, g, or t
  misc_feature (1563)..(1566): n is a, c, g, or t
  misc_feature (1571)..(1571): n is a, c, g, or t
  misc_feature (1574)..(1574): n is a, c, g, or t
  misc_feature (1577)..(1577): n is a, c, g, or t
  misc_feature (1580)..(1580): n is a, c, g, or t
  misc_feature (1582)..(1582): n is a, c, g, or t
  misc_feature (1585)..(1588): n is a, c, g, or t
  misc_feature (1591)..(1591): n is a, c, g, or t
  misc_feature (1594)..(1594): n is a, c, g, or t
  misc_feature (1600)..(1600): n is a, c, g, or t
  misc_feature (1606)..(1606): n is a, c, g, or t
aaaaaaaaaaaaacccaagtttcttttacaaagttgtgcggccgctcgcgatgaactagcgaggatggccgtcatggcgccccgaaccctcctcctgctgctctggggggcagtggccctgaccgagacctgggccggctcccactccatgaggtatttctacaccgccatgtcccggcccggccgcggggagccccgcttcatcgccgtgggctacgtggacgacacccagttcgtgaggttcgacagcgacgccgcgagtccgaggacggagccgcgggcgccatggatagagcaggaggggccggagtattgggaccgggagacacagatctgcaagaccaacacacagacttaccgagagaacctgcggatccgctccgctactacaaccagagcgaggccgggtctcacaccctccagaggatgtatggctgcgacgtggggccggacgggcgcctcctccgcgggtatgaccagtacgcctacgacggcaaggattacatcgccctgaacgaggacctgagctcctggaccgcggcggacacggcggctcagatcacccagcgcaagtgggaggcggcccgtgtggcggagcagctgagagcctacctggagggcctgtgcgtggagtggctccgcagatacctggagaacgggaaggagacgctgcagcgcacggacgcccccaaaacgcatatgactcaccaccctgacccaccaccccgtctctgaccatgaggccaccctgaggtgctgggccctgggcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtctgcccaagcccctcaccctgagatgggagccatcttcccagcccaccatccccatcgtgggcatcgttgctggcctggctgtcctttctctttggagctgtgatcactggagctgtggtcgctgctgtgatgtggacggaggaagtangtntnnnnttnntnnatatggatgggagntacnctcaggctgcaagcagtgacagtgcccagggctctgatatgtctctcacagcttgtaaagtgtgagacagctgccttgtgtgggactgagaggcaaganttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattctctgccatgagaggttgatgagttaattaaaggagaannnncctanaanttnagngncannnnaantgnaacacntgaaanaacacactatattacgggggccagaacgcttcccccccccctgggcgcacggtaaccccc

SEQ ID NO: 717857 - DNA, 559 bp, Homo sapiens
  misc_feature (378)..(378): n is a, c, g, or t
  misc_feature (559)..(559): n is a, c, g, or t
aaaaaaaaaaggagcttgtattttttaaaatttcaattatgttccctgggtggacaagaaacaagggggacattttatgggggattttgaaaccaccctaacatggctttacattggatgcatcagtttttcaaaaagccagagaactgtgttccttgaagcatttggggacttcgatagtgccatctatacactgagcatcctctgtatagctacacttcttttccttatttttgcagaagaaagaaactttatcaccatgtagcattccattcttaaatttttcctgaatctttactctctctccttggtacaccacagtggcttttttcacaggtaatttacaagatgctttacaacttggcatggcagaccagnttcccagtttggtacattctattttttccggccatccagagaatatccatcatggcagccaaatgtggctttatccttgaataaaagcgttggtttgcaagataggtaacaaaatcatgggctgggcttgatgggaatgggcatttttacttccctgagtctgggaaattaagcccaattn

SEQ ID NO: 717858 - DNA, 512 bp, Homo sapiens
tactccccagaaaaggctctctcccgaaaatcttatgaaagttagagtttatcaaagaagatgattcttcatcaggaatttacagagtagaaagcactgagtgcatatactagcccccaccacaatccaagtgaggaagatccccaaatagcatctattcagaaatagttgatagtgggacacatgctagcagagctgaagtagtttgtaggaatctctgttgttgtacgaatctctctgttgctgtctgtgtagagagacttcttggtgaggactagacacatgatctatgagaactgcaggaaatctcagcacattaattgactctatctaagcctctgcattaagagaggaccagagtctagcatgatctctagcagtatgaggccctgtccctaggatgagcccagttcccctgctcctccattgaaatgcctacctgagaaagctcaatactgccaggtgaatttatttgcttcagccatgcctgaagacaggcctctgacctccct

SEQ ID NO: 717859 - DNA, 186 bp, Homo sapiens
  misc_feature (140)..(140): n is a, c, g, or t
cacccgatgaggcaaccagccagaacgccttaacgcaggcacatactttcctattctcaccctaggtaggcttcccttcccctacgtaatgcacttaattacacctacaacaccctaggcgtacctaacaatctacatcntacctgtacatcccaaggacctataaacgtcctgagccaacaacct

SEQ ID NO: 717860 - DNA, 875 bp, Homo sapiens
gcaggtgtatggattacctcaaatagtgacccaacaataaggggaaattctatatttaagtggaaatcaaggaggagtttacatctttggtgatggacgaggccttattgaaggaaatgactttgatgtgcattgcattagcaggaatccagattaggacaaacagttgtccaattgttcggcataacaaaattcatgatggccagcatggtgggattatatgtgcatgacaaagggacacaggagtaataggaagagaatgaagttccatagtaacgctctagctggagtctgggtgacaactgccagcatctccagtactgagaagtaaactgtagtacacagtggcaagcaggttggtgttcattctgatgacaatggacatggagtgctacgaagacaatgactatctataatcatatgtatccaggggtgcaggataggactggaagcaaccccaaaattagacgcaacaaaatctggggagcgacagaatggcggaatcctagtttataattctggtctaggctgtattagaacgaccatgacacttctttgcacactgccatggctggagtctggattaagacagatagtaatctacactaggaagaataatccatgatggcagagatgtggctcgtatttttaatggggtcaggcccttgagaacatgtttttcagattgtcccgccgcgtccctcagcctaatgtttccatctttggaaacgcaattggggttgcggcgtttgaatccaatcggactgtcattaggagggtttaacggtggggtttactcggattgcagaaaaacttacaaccgacgggtacgtatatacaacacgcactcgttccgactgcaacaacaaaatcgg

SEQ ID NO: 717861 - DNA, 435 bp, Homo sapiens
  misc_feature (43)..(43): n is a, c, g, or t
  misc_feature (47)..(47): n is a, c, g, or t
aggagaaataggggccttctgaccgctgatgacactggtatgntccncgactctttaggaaacccatacgcgctgcgagaagaggaaggaccccgagtcataagcctaccggatcacaccgggcaaactgatcaacacgtccgcagggccgttcgagccgtagaacaggaaggacagggcgaagaacgaccacagcagcaggacaagaacggcgcagcgcacacggtacgtgaagcgggagatccaaagacgacccaggacacagagaatgagtccatggccaaggacgctcagggcacgaacacgcaggctgcgccaggagcgagacagaggcagaactcactgcaaggggcaccgagcacgaatcggcaagcgagggcagagctagctgctgagggaaacagcgataagctgacaccatcgcacagacacacg

SEQ ID NO: 717862 - DNA, 1516 bp, Homo sapiens
tctcatgggtcactgaggctttaatttggagcccaaaaccaccggggatctagccttggttgccaccccgggatatgacacgaggctcacatgactctagaccactggggttgcaatgtgaggctgagaaaaacaagtgactggtggccaattacactgactggcaaagctagagctgccaacgagggctccaggggatgctagtgggttcagggtaagacctgttcctaaggagaaaagctgtgatacagacacctccaactgagtcgagtgatggtgagcgcgcatacacattatgcagtgtggaccctctgtgttcaagtttgtatagtgtctagtgtgtgtgcacctctgagagcttgccctttgagctttgacccactgattgtggtcaacggtgcggtctttgtttgatataacacacacaagtttggaccccagaaatgcaggactttgcctgtggccccacaaggtgtataacttaggtggccccaacgggggggttaacatggaaagaatatcacattgcagcgtggatcaaacacatattacgacctttagataggggccccaggaggacctaccgttaacaaaagaatactagacagagaagacatggggtatgacaccatatggggcgcaacaaaccagcaccaagaaaacagagaaacaagggggggccaccaaagagaacagagaattccacggcccccaaagtgcgagctaagcccccaaaacaaaacaaagggcgagagacacacacgcaaagcggagatcatacacgacacaaccgccccgggaaaacagaatagaaaaaaaccccgaaggaagtgcacacaaaacaacagaaagggcacgtgtggacccacaaatgtgggtgactgcgctcgtaagaaaagaacacagaggaagaacgggagggacaaaacaacagcgaggcaccacagggaaacaacaagaaaccacagctcaagaagccacccatcactaatacaagaccactaaggatagaaccacaacataagagaaacaagcaacccatggtagaataactacaacacgcacaaaaaagaccaaagctagcacccaaacaactagccgacgacatagacaacacagtacgcaaccaacacccaccgacatcgaagtatgacgcacgaaagggagcaagacgcaagaaagaaaaccaacagagacataaccaccaaacaaaaaaagaagaagtaaaaggacgagagaacactaaggacgagagagcaaagaccacgaaggtgaagcgaatagagaaaagaaacaaagcgaatagcaacacacaagcaaaacagcaagagcaacgacagacccgagaccacagacagaaccaaacgcacgcaacagacaaacgcacgcagacacgaaccaagagaaagaaggaaacccaacgaggcgaagtaaataaaaacaggtggacaggagcacaacataaacagaacaaaacagtacacagcgaacagacccatacacacaacacgacgtt

SEQ ID NO: 717863 - DNA, 105 bp, Homo sapiens
ttatatgtctcgatcgttatcggaattaagcagacaaatcgctccactattgtcctatgaccctgccaaatccccctctgcgagaaacacccaagaatgatcaat

SEQ ID NO: 717864 - DNA, 325 bp, Homo sapiens
  misc_feature (153)..(153): n is a, c, g, or t
  misc_feature (160)..(160): n is a, c, g, or t
  misc_feature (171)..(171): n is a, c, g, or t
  misc_feature (189)..(189): n is a, c, g, or t
  misc_feature (204)..(204): n is a, c, g, or t
  misc_feature (208)..(209): n is a, c, g, or t
  misc_feature (253)..(253): n is a, c, g, or t
  misc_feature (256)..(256): n is a, c, g, or t
  misc_feature (314)..(314): n is a, c, g, or t
gaagaaaaaatacgggaacagcaagtcaaagaacgaaggcagacagaagaaagaaggcagagtaacctacaagaagttttagaaagggaacgcagagaactagaaaaactgtatcacggaaaggagatgattgacgaatcactgaagattaanataaaanaggaattaganatggaaaatgaattaganatgagtaatcaaganatannagacacatctgctcacagtgaaaatcctttagagagatacatgncantcatccagcaggagcaagaccaggagtcggcagataagagctcaaaaaagatggacangaaggctccct

SEQ ID NO: 717865 - DNA, 966 bp, Homo sapiens
gtcttttctctgtttttgttgtctttgtttttcgtttttgtttgttgttttttttctttttccttggttttgtgagcagggaaaggagagatcatctgttgttgctttgtatggtttttttctttcttgattgttttttttgttttttgggttgccgccgcggaagagccaacactagtcaccccgttggccttgaccagggcccagggcccaaaacggttttaccgcgccgtctatccgcctagacaactgggtgcaatcgccgaggacatggcattccggcaacgccagccgcaaaccgggcagagaaccctcccccagacggaatatattgggcgcccactgcccaccccagattgcccccccgcatcccccccggccgttcggggaggtaccagaaataccctgccccgaggttgacctggggatttttccctggggctccgagtttgtactcgtaaaccaggatcactcgatgttgtctaccaagcatctaataaacgagctggttcgtacccagagccctggtgaagaattgcactcgtgctcaattgacagcacacccgtaccgacccagtggtatcgaggtccccctaatgcgctgccccctgggcccccaagaaagggaaccacaagctgaactcctgagggaaagaaagaagagttttaaaccaaaaacgagtctaaaaaaattcacgagagaaaatatgagtgaaaagggaaaagaatgcccaaaacagcacgtctcctggagggagccacgttccacagccagggccagctttttgcgtgcacatcgctttcaaggccgggaccacgtgtggccgagagcacagatggctatagtgctagagggccaagagattggagttttattctttagggaaatccaggccccccaaggccaaataaataccttgttttgtcttcaccccagtaataaaggtgtttattgttttgttcccc

SEQ ID NO: 717866 - DNA, 261 bp, Homo sapiens
ctagctcatgcctgtagttccagcactttgggaggccaaggcgggcggatcacctgaggtcaggagttcgagagcagcctggccaacatgcccagtccacggtgtgtgtgttttgttttgttgtttttttttttttttaatttttttggaaacaaatttttgtttttgtcgcccaggctggagtgcaatggcgcattttgggcccattgcaacttccacatcttgagttcaagtgattctcctgcctaagcctcccgagta

SEQ ID NO: 717867 - DNA, 334 bp, Homo sapiens
  misc_feature (133)..(133): n is a, c, g, or t
  misc_feature (268)..(268): n is a, c, g, or t
tcttgcgtgcaaagccctggtgaaccagtgcctgcaacagacgatgcacattgcttttattgagcatcagttgattggccagctcggtcacacccgagcctcgttcgtgcttggccagggcttccaggagcancaggcccttaacaaaagtcttgtccaatcgaatatcccatcaatcactaaaagtgcatgaattgtctcatggaaccgggccacaccatagccagacaagcccgtatagcaaagcggcaagcggctttcgcaacanattcatcagacatgcaggcagacgggcgtgcacacttgaaccttcaacagcaagcccagtcgacgc

SEQ ID NO: 717868 - DNA, 530 bp, Homo sapiens
  misc_feature (155)..(155): n is a, c, g, or t
ggcgtgactgctctcatcgtctcagcagatcagttcgaggtcacgtcctctgtcttgagactatatgcggacattgaggtggacgcagcaggtgagctgctctgtggacacagcagggcaggaagactatatcgactgcggctctcctcctaccngacactgatgtcatcctcatgtgcttctccatcgacagccctgacaagcctgggaaacattcctgagaagtggaccccaagagggtgaagcacttctgccccaacgtgcccatcatcctggtggggaataagaaggacctgaggcaagacgagcacaccaggagagagctggtcaagatgaagcaggagcccgttcggtctgaggaaggccgggacatggcgaaccggatcagtgcctttggctaccttgagtgctcagccaagaacaaggagggagtgcgggaggtgtttgagatggccactcgggctgcgctccaggtccgcaagaacaagcgtcggaggggctgtcccattctctgagatccccaaggcctt

SEQ ID NO: 717869 - DNA, 114 bp, Homo sapiens
ttcgatcgagctcgcgtccttacagacgattacgcgttctttgggttgctttccgcggttcccagggtttgatgaagggtttgatgaagggtttcgatgacagggtttcgatga

SEQ ID NO: 717870 - DNA, 242 bp, Homo sapiens
catgctgcgccgaaccaaatggcaggcggtgattgtggaggccagtggagggggtgcctttctggtgctcccccgtaagacaagtacgggccgcattgacaaggcctacccgacgtgtgtgtgtgcacacgggtacctgtcctggacatcgactggtgtcctcactacgactaattcttagccatgcgcctcagaggactgcacggtcacggtgcgttggcccaacacggtgcgttggccaa

SEQ ID NO: 717871 - DNA, 613 bp, Homo sapiens
accttcccaccagcaagacaggctatgctatagcacagccactagcccgcctcttagaacctctcatttcctttccatcgtggaaatctatcctcaaggaaataacttctcggtgttccatctgctattctactactcctcagggattattcaggccccctccctaccctacacatcaagctccaggatttgctcccacccaggactgacaaattagctttactcaacatgccccgagtcagataactaaaatccctcttagtctaggtagacactttcactggataggtagaggcctttcctacagggtctgagaaggccaccacagtcatgtcttcccttctgtcagacataattcctcagtttagccttcccacctctatactgtctgacaacaggtaagcctttattagtcaaatcagccaagcagtttttcaggctcttagtgttcactgaaacctttatatcccttacggtcctccgtcttcaagaaaagtagaatggactaaaggtctttaaaaacacacctcaccaagctcagccaccaacttaaaaaggactggacaatacttttaccactttcccttctcagaagtcagaactgtcctcagaa

SEQ ID NO: 717872 - DNA, 110 bp, Homo sapiens
taacagtatatgagtatatatataggtctatatagacagtgattctcaacctttattctcacactatgcacttacatacttcttgtccttaatacaagaaacatggttga

SEQ ID NO: 717873 - DNA, 452 bp, Homo sapiens
ctatgtgcaggcgggcatgattgaacatcttagactgtgtgcaacgagtgtgcaccatcgtcatctgagcaagtgatggcatgtgtttccgtgagcacatggctacatgacgtgtgtagaattatatatgggggaactaatcaattaagggcgaaaatagtgcaactttttggcccgcgggagactcaggggagggacttaaatagtaagcatgcttactaaaatacttgcaagagagtaatatcagcgggatatataagacggggtaagttttgttccagaaaatgtcatattaatctgatcgagtctcaagtctcatagtggtaaaacgctttatcggtgtacgtgctagcgggagccatgaaaggcacggggggaccagggtaagagggggttcttgtattgaaaacgctcgtggagacgagggcacacgtttggtccacatcgtgtgt

SEQ ID NO: 717874 - DNA, 111 bp, Homo sapiens
aagatcgagtaggtacttgttgagatgtttcgatggggtggaggtttgttggagacttgattgtatcttgcattcagcagtctggtggagaggtgaagacgtgacaaggta

SEQ ID NO: 717875 - DNA, 366 bp, Homo sapiens
  misc_feature (101)..(101): n is a, c, g, or t
ggcctctggggcgcattccaaccttccatgcctgcggactctgcgttagatagaatcaggttaactgtatttttgcttggccccaatacagtaccccttgnaaggccgaaagcaacaaaaattaaattttaaccatgagggaaactcgtgcacaatcaggctggtcagtgtggcaaccagatcggtgccaagttctgggaggtgatcagtgatgaacatggcatcgaccccaccggcacctaccacggggacagcgacctgcagctggaccgcatctctggtgtactacaactgaaagccacaaggttggcacaactatgtttccctcgtgcccaatcccatggttgggacttctaaggaacaccc

SEQ ID NO: 717876 - DNA, 1381 bp, Homo sapiens
  misc_feature (815)..(815): n is a, c, g, or t
gcccacagcggggcgagaaagggcacaggccggggagaaggaacaccacgtgtagtgtatagattatatttctactagtccgtaattactactagtggtgtctcgctagttgttagatctcacatttactcaagcccgcggggtgtatatttcccccctttgaacaacactccccctgtccgcgttgtggtgggagagtctctctcttgatggagaccaatgttagcaccttgtgtctgtcttctctcagcatttccccctggggggaattttctttacccggggacaagatacggtggggcccccccgtgatcagtctcctttgtgtgccccctcgtgccccagaccaaaatttgggggaaaggctctatgagacgtctcctctgaaagcggtttctacagggggaaaatctccttatgaatgtccccggggctatatggaagcgagaccaatgaagggccccggccacttccacaggagggattaatgggccctgattttgagggacccaaacaaggttcgccctttatttggggcaccctggggaattcccccccccattcgtcgtactattttgcccccccccccaagtctccgtctcccggaacgtgggagccccccgcgggtcccccccggtggatgcccagagggaggaatctttctagggccctgtttgcttgtcaccacatctggtgtgcgagtgccgccagaccttggaaggaggccactccacgggtcactcacacccgcgtgtatgaaagccccctggccacttctgacacatgttctcacacgcacacgacccaaggtgatntataagaacagatgatttgcccagagagacactgccacactggtggggtggcgcgcccaccgaatgtcactcggtccacacactcacccttgcaccttctttgcacctttcgcggggacctggggaaccacccggccctgggagtcctacaccactggcccaagaagagcctttcgagaacttttttctcaccccccgcctcttgcctgtgtgaggacctttgaatgaaatgtatgtaaggccctcgaaggctcacgagtatccccccgaggtcccggccacacaagtgagccccgccacctgaaggagggggtttgctccccctggcctggccactactgtgttccccttcggagtgcggagccacccctcacctggcttctcctcggccctcgggagaatctcgcttcctgcacgccccacgtcccacgccccctctccttctcgctgagcctcgctgagacctgtgcaccacccccctcccacctgggccccagcctcacccattcccaatctccccccctttttagacccattaagagaccaataccattttttaactccta

SEQ ID NO: 717877 - DNA, 1086 bp, Homo sapiens
aacactagacatgatcgaattcacctcgtacccccagcagcctaagtttggtctccaagaaaatccttgaacccttctttttcagggaaccagatcctcccagcctctcatctgcatccccgccaggtcgagggaatcttctattcattctggtccagaagagctgcccactcccccagagcctgactttccaccgcccctctcccgcccttgtggacagccacaccgtggggggcccagccactccatgctctcccctgtctgaagcctggcccctgactacctcctctgcaccacaggggagccagacttactccctggcccccatgagccctccccacctgggggctccctgacctacttagggaggacctcgctgagacacacaccagactccctcgacttgtgcattctgccttgggagacacagaccagctgaggagccaacagcccagtgccagtcccacaacccagtgaagcaccatacagttggcccgcccctgttggacgggcaagcccccgacaggacagcgcgtaccggtccagtctgagcatagcctgagcagggggcatggcgaagcctcacaacagtccaccatcttggagaggcattcaaggactgtgaaccaggccacgcacaggtggaacagaatggtggacaccccaaaggtctgcggggactcagcgtgtgccaggaaccacatcggccaagataataaccaactgacccaagagtgcgacacaattaagaacgggtccagcaagacgaggaacgggaccagacacacgagggacgaagcatgtaacgaagagagagcaaaaatcgacggaagaaggagacaacaagaaaaacaaccacaaacagcagacaaccaaggacccacacacatagaagcacacagccccgaagcagtgacagaacaaagaggcgcaaccgaacagaaccccacgcgacgaaagagacagagaaaccagacaccacacacaaccgacaacagccaaacacacgccgccgcccacacgagcaacacagcaaccacacagcacacctgcgccaccacaccacaaggaacgagaacagcaacg

SEQ ID NO: 717878 - DNA, 525 bp, Homo sapiens
  misc_feature (43)..(43): n is a, c, g, or t
  misc_feature (89)..(89): n is a, c, g, or t
  misc_feature (93)..(93): n is a, c, g, or t
gaggctgcagcgagcagtgtggatgcaccactgcattccagcntggaccacaaagggagaccacgcctcaaaaaaaaaaaaaaatacanctanctgaatgtacccagaccctctaccttccagaaaaggaagtgggctgaggagagaatcctcacaactttaatacttagctctctgtccccttaacgctcacgacagcaggctcttctgagctgccccgagctgtccactgttctcagcaccgagcgtcagtacacctagctcatcttcacactctacttagcaggtgctgtgagcactcccatcctaaagatgaggactcaggcacccagcaagtgaaccccgccccagataacagcggttagcggcagggccgggcctgatggaaagcagcaggagctcgcgtgcagcaggagcagtgaaagctgcttgggcctgcacctaaatcctgccggacccgccgctacctgggcgaccgctcctgaacctaaacccagccggacccaccgcttccccggcggccgc

SEQ ID NO: 717879 - DNA, 115 bp, Homo sapiens
catggatttgctggtgcagtacaactaggcttaatagggacatgtccctattaagcctcgaattcgagcttgaattcgagccgttagaagcttgaattcgagcagtagtagtagt

SEQ ID NO: 717880 - DNA, 932 bp, Homo sapiens
aatcgcttgaacctgggaagtggaggttgagtgagccgggaccgtgccattgtactccagcctgggtgacagagcgagattccgtctccaaaaaaaaaaaaaaaaagcccacctgaaagcctgtctctttccacttggtgggcccttccagggggattatcgagcatgtggttttttcatagtgccttttcccttatttcaagggtttgccttctgagtgtggtgtgtttttttttttaaaattggtttgggtttacaaaattagagtttaaagaacagtctccagaagcttttctcagccaatttgggtctccttacttcgtgggttaaatatttttccccctcgcgggcagggggaagccagggttagaagccaagaggagacaagcaggagtgtggaggaggtgaggcgtccctccgtgctgttacataagcccaggaggcttaaaggctccacgcttataaggggtggtagaccccctggggggttccaggggaccgtgtttgcccagggggtgcagcgtgtgatgtgtgatggggccaccgggcggcaaacacgggagggtgacccgcccagttctcccactatcccactgggattcggggctaaccacggggggcgtcggaagcctgtcctcacgtgccttcggggggtggtgggccccggccccttccttatttgccccctgtgtgaaccggcaagtcccaggacagggagcaggggaggagggacatttctgggaccgcagcctccagttgtaggcggttcattatctctatggcgggggtaccggggagagtactccgttccgcggttctggctcctaagatgggcaggggttacatctgtgtccctgacccgaccgtagtgtaggcgcctgggcaatgggtgctgtgtgccccttccgggggtggtggaggtgtccccctag

SEQ ID NO: 717881 - DNA, 197 bp, Homo sapiens
ctcctcatgtgcatgacgctgtgtccgtacatctttcttttcaccttctgccagggtgtgagctgtaccccctgctgtcactgcaggtctcttggtctttcttgcgctttgtgggcctggtggccgcaggacccctggacctgctggcaaagtagtgcgcccgctgtcccccatcgggtgctcctctcagagtcgcc

SEQ ID NO: 717882 - DNA, 931 bp, Homo sapiens
ccggcggggatgagtcggacccagggtccttcagtggtagatgtcccctggtatggtgtggcaccctgaatggctcctccctggcttatgccgtacctcagcacatccctgtgctacttgtagctggggcctctgggctcttggtcctctactgcctcctgcttttgctcttctggatctacagcagctgcatcgaggactcccacagaggtggctatagggctgcgcattgcacgtggccatctcagctatagccgtcttcctggtcttggtgtctgcgcatgtatccttcgatttggcagccaggtctctctgtcaagtccatcatctccttgaacactacaattagctgttctgaagcccagaagattccgatggacgaccccctgtgaactgctctgcagttatactgtcaacctacacaatgctgaaacctcttcttgggtgaattgggtattgtggtgtgtggtcttggggctccaggtcgtgcagtggaagtctgaagccacgcccataccgggctctggagaggggtgaccctgatctggagctctgagacagcatgctcttgtgggtacacgcttccccattcctgaagcataagcggagtgcttccgggcagccgaagactctatgcccaaagtgccttggtaaggcccggcacgactcaagggaccatgtaactgtggggaagcctcacgacggccgtctgccgacggggcgcgaggggcgcgacaacatagagaccagggcccccgccagcctccctactgccacctgttagtgccaaagacacttccggcgtcatcctacaacagacacacacgcacaaagccgccgcccaaaaccgggcacaacacacaccaacgccacgcccagcgccgcccccccggcacggcgaacggcccacgcgcccacccaccacggccgc

SEQ ID NO: 717883 - DNA, 120 bp, Homo sapiens
gtcgtatagatgcgtacgtaatgacatctgccacagtctccggctctccagcctcagccctgcttcagtcccttccccatgcttctgcctgatgacaataaagctgttgactcagctaag

SEQ ID NO: 717884 - DNA, 227 bp, Homo sapiens
acctgggaccttaaatatacagctatgatatgttggtcgaacagaccttcgtggcagccagatgtcctatcacctcgctagtcggtaagagggcctctttgagctctgtccacctagtcaggttggagacaccaggggatctaccaccaaaagctcccttctggttggaggccctgggtctccaattgacccttcaaatatattattctgttcttttgtgcatttct

SEQ ID NO: 717885 - DNA, 603 bp, Homo sapiens
cgagtgaaattcctaccagagtcaagtggttctcagctcttggctatacactgaaatcacctggggtggcttcaaatagtgatacctgtgtcctgttctcacttattctcctataatcggtctggggtgcacccaagccctgggattttcagaagttccccagatgattctcctgtgcacctgaggctaagaaccacagcatgagacataacccatggacaggtgttgacaatattaggctctgattataaattagtttggccaggtaatttctttcttgatccaaataagcctacagaaattattcccaagaaagaaatcttagtattttttttttgacacaggatattgctctgtcgcccaggtggaattacattggcacaatcatagctcactgtaaccttgaacttctgggctccagcaatactcctgcctcaacctaccaagtagctgagactacaagcactcaccaccacgcctggctaatttattttttttatttttattttttgttgtagaaacagggtctcaccatgttgcccaagctgggtggtctccaactcatgggctcaagcaatcctcccatcttggcctcccgaagtg

SEQ ID NO: 717886 - DNA, 126 bp, Homo sapiens
acaatctcctaattataacattcacagccacagacctattcatattttatatctgctcggaacccacacttatccccacctcggctatcatcacccgttgaggcacccacccagaccgcctgaccg

SEQ ID NO: 717887 - DNA, 428 bp, Homo sapiens
aaagagtttcgaacgaatgataagacagtgccaggacggataggtgcgactgccggcggttctccccgctcctgcatgctctctttcccctcgtttctcctcgttccctttcttttcaccctcctctttctctccttcttttcttttttccccttttcctccttccccttctctccctcttctttcccccgttcatctatccattgtcctcgtccgcaccacttccccttcgctttacactctccctggtttctctcttactctggctcctttcctctctgcttcctcttcctttactctctctctctctctttctcctccctttcccccttgacatcccatttctcgtttatttagcctttctcctttttctctctcctctcttgcctcttctgctttccgcctttcttttcgtcccctttctgttt

SEQ ID NO: 717888 - DNA, 586 bp, Homo sapiens
catggtggtgggtgcttgtaatcccagctactcaggaggctgaggcaggagaatcgcttgaacctgggaggcagaggttgcaatgacccgaaatcgagccactgcactccagcctgggtgggaggcagaagttgcaatgacccgaaatcgagccaccacactccagcctgggcgacagagctagactctgtctcaaaaaaaacaaaaaaacaaaaacaaaaaaaaacaaaaaaaccttatcagagtgaatcaacatcatatataaactagcacccagaatctgaccaaggatacaaccgagaaagtgtgatgtcactgcttaatattcaagttacgaacagctgtgtgcttggtcagagacataaggcctcagcctggtcgcagtggctcacaggtgtgaatgcccagcagcgtcgggcggtccaagagtgagggagtgcttgagctcaggagttgaaatatcagcctgatacatacatgtgaaactccagtctctacaaagaacgagaacagaagaaaaaaaatacaaaaactgccaggcatgggtgtgtgtctatattcctaattactccaggggctgagatgg

SEQ ID NO: 717889 - DNA, 129 bp, Homo sapiens
  misc_feature (20)..(20): n is a, c, g, or t
  misc_feature (33)..(33): n is a, c, g, or t
  misc_feature (81)..(81): n is a, c, g, or t
tagatccaccattccctctnatggtgtctacanccgtcatactaccagctgagatggtggtgggcataaggagaatttgtncctataacccttagtgtgttctggttttcctttttttaatttttaaat

SEQ ID NO: 717890 - DNA, 413 bp, Homo sapiens
aaatttggtacaactttgaaataagcaggactttgtacagaagcaccatctccttaagatatgttgtaaatgccagtacagcctagtggctttaattagtttgttcaatacaaatgaaaaaatatgagtagcttgtcactgttacccagtcaaaatggtgtttttaatatgtagagcattatgtgtgacttgaagatggtaggaaagccaaatgcctgtagctgatggaggccagtgcccatgagaagttcactttcctggcatcagacccaaatgggttctggctctgctgtgattgatttggtgggcgcagtcataattccaattcacagcccaggcttctcccagtggtccaagacagtctcagtggggcaggtgtggcaccctagtagaatgtggtgcacctaaagtat

SEQ ID NO: 717891 - DNA, 899 bp, Homo sapiens
  misc_feature (720)..(720): n is a, c, g, or t
gctccggcttcggcgcggaggggcggtcggtcgggggaggcggcggcggcggctggtattcgcaggagccatgttgtcagaagtcctactggtgtctgctccggggaaagtcgatccttcatggtaggaacatgccgtggtacactggcagaggtagcactggtctgtatccttgaacttgagaacattcctccggcttcaatgcccacagtagatgggaaacgtggaccgtcatacttacccaacattgggtatcaagcgggcctggtgatgtggccaggcttcagtgcagctggacacaagctttctggagcaatggtgatgtcacaacacccactctcagagcaagtggagaagctaaaggaggttgcaggcttgcctgacgatgtgtgctgtacgccgagcgcctggctgtgctggtcttgcttaacttatacctgtccatctgccggaagcagaggtggaccaaggaggatttggagctaattaacaagtgggccttccaaggggagagaatgattcacgggaagcccctccgagagtggacaatgctgtcagtacctggggaggagccctccgatagcatcacgggaagatttcagtccttaacgaggtcgccaggtctccagatcctggtgaccaacacaaagtccctcgcaataccagggccttgtggctggcgtcagaaacaggctgctcacgttcccagtagatcgtggntcccacatcctgaagctcgagtagatggccatctccttggagtgtgagcgccgttgctgggcagagattggggggaaggccccagagcccgtaaacacatgacctgtggctggaacaacggcttggggtgacaggggccctctgaatgccctcgggttggccggtccaatctgtggaca

SEQ ID NO: 717892 - DNA, 801 bp, Homo sapiens
cgggaggagtactttccaccaaaggtgttgtgtggctgtggactacagccacgacaaactggtgggagcgagccgtggccatcgtcctggctggtcctgggcttcctgtggcctctactcactgctcacgatttgttacactttcatcctgctccggacgtggagccgcagggccacgcggtccaccaatgacactcaatggtgtgtggtggcagtggtggccagtatctttatcttctggtttgccctaccaggtgacggtggcataattgatgtccttcctggagccatcgtcagccaccttcctgctgctgaataaagctggactccctgtgtgtctcctttgcctacatcaactgctgcataaacccatcatctaacagtggtggctggcagggccttccagggccgacctgcggaaaatcacctaccaacaagctcctccggaacgtgtatgactgaagagtctgtggtaagggaagagcaacgtcattcactgcgctccacagtggacactatggcccagaagaccccaggcagtgtaggcgacagccctcattgggccactgtggaccgagtgtccccttacattaccggccagtactccctcttgttactccacatatcacgtctcccggggaggatggggtaacccattaggataacctacacgtctccatccaaaggtgcctgacgataccccaggaaatggtcctcactatatcccagcgggacccattgatcatcccgtacctcaatatgccaagggtgaacactccacactaagagagcacacgccgc

SEQ ID NO: 717893 - DNA, 131 bp, Homo sapiens
tgacgaggcagtgctgccaggctgctcttgattgggaactggctgtcctctgctctgaagcccaagagacctgagataggcagctgctgggagggcttttctgaggcaggagaatggcgtgaacccgggag

SEQ ID NO: 717894 - DNA, 303 bp, Homo sapiens
cagcaagggctgacatgttggagaaaggagctgtgagtagaaccgttagttgggatgagtttggggctgcgtagttatggaggaaacaagctcagagaaccaaatctctgaccttctgctctgactctccccctccacccccagatgcgattcatgctgctgttcagccggcagggaaagctgcggctgcaaaaatggtacctggccacatcagacaaggagcgaaagaagatggttcgggagctcatgcaggttgttctggctcgcaagcccaagatgtgcagcttcctcgagtggagggac

SEQ ID NO: 717895 - DNA, 126 bp, Homo sapiens
tgcttactgtggcgttggagtaaattctgtggaaatgatggataaagaaagaaacaaagacaaaatgcctgaggatgttacattcagccctcaagatgaaacacagaccgcaaatcatacgcccag

SEQ ID NO: 717896 - DNA, 278 bp, Homo sapiens
ccccccattttgtgcctacccttaaggatttttgggggcattgctggaaattagccccctgggtaaaatgtccaaaatggggtaaattaaacccgggaattggggggcaatttattaaaagcccccttaaagccagtaacttccccttagggggggggggggaaaaggttaaattttgtatccaggggtttttggggcacttttggggtttttaaaaaattgtttttgggggggtttaggcccaacccatgttttttttcagggccaaaaaaatttag

SEQ ID NO: 717897 - DNA, 201 bp, Homo sapiens
  misc_feature (91)..(91): n is a, c, g, or t
aattttccctttttttttccccccccccccggcccttgggggggggttttttttaaaaaaaaaaaaaacccccccccggggggggggggtnaaaggggtttttcccttaccccggaaaaaaaggggggctttttcccccccgcctttttttaaaacccccttgtttttttattccccaaaaaaactttttttttggggtta

SEQ ID NO: 717898 - DNA, 190 bp, Homo sapiens
gattgctccggctgacatctagagtatcccgaaacctaatatacgcagtcgtaatgggctggtgttgtcactgcagctatttggtcactgctgtgggttctatccctggcctgggaacttccacatgccactaatgtggccaccaaaagggctttgagttcctagaaagtcaggaccacatcttctattt

SEQ ID NO: 717899 - DNA, 108 bp, Homo sapiens
tttgccgcttctgcttctgtgttctgcttctgcgcttcctcttctgcttcctgcttctgccgcctcctgcttctgccgcctcctgcttctgcccctcaccaagaccct

SEQ ID NO: 717900 - DNA, 376 bp, Homo sapiens
  misc_feature (34)..(34): n is a, c, g, or t
  misc_feature (39)..(39): n is a, c, g, or t
  misc_feature (51)..(51): n is a, c, g, or t
  misc_feature (110)..(110): n is a, c, g, or t
  misc_feature (340)..(340): n is a, c, g, or t
  misc_feature (352)..(352): n is a, c, g, or t
gcactgagccgccgccgcttccggaagcgcagantccgntggtgccacgtntatccccttacatcctcctaggacccggtcggtagtcgtcgccccagcccgccggggcnagcgccatgagcgcggccctcgagacgggaccgagagcatcatgggcagcactgtcccgcgctccgcactccgtgctgcttctgctgctgctcctgcgccgggccgagcagccctgcggggccgaagctcaccttcgagctgccggacaacgccaagcagatgcttccacgaggaggtggagcagggcgtgaagttctccctggattaccaggtcatcactggaggccantacgatgttgantgctatctagaggacccccagggg

SEQ ID NO: 717901 - DNA, 255 bp, Homo sapiens
  misc_feature (51)..(51): n is a, c, g, or t
cgtataccagatggcgagcacatgcccagtgactgcgggaaagtttggtcngaccgcgcagaatgagtgacgatgggtggcgcgttcgtgcagttccatcagcgtcagcacaatcacccacaccgacatcagcatccccaccacggtcataccgacgattttatcctgcaacaaccacggcagaagaatcgacaagaccagcgtgacgaccagcgccacgcccagattatgccattttttgcgtcgcgtaacttt

SEQ ID NO: 717902 - DNA, 1611 bp, Homo sapiens
tggtgaatcatgttgtctctttccaataacgggctataaacttttcccatctctcttgaaacaaagcagtctgtcttttaaaaagcgcggtaaatggtctttctttactctttatattctctttggaaaaatgaagagctcttttctcttaaagaatatgtgatcttaaaaggtgtgtgtggtcttatgtggctataaacaacaggttgagaccaccccatctttattgtgtgaaagtgtgagaaatattgtgtccacactggctattgtgcagaatgtgggcacctatggcaaatattctctggtatatgtgtctctccagtatatggctatccctctaagaataatataacaacgtctcttatgtgtgtgagaaccaaggaggaaaaaagaaagaaacaacaaaacaaaaaacaaaacaacaaaagacaacaaaaacaacaacaaaaaacaagaaaaacaaaaaaaacaaaaagaagaagaagagagaggaggcgcgcgcgagcaacaatagaaaagacaacaacgcgagagaggagagaggaacaaaaaaaaacaagcgctaccccaacacagctcttagagagaaaaaagagaggaggacaaccaaagagagaggaaggacgactacaaaaaaaaaggacagcaagaagcgacgcgcagcgaatataataagacaacaagagaaagtagacaagaaaaggaagacaaacaaaacacatacaaaacacaacgtagagacacaaaaacatagtagaagaaagaacaacaacatacccataacaacgaagggggtagcagcacaaaaataaggtatagaacaacacaaacaccaaacagaagagaacaattaacgcatcctcatacaagagcagcggtactaaaacaaaacaaacactcagcaatagacagagtagacagatcaacaagaggaggcgagacaaccaaacagcctaagggaaaaaaagcagacgacaaggcgacgcagaaaaaaaaaaaaacaggtacagcacaagccgaagagagatcatgaattcaagagacagaaaaaatatatatacaccaacgcaggaggggcacaacacgaaacaacatacgagcggcagcgctgacgggaactgaagaagatagaacagtacgagagtaatgtggaggctgcacaatcaaccgacaatatttaagaagtaccgagtgtgatacaatgaagaatgaaagacgcttagcgcgtgaaggagtacggtctgagacaagtgagaggcacagagcagctaacggaggggcgcgtatgatgatgagacggtcagagcgataggagacaatagagaggcagtcagataacgagatgagacaggggaacgacgcagacgactgaaggctgcgcatggcgaagtacaggaaacagagcagaatagaacagagggagagagagcagatgggcacgtcgagacagaatcaacaaggaacgtagatagtgagaggtagagcagcatggagtagagcgaaaggacatgatgagggagcctgcggaaaatcgcatgacgaagcaggagagacgtcaaagacagagagagtcgagagaggcagacgagaaagtcagatcatcagaacaga

SEQ ID NO: 717903 - DNA, 284 bp, Homo sapiens
  misc_feature (69)..(69): n is a, c, g, or t
  misc_feature (221)..(221): n is a, c, g, or t
caccagcgcgagacctgccgtcatcggcgacagccgaggacgagctgcagatgctgcgacacgaatagnaggaagccgaccaagagccacgacactgagcaggttgaccaggatcgccccggagaacgacccccgcttgaacagcgccatgtcgagcatcggcgtcttggcacgcagctggcgccgcacgaacaggaaacccatcgcgaggccgagaagtncccacggaccggcctttcagactcggaccatccacgggccagcgactttgatcgcgtagacca

SEQ ID NO: 717904 - DNA, 209 bp, Homo sapiens
tacgcatctttggaggacaaaaggcttgccatatgttagaataaatttgaatctcataggtactcacaacaatgagcagcattgtaagtagtgattgcattcatttgaattcggaacattctcaatcagtccttccactctaagttaatctttgtttctcacagaacactaggcagttcaaagggcctctggtttcgcgacgcacactg

SEQ ID NO: 717905 - DNA, 160 bp, Homo sapiens
aaacacatcttcacgggaaacttactggcgtcaagtgcatcgacgagaccatgaagctggcgggcatgcattacctgcatgtcaccctgaagcccgccatcgaggagatatgccagagccacaaaccctgtgaaatcgaccctgttcggttgagcggaga

SEQ ID NO: 717906 - DNA, 1015 bp, Homo sapiens
  misc_feature (822)..(822): n is a, c, g, or t
cgtgagttaaggaccctcaatcatccagaaagtggtttgaaccctgtggtgtcgcacctgatgttcgttcctacactcaatctgcgaggaccgtgaaaatctactcgcgcatgcaaatacgagtacaggatagctctgtacaagactacacaggtgcccattctaactatacttagatcgtggactattatgacaacattcgggttgcacgactatatcacggaattgtatgctttaaactcgaagacatacatgcacacacacttcgttccattctccatcccctgggtcgtgcatgtaattaaacaaaacccgaccattcactaggactaaagaccctaaccgatgtaggcaaggaatcagtcgatgggtgcatcgtgagctgacaggtatctcaagagaacattaacatagtagccgaccataacgccatgactactatgcgacatgactgaagactctccagagagctcctcgagagaaggataactcacgctaagacacgtgaccgtccatgcaacaagagactctcctatgaacccttttaagcttacactcgtgtatctctcattgatgtggttgagcacggcctcttattcatagtagaatcgaaacataccctatctccgggcacgagagaggcgtggatgagatccgaaagcttgctgtatgggaacttcacactacggaattccctgaattacatactcacacgttggcacacgctgtaacgtgcagcaatgttcaccggattgactgctcgggatttactttgctacgtgtgatgttctcattccatgtaaaatgaggatttatggagcntaatattgtcaaggcgagacccctgcacataaaggcggaagccccacgaatgaaatatgataacaccctgaggccaaaagccctttttgaaattcccccttcgcacagagtcaagggcccgaaagagggtgatggacctaatactgactgacagcataggttgttccggatcctggcgggtaacgaaactagg

SEQ ID NO: 717907 - DNA, 175 bp, Homo sapiens
cagacctaacatcgctcactagcatactcttcacatcacgccaccatagccctcgtagtcacagccatactcatccaaaccccctgaagcttcaccggcgcagtcattctcataatcgaccccgggcttacatcctcattactatactgctatagaaacttctaaaactaggcct

SEQ ID NO: 717908 - DNA, 505 bp, Homo sapiens
  misc_feature (16)..(16): n is a, c, g, or t
  misc_feature (39)..(39): n is a, c, g, or t
  misc_feature (70)..(70): n is a, c, g, or t
  misc_feature (77)..(77): n is a, c, g, or t
  misc_feature (82)..(82): n is a, c, g, or t
  misc_feature (87)..(87): n is a, c, g, or t
  misc_feature (90)..(90): n is a, c, g, or t
  misc_feature (100)..(100): n is a, c, g, or t
  misc_feature (110)..(110): n is a, c, g, or t
  misc_feature (113)..(113): n is a, c, g, or t
  misc_feature (123)..(123): n is a, c, g, or t
  misc_feature (128)..(128): n is a, c, g, or t
  misc_feature (137)..(137): n is a, c, g, or t
  misc_feature (140)..(140): n is a, c, g, or t
  misc_feature (166)..(166): n is a, c, g, or t
  misc_feature (169)..(169): n is a, c, g, or t
  misc_feature (175)..(175): n is a, c, g, or t
  misc_feature (180)..(180): n is a, c, g, or t
  misc_feature (185)..(185): n is a, c, g, or t
  misc_feature (192)..(192): n is a, c, g, or t
  misc_feature (201)..(201): n is a, c, g, or t
  misc_feature (204)..(204): n is a, c, g, or t
  misc_feature (227)..(227): n is a, c, g, or t
  misc_feature (262)..(262): n is a, c, g, or t
  misc_feature (285)..(285): n is a, c, g, or t
  misc_feature (344)..(344): n is a, c, g, or t
  misc_feature (357)..(357): n is a, c, g, or t
  misc_feature (417)..(417): n is a, c, g, or t
  misc_feature (440)..(440): n is a, c, g, or t
  misc_feature (480)..(480): n is a, c, g, or t
tatctgaaagcaatanatttattaagtatccccgaaaanataaacacaaaccagtaaaaaacaaaaccgnaaaacgncaggnctggngcngcaataaganagagacaggngcngcccacacgnggccnagggggggnggncgaggccataaatactgcaggggggnggnaagggngcccnagggngaggggnaagcagggngtnggcagcgagaaggctccgggggnttagacactgctggcttcggccccggccgccaccngcctctcactccagccgcgagcngcttcacttggggccctgggcctccgactcccccccgtcgtcttcgtacatctcgcccncttcctcggccgnggcgtcctggtactgctgggactcggacaccagggcgttcatgttgctctcggcctcggngaactccatctcgtccatgcccncgcccgtgtaccagtgcaggaaggccttgcgccggaacanggccgtgaaccgctcggagaagcgc

SEQ ID NO: 717909 - DNA, 751 bp, Homo sapiens
ctgttgtctcttccgtgcgttatcccgttcttatttgcttggtttcttatcgccgtgttgactcctgccagggtgattccggggacccctgtccagcgtggttgctgatgggcggatcttccaggccggtgtggtgagctggggagacgtctgcgctcagaggaacaagccaaggcgtgtacacaaggctccctctgtttcagggactggatcaaagtgtactatctggggtataggggccggggcctacccatatgtgtacacctgcggggcctaccctatcgtcctaccccagtgtgcacgcctgcaggctggagtactggaccgctgactgcaccagcgcccccagaactatacactgtgtaactcaatctctcagggctcctaaatctgcctagaaaacctctcgcttctctcagcctccaaagtggagctgggaggtagaaggggaggacactggtggttctactgacccaactgggggcaaaggtattgaagacacagccatcaccccgcacagccaccaagcatgggcacgaggcagcagtttgtgcatatctgccatcccacatgtctctaaggagcagcgggaacggagcattcaggggcctcctcagtgaaggtggtggggctgccggatctgggctgtggggcaccttgggccacgctcattgaggaagcccaggcatcaggaggaaccatggaaaacagacaggtcatgagacatgaaaattgatacaccagctgccca

SEQ ID NO: 717910 - DNA, 204 bp, Homo sapiens
  misc_feature (176)..(176): n is a, c, g, or t
gtgccatatcctatctattgacagtaaatggacagctcatgggaggccaagtggtggatcacctgaggtcagaagttcgagaccggctggcaacatggtgaaaccctgtctctactaaaaatacaaaaaattagttgggccgtggtggtgggtgccctgtaaatccccagctactnccaggaggctgagacatgcatattcagg

SEQ ID NO: 717911 - DNA, 128 bp, Homo sapiens
agatgtgcgtatgtaagcactagctttctcgggatctgatgcgcgctggttctcggctggtacacggcacctgagtggcacatgctgctcggccgagatacatcgaacgcgcctgtggtcgtgagcct

SEQ ID NO: 717912 - DNA, 388 bp, Homo sapiens
tgatgtgaaaatatgtctttatttctcgtgggtaaattacgaggagtagaattgcggggtcttatagtgagcttatgtttaactttttaaaacgtagctggcagggcgcgggtgctcgtgcgctgtggtcgcgcgagctcttaaggaggcgcgaggcgggtggatcacgaggtcaggagattgagacggatcctggctaacgcggtgaaagcgcgcgtgtgtactaaaaacggaaaaaattagctgggcgaggtagcgggtgcggtgtagtcccagctactggggaggttgaggcaggagaatggggtgagggtgggagcgggagcttggagtgagggaagaggatgggagtcgcctccaggctgggggagagagcgagagtggatgt

SEQ ID NO: 717913 - DNA, 195 bp, Homo sapiens
  misc_feature (6)..(6): n is a, c, g, or t
  misc_feature (150)..(150): n is a, c, g, or t
  misc_feature (174)..(174): n is a, c, g, or t
accatntcagtgcaccaattactgttatcgttgtgggaacaggctgctatcatggaattagatgacactttaaaatattccttccttcaatttgaccccagcgcctcgtcgtggtgagcctcatgttacacggcgcaccccagactactntcctataaattcctcctggggaancctgcctttgtatgtgggaag

SEQ ID NO: 717914 - DNA, 903 bp, Homo sapiens
  misc_feature (903)..(903): n is a, c, g, or t
gcagtcatgtcggggattcgacgatcctggcattttctacagcgatagcttcgggggcgacgcccaggccgatgaggggcaggcccgtgaatcgcagctgcagaggcgcttcatttggtagttccgtgcgcgcagtaccgaagtgggcacgcgaccgcagggttgtccaccgttcaaatacagggcatgaactcaagcggctattacaacccgtgcgggcgagtactgcattgaggtgcgcagatggaggcatctggccagctttgatgaggaccgtggccgactacgttgtacaagcagccagccgagcaccgtgcagctgcttgaggaagctggcaaggaggtagctgatgaggtgacccggcccggccttcgtggggaggaggtgctccaggacatccaggtcatgctcaagtcggacgccaggccttccagcattcgtagcctgaagtcggacatgatgtcacacctggtgaagatccctggcatcatcatgcgcggctcgtgaggtccgtgccaaggggcacccgcggtctctatccgagtgccgcagttggccggacaccctcagcaaaatgtgccatgcgcctggcctcggggggctatgccctggccaggattgtgcaccaccagatcaggcttggtgcggcccgaaatgccatgtgaccgtacttcatcatgcccgacaatatgctaatggtggacttccaaacctggaaatgcacgaactgcttgagtgcgtcccccacgggagaagccgacacttgggggctgctgcgacaggtcctgtgtcacgggggccgggacacgggtcacgtgggtaaccacaacaaaatgggtagacacaaggcggaaggggggggcaagcaaacaggtggccggggaaagttcgtttggggggan

SEQ ID NO: 717915 - DNA, 153 bp, Homo sapiens
tggggagggagggatcagaagagctcgtcggttatgtaagggatgcgtatggatgggagggcgaggaggactaggatgatggcgggcaggatagtgcagagcggtttctagtttcctggagcggtctgaagatgttcggtattgagttcagtt

SEQ ID NO: 717916 - DNA, 371 bp, Homo sapiens
gtccaaaaaaagaaaaaaagggcccaagatgaatggcccttatgccccccttagtttacctttgaaaggtttgaaaatataaagtattggctgggggtgggggttcacccctccaatcccagaactttgggaggtggaggcaggtggatcccttgaggtcaggggtttgaaccaagcctgccccacatggtgaaccctctttttttttaaaaaaccaaaaattagccagggggggtggggcacccctgtaatcccagctatttgggggggtgaggggggaaaatcccctgaacccggggggtggacgttgcagtgagttgaaagggcccttttgcattccagcctaagcaacaaagaaaaactccttttca

SEQ ID NO: 717917 - DNA, 129 bp, Homo sapiens
cttcccccttggaaatcctgggggttttcctcttccctctttgggggttctgttttgtaatttaaaaaaagctattcatccccgtaattattattattttttccaaaaaatggggcctgggcccaggga

SEQ ID NO: 717918 - DNA, 732 bp, Homo sapiens
gccaagctgcgcgggcagaagcggtccggggcctccgcggccccgcggcctccgcggccgctgccttggcacccagcgccacccgcacacggcgctccgctacgccagtgcctgggatgcaacgagccatgtgctggtgtgagaagccgcctgtcggagaagcctgcgtgctgagtgctgctcgtctgcctgcggtgcccacgtgaggatgtggccctggtggtgacgcctgccgccgcctgatgcttggctgttgctcccgccacccgcctgcctgccgccgccgactccctgcgaccccgacgtcctcggcgtccaacctggacctgggcgagcagctgggagcgctgggagacgttccagaagcggcagaagcttaccctccgagggtgccgccaagctcctgctagacacctttgaataccaggcctggtgaagcacacaggagggctgccactgtaggagcagttcgtttcgaagttagggcctcagcagacttgcatatatttgacatgcaagtaccggaattatatatgactaacataagcacatacgaatggacattactcacaattggagaacttgaccaggctactaacaatagcagtccagattggcaaaagacgcaactgttggaactaaccttgtgagagggattctgtgctacacatttagaacttttcacaaggttggctgacaacacgaggggacttcagtttaattcagagatgg

SEQ ID NO: 717919 - DNA, 124 bp, Homo sapiens
ggtcctaactcgtactccccttgctgcagctcggtgcgtatggacatgataacttggccaatgtgaaccctggccacaagtgccctggggctttccaaaggcacctcgcatgcctgtatggagc

SEQ ID NO: 717920 - DNA, 162 bp, Homo sapiens
gctgcaggaattcggcacgagctggaaatgaatcggaaccagagggatccaacaatgaggcctcagatagaggcacagaacatgggtcagatgatagtgactaggttttatttcatcatagcttcactctctctgagaaacctttttatattatgtgaaagc

SEQ ID NO: 717921 - DNA, 415 bp, Homo sapiens
  misc_feature (35)..(35): n is a, c, g, or t
  misc_feature (44)..(44): n is a, c, g, or t
tagagacacacaccagctggtcaaaacacgaattnctggggcanatctaatgagggcgttttctgggaagacactgagataaccatgacccaatgtggatgggcactgaatatggtttggctgtgtccccacccagatctcatcttgaattgtagttcctgtaatacctacatgtcgtgggagggacccaatgggaggtgactgaatcgtggtggtggttactgccatgatgttctcatgacagtgagtgagttctcatgatctgatggttttataaggggcttttcccctttggctcagcacttcttgttgctgccatgtgaagagggatagctttgcttccccttctgccatgattgtgaggcccctgcagccatgtggaactgtcagcccattaaacccctttgttctttat

SEQ ID NO: 717922 - DNA, 158 bp, Homo sapiens
accctacaagagacaacgagatgtacaagatgaagagacgagatgatgggcattgagagagactcagggaagaaggatgaaacgagcaatcatgcagcttggtacaactcttttgtcgctttatcatattctcagtcgttcaattggtgtttgctata

SEQ ID NO: 717923 - DNA, 820 bp, Homo sapiens
ccttacctctgcaggctcagaagtgcctgctccagatgcgtggcttctccagactcccagatgtctgctccgggactgagcaaatgtttaagtgtcaagtcctggtgcgctttgcaacccggccgtggtgtgcgtacactctgttgtgcatgccctgccatgccatgcccccatgtcactgcctctgccccctccagactttgtgtgtgccaacagatgcacggtggagtgaatgtgcttgaaatgtgtggcacttgcatgtgtccccacatgtgcactgtgatatgccatgtggcatttgcgagtgtgacaaaccttgtcaaatagtgcactgcatgtgatgtgcacgatatgtgttacccctgggggttgtgaatatgtgggtgctgggtcccctgtgatgaaagaccccaactatttgagacagaacatgtgtgactgcatcattgatggtgccttgggtgggcccttggtctgcggttccccacgttgggactgtccaacctgtctgagtagacggttgaagagaacgtattttggttgtttatatattcacaggcacctctgcccgaatgtgccaactcccagtgtgaccaagtcaagcaacatcagctttaccttcccttcaagaagcccatgtatgaaagtccccaggatctcaatgcctaagacctctgccactggtgatgagttgtcaagtgattgaacctagcctttgcggactaaagaagctatctcacttcccggggctcctccttctctccctgaagatcgtggccaactccttcagggaccactgttgcttgcagaattgggacta

SEQ ID NO: 717924 - DNA, 121 bp, Homo sapiens
acacccgggtgtccgcctacatcgactggatcaacgagaaaatgcagctgtgatttgttgctgggagcggcggcagcgagtccctgcaacagcaataaacttccttctcctcgggcaaaaa

SEQ ID NO: 717925 - DNA, 207 bp, Homo sapiens
cggtttaaagacctaatcaagtgctcagcataatgaatgataaagaccaaaagggcacatcatgaaatttcagaatgtggggaaaacaatctaaaacatctcgagaggggcaaggacacggtatatatataggatatggtttcacactagtacagtagagctggaggcaatagaggatacctcaaatttggaggaaatgttataact

SEQ ID NO: 717926 - DNA, 922 bp, Homo sapiens
  misc_feature (922)..(922): n is a, c, g, or t
agcagtggctcacgcctgcaataccaacactttggcaggccgagacagaaggattgcttaagcccaggaattcaagaccagcctgggcaacacagcgagaccccgtctccacaaaaaataaaaaaaattagccgggcatggtgacaaacccatttagtcccagctactgaggagactggggcgggaggatcacttgagtccgggaagtcaaggctgcagtgtgccatgattgcaccacggcactccagcctctgtgacagagtgagaccctgtttaaaaaaaaaacaaaggtgtgtatcttccatggttacttaatttttacttcaaaagaaaacctgtaagcaatttttgaaccctagtttaatgacttgcatgcctaagtgtatgtagatcaaagctgaacacaagtgtctgcaattcatgcgcggaatgcttcagaaaattcacactgagttgatgggccggtaccgtgatcacacaattgctagatatgggcataacagcaagttaatagccaggtccaggcagggtggctcatgagtgtaatcccaagcacttctgggaggcccgaggtggccggatcatctgaggtcaggagttccagaccagtcccaccaacatggcgaaacctatttccactaactcaaaaactttagcccagggcggtgatgggcacttgccttggatatcccaggcgctggggaacggcttgcaacattaccagggcacaaacccacccacggcccgggttaatactggaatttcggtacgacaatacgcatttcgccactgtgggcccacgcttggccttgaaccgtctgatctccagggtaacccggatgcccatgtgctttcacaaggggcgggacaacagacgagttgagccccggtgcatgtgccacaaatttcattctcaaggtgn

SEQ ID NO: 717927 - DNA, 240 bp, Homo sapiens
aggtgcttcaaagtactttgggccagcaggagccaggccgtggcctgctgactgcatttgccaaatgactaccaatgtttagctgaaagcagagaacccagcaaaggattttgggaaggtcctgggggatggcagagccagcaaaaaaagggtatggatcccccaggcataggatggaacagagcactattgaccccagtgaactggggcatgggcaatcaataaacacatattagatta

SEQ ID NO: 717928 - DNA, 539 bp, Homo sapiens
ttggggcccattcagtgaggtgtacaggtgatagttctcacgagttcagatgataggaagcacatgccaaaaggtaggggcaggacagggaaaaagtactaaagcaagcccctagagtgctaatttacccatgtatggtaagattcaaaccaaaatacagggaacaagcagggtatgaggtcctagtaaatgaactaaatacccagaagtttccaatattaacattaacagaccatccaatattaacagaaacccagttcaagaaggtatgcagagagcctctttcagcttccagggctcaagacggaatacaagttaaaaattttacaatttaaaaaaaaaacaaaggggaaattaggcctaaacatgttatgaagaatgaacagtagtgggaacagtgggactctaatcctagtgctccttacacacactatgtaacttaaataatttaatctctctaaagcctctgtctccttatctataagagagaacagttctgtccatctcaaaaaagtactgctgaagataacgtgagacag

SEQ ID NO: 717929 - DNA, 488 bp, Homo sapiens
caagtacaatctacagcattgaagtgtgagaatcatagacgctactgacaataattctgaaaaatacagtaaaaatgtagcaaaagacgaaggtaaagaattcgcttttgtattttgacgcatcactagaaatcactaatgtaactcaaaaaatatttggtgcaactaaacatagggaatctatcagaaaacaaggtatttcagttgccaaaacgtcgctgcatatactttttgacgcacgtggatcacagattctagtgccagaaagtcaaatctcaccagtcggagaagagctcgttagtttaaaggaaaaatcaaagtcctcgctgtaatttgctactgcttcaaaatatatcaaaaacagtgacaaagggaatagaaataatagtcagcttgagaaaaactactcctagcaaaagaaaaatgtctgaagcatcaatgattgtttctggtgcagatagatacactatgagaagtccagtgctttt

SEQ ID NO: 717930 - DNA, 468 bp, Homo sapiens
  misc_feature (82)..(82): n is a, c, g, or t
tggtgtctagagtgatccttctctgatcgctcgccaggtcgcgcgctcgcaagctcacggaccaccaaatgcatctcaatgnacacgcatggaacatgatgttacattcacaatcgctggggataaggctacttaacaaggaggacctgagagtactctggaaaaggagtccctggatttttggaaaatcaaaaagaacctctggctgtggacaaaataatgaaggacctggaccagtgtagagatggcaaagtgggcttccagagcttcttttccctaaattgcgggcctcaccattgcatgcaatgactattttgtagtacacatgaagcagaagggaaagaagtaggcagaaatgagcagttcgctcctccctgataagagttgtcccaaagggtcgcttaaggaatctgacccacagctatccccatagaaggaattcatgagcgatcagagaaagggtacgag

SEQ ID NO: 717931 - DNA, 473 bp, Homo sapiens
ctgtgtcgagagtggagaatagaatctgttttcaccatgttgaattatgagcactaacgggatatctacgttgacatgtccagtgtacagctattcatactgaaactctgaggcaagaaattgcttaatttactgaagtgtcaggagctaatggtctttcctaaccagcacccagttcctacttgctaggttgaattgtgaatgacgatcacccactttgaaaagggaatggaaatcaataggatgggctgggcctgcatgggattcactggaaggggaagagagcaaggtgaccctgaactagttcatgggtaaggacaaagacagagggacacagccaaaagaccagaaggccagaatgagaaatagcaaatgggacaaagatctaaatcaaaggttcatgccccaaagggactaagagaatggtgctgctgaacggtaagagcacaggccagctagaagggcttgagtag

SEQ ID NO: 717932 - DNA, 163 bp, Homo sapiens
gtcctagacaatgtactcaggtgtggatgagtggtggagtgtggccgtgagacacccagagtaggacgttcagaggctactgcaaacacaggtgtctgggctcaggagtggccgaggagatcaactgacatggtcaatctaaggggcggactatgtgtggggt

SEQ ID NO: 717933 - DNA, 215 bp, Homo sapiens
catgtagtgaggaactagatgggtacaacagtctcagcttcactgcaggtgtcccagtcagatccaggagtgggcgccctagcttggcttgctagtcctggtctagagctatgccactaaaatatctaatcctaattcttaggtccttgccggtgagatatgaggtcttagagtagagcgcagagctcccagcccttctcctcattacatggcat

SEQ ID NO: 717934 - DNA, 344 bp, Homo sapiens
ccgagatcgcgccactgcactccagcctgggcgacagagcaagactccgtctcaggaaaaaaaaaaaaaaaaaggtcccagtaaagcaatttttaaaagagcccaggtgtccgggtgtccctataatcccagcacttgggaaccctgagatgggagttttgtttgaccccgggatttcaggacgggccggggcaccataggggggctccctctctactaaattacaattaatttagccgggtgtggtgtcacttgcctgtcgccccagctactctggagggtggggctgaaaggtggttgagcccaggaggccaaggcagcagtgaccatgatggtccactgca

SEQ ID NO: 717935 - DNA, 177 bp, Homo sapiens
ctgaatcctctctgcttcgtccttcttgagtgcgtctcaaccacagtgcgtgaatccagatagtttctaaataacgaacaggccaaaaatcagtaaaacgagtctttttttgcaaaaaccaagttaccattttactgacacaattatcatttgtggggaaaaggcacaggctcgagg

SEQ ID NO: 717936 - DNA, 381 bp, Homo sapiens
tatgatcatgtataagcatcaccttttctctgcgcctcaccaggatgtttatattttgagtttataataatagccatttcgactggtgtgagatggttatctcactgtggtttcaatttgcatttctctaatcagtgatagagtttttcatatgcttgttggctgcatacatgacttcttttgaagtgtctgtttatgtcctttgcccattttaatgggattgtattcttcttgtaaatttgcttaagttccttatagatcctggatattagacctgcattgtttgcaaatattttctcccattttgtacattgtctgtttactgtgttgatagtttctttagatcgctgggttctaatggaacacagaaatgtaaacagc

SEQ ID NO: 717937 - DNA, 793 bp, Homo sapiens
ggcccacggcccgacatcgatgccaggtacgcaccgtcaccggcagcgcctgtaccagctcgtcagcacccggcgcgatcccgaccgcacgttcgcgatcgagtttctcgatccggtgtcgatgcgtacgcattcactttcggttgaacacgggcgccccgtcatccgcgcaccgtcttccacccgcattccgaaggagcaaacgatgaacccgattcccccccgcgatgccgcccgcgacggcgcgcggccatgctgcgccgcatcggcgcgatcgccgtccggccccaccgtgttcggcttccagcgcatcgtcaattccgccgaaccgatgcgcaccgtgcccgcgccgacgctcgacgaaacgcccggcgcgtcgcacgacgagacggccgtgttcgccggcggctgcttctggggcgtgcagggcgtgttcgagcacgtgaagggcgtgaagcaggtcacggccggttatgcgggcggcgcgtccgaaaccgcgcactacgcgctcgtcggctccgggctgacggggcacgcggaatcggtccgcatcgtctacgacccgacgcaggtcacgtacggccggctgctgcaggtgttcttctcggtcgcgcacgatccgaccgagctcaaccggcaaggccccgacgatgggccgcagtaccgctccgcgatcttcccgaccaccgcgcagcaacgcgcgtcgcgaccgcgtacatcgcgcagctcgcggcgcgcacgtgtttcccgcgcccgtcgtcacgcgcgtcgagcctacaagggttctatccgc

SEQ ID NO: 717938 - DNA, 195 bp, Homo sapiens
aggcgactctagagtgatccctaaaaaaaaaaaaaaggttattggctgatatttccacagtggttctggcttgaaatggtaaaatcccaattttctattgtaataccaagatttatcctaaattaacaataggcggggtttctaataagctttgcatatatggtcggtgtgtataatcttcgatttggacgcgtt

SEQ ID NO: 717939 - DNA, 337 bp, Homo sapiens
cggactctagccctcatctgccaggcaggccaaacgacagaccctcactccagagagtcagggagctatggatagtgaaacgggcctggtggtgcgatacagctatatagcaaacaccagtcccctcccacaaggcatcttcaattccaaaagtgaccctattctaaaattaccaagtggcaggtggccaggccaaaaatccatatccaatcagagctaatggactgtaagtagcgatttcctcatatatagctgcagcactgctatgaacaccctgggtcggtggtttgagatttatttaactaggagaggtcacggcaccccagcaccgcaagca

SEQ ID NO: 717940 - DNA, 456 bp, Homo sapiens
  misc_feature (339)..(339): n is a, c, g, or t
aagcaagtaaaacaaccccaagccccggattatgccaagaagaaacggacaccttacccagacctggacgtgaagttgattgcaatacattcatcgccattcacctctcctcaaccagcggcaccatcacatcacgcgaccaggaaaccatcacctgttgtccggccgtgagcgtggcaggcagttcttcgcctgtcatattggcctgacttacaagcagtttttcaccgccgttcaatttcagttcaaaacgagttgccgcgccctgatattgcaccgcctggatcgtgccattggcctgcagttcaccaggggtgttgaggcggatatgttccggtngcagggcgaagcttcccgtcatgccacaaagtttctctgccatcagtccattaaaaacattcgatgtaccaacgaacccggcaacaaaccgccgtcgctggcggcatatagagattg

SEQ ID NO: 717941 - DNA, 308 bp, Homo sapiens
  misc_feature (247)..(247): n is a, c, g, or t
  misc_feature (279)..(279): n is a, c, g, or t
  misc_feature (288)..(288): n is a, c, g, or t
tgaagctcagagaagttaaggaactcactgggtgcagtggctcacgcctgtaatcccagcactttggcaggccgaggtgggtggctcacttgaggtcaggagtttgagaccagcctggccaacatggcaaaaccctgtctctacgaaaaatacaaaaattagccaggcgatgtggcacgtgcctgtaatcccagctactcaggaggttgaggcacaagaatcgcttgaaactgggaggcagaggttncagtgagccaagatcatgccactgcacttcanccagccttnggtgacagagtaagaccctt

SEQ ID NO: 717942 - DNA, 230 bp, Homo sapiens
agagtatcccgatcttctgtgatgacgcaggacgcatacatagttggcttcatatatgcaattttcaacgtgacggtctgcctaaccaccccgcactgacaaaaatcccatgtgctaaatataagaggaataatattttcagcttgatcaaccttcatccataattacagctttgccatgtctggaccaggtaaagatgcacagcaacaggccaagcaacgcaaccaagc

SEQ ID NO: 717943 - DNA, 689 bp, Homo sapiens
ccgccccagccctgtgcgccaaaggatatcgtatgttcatggtccaaacgctcggggctggtgctggctgactttgtgcgaagtcgtgtggtccccgaccggtgaggaatggcgtgcagcggcggcggctgtgtgtgcggcgacgaggatgggagcttggtgcatgcctgatgctgatgcctggcccctgctggtgcaagagatgggctggatggctgcgtgcctgcgtcctgaagtcctgccctggtatgccccgctggcggcccctggtgacgcatgtgggacagctgaggctgcccagtggcgctggggatggctgccggctgcgcatgtggtggccccccgatggcccatgtcggagccagggtgcctggcgctgggagctccctgctggacgtggcggagccgggaggccctgggctggctgcccgagagtgactagcgagacggtgacctgctgtctcttttcggagcgggacgccgccggctgcgccccgggacgccagagaccccctggccggggcggccctggagccggcgggcgtgccgaggcggagtcgcgaagcgcgctcgcgtgtgctgctgctggagcaggaactcaaaccgtcacgtactcgctgctgaagcggtcaaggagcgctcgctggacacgctgctggaggcggtgagtccgcggcggcgtgcgggcg

SEQ ID NO: 717944 - DNA, 90 bp, Homo sapiens
  misc_feature (27)..(28): n is a, c, g, or t
  misc_feature (61)..(61): n is a, c, g, or t
tctacaaaacagatagagaaaagtacnncagaaactagctcgggaatggactcagacgtangcgatagtaagtctaaagaagtctattcc

SEQ ID NO: 717945 - DNA, 1487 bp, Homo sapiens
cgttttctgaagaacgcacccgtctctactatctccaccttacagcctctggacgcctgtttctgtttctcacgaggtagtggagtgttctttcgagctacaccccaacaacagcaggcggggtcgtgttttagtctccagcccactgcctgtgtagccagcaccacgtgttgctcagggtcgctcttgtttgagtagacgcagtggtgccccgtgcctgttgtggaggtagtacgcccctcttgttgtctgggttgttttctgttgtctcagcgttggttcatcacgcggagccgccagttttcctcccggcttctctcctgtgttgggtttgtcttcgcggttgttacccctgctctgtcgcgcctcttgtggtgtaggagtcaccctccgttggtcgtccaccacctccgggtggcccctctgttgtggtacccctgtgggttcacgtcaccgcgcgctgccactcttcttacctgttgggtttttatccccccccacatgattttgttgtgtggcacgaacccccttctggggggtacaacacaagcctcctagtacccccctcgtggcgtttttttatgaagaaaaagtgggggtcgcctgctcgtgcggtgtgcggccgccccccaaagctcgcttgtggtgaggtcgttcctctgcacgaggggtgtcccacccccctgtgtgctcccccctcttgacagcggcgtggtgctacatacccccctcgtatgatattcctttggggggaccccccccgccaccgcgggttacgcacctctcctcccggtcgctcgaagatgcttttttcgacgccctctttggtgcacacacactgggggccgcccttccacgcggctcttccctctcttcgggtggtcggagaacatttttccctctccgcaaagttgtttgcgaggagagattggtttgccccccccccgcgtgtgctctctgggagacctcctgggtggctcctctttgtgtctctcctccgggagggccccacgcacccgcacagaatgttgttccggacgccacgacggccctcttttttacccgcggctctctccacaacttctggatgttgtgtctccccggccaccccagccctcgtggtttggtgttgcaccccgcgttgctcctccgtggggcccacacgtgtcctcccgcgcgcacgcataggacccccctttggggctgaatcctcctctcggtggggagacagactctttccccgcggctctcaagccttttcccctctcatgactcgggccccccccctgggttgtgatgtccccctctcctcccccacgcttcttgcagccgccgcccgttcctcatgtgtggcagcgtagggggggaccccacaactgtgtctctgtcccctggtcttccacacgaagcgggggagcccccgggggggggggggggggttttttgtggaattttttaaaaaaacccccccttttcctcccccccca

SEQ ID NO: 717946 - DNA, 291 bp, Homo sapiens
  misc_feature (12)..(12): n is a, c, g, or t
  misc_feature (76)..(76): n is a, c, g, or t
  misc_feature (174)..(174): n is a, c, g, or t
  misc_feature (248)..(248): n is a, c, g, or t
  misc_feature (274)..(274): n is a, c, g, or t
  misc_feature (286)..(286): n is a, c, g, or t
ccgcctgctttncccccacgccgccggaagccctgcacacgatgcaggaagtgggagatgctctgggtgtcggggncctggtgcaccgactccggctcactgggtgtccagcagcggggcggtgagcaccgtccagcgcactggctctggcggttcaggaagccagcttggccnggacgtctgagtactcggccttgctgtcgttggcgtctgctgcataggatggctggggagatgccagcttcctnttcgccgccgtcgtttttttacctcngcatggccatgnggccg

SEQ ID NO: 717947 - DNA, 118 bp, Homo sapiens
aaaaaaagagatgagccggtccgaagcgactcgtaaggggtggatttttctatgtagcgtgagtgtggtagtcaaaatgtaataattattagtggtttccgccgtcggggtcatcagg

SEQ ID NO: 717948 - DNA, 490 bp, Homo sapiens
actgctctatgaaaagcaatgttatactctgggagttgaacacaagcctcacaaaggagtttctgagaatgcttctgtttactttttacgtgaggatgttcccgtttccaaagaagtcttcacagagttccacctatccatttgcagatgctagcaaaagagagtttcaaaactgctccatcaaaaggaatgttcaactctgtgagttgcatgcaatcatcacagagaagtttctgagaaggcttctgtctagattttatgtgaagatatggccgtttcgaacgaaggccacaaagcgctcccaatatccacttgcaggtcctccaaaaagagtgtttcaaacgtgaactaccaaaggaaggctcaactctggactttgaatgccaacgtcagaaggatgtttctgcgaaagcttctgtttagttaggtgacgttatcccgtttccaacgaaatcctcagagaggtccaaatatccacctgcagagtcta

SEQ ID NO: 717949 - DNA, 185 bp, Homo sapiens
  misc_feature (28)..(28): n is a, c, g, or t
  misc_feature (177)..(177): n is a, c, g, or t
atgaggctgaacgggatgttgtccaggntgggcattgtcaggaaagctgcagagttattgaaccacttggtcacctttccctgtgggtccaccaacttggcccccaggtagagctgagatggtgtcaccctcgagtggcaggatacagaatggtcaaactccatgacggtcaatgcntgagggaa

SEQ ID NO: 717950 - DNA, 243 bp, Homo sapiens
tcggagggcgaggggctgcgagaggcagggacccggaaacagcgtatcactgagaccgagtcggcttatcaggagctccaggctcagaggtcggatgtctactgcgacctcaacacacagaggccgtattacaaattagccctaatcatgacagtcagcaacatgatacctggatccagccattcctgaagcccaacctggacctcattccaagccctaccgcgatacatacccacagagtgc

SEQ ID NO: 717951 - DNA, 437 bp, Homo sapiens
acatggcggtcgattttacaatcgatcgttgactggtgacaaccctgtgtgggagcccgacgcgggcggatcacgaggtcaagaaatccaaaccatgctggctaacatggtgaaacgccctctctactaaagatacaaaaaattagccaggcgtggtggtgggcgcctgtagtcccagccactagggaggctgaggcaggagaatggcgtgaacctgggaggcggaggttgcagtgagccgagatcgtaccactgcacctccagcacgggcaacacagcgagactccatctcaaaaaaaaaaaaaaaaaaaaattcagatctcgtgagaactccctcactatcatgagaacagcagggggggaacgggcccccagtgatctgatcacctcccaccaggtccctcctttgacacgacacatggcacgcgacatcgccg

SEQ ID NO: 717952 - DNA, 1151 bp, Homo sapiens
  misc_feature (299)..(299): n is a, c, g, or t
  misc_feature (372)..(372): n is a, c, g, or t
  misc_feature (501)..(501): n is a, c, g, or t
gccagagacgataggtgtcgtgaaaaaataaccctaaaagccagaaatgggactgggaagcgactcatatcagacattgttcgctctattggcatcacggtaagacttcgaggctaacgtcgctacctacctactggtctagtcgtgatctatacatactgcggtgtgctatctgcacctacatacacgaaccgattcgcacaagaactttgaagatacggacgtgcctagcatgatactgtgcgaaacacgagtggcctcccgtgtacgaagttactgaccgtgggcgctacctatgngcaatacataacctgggatagacgtcgttgcaagccggtagtagagcggattgcgctcaatccatcgccattntcgtagtaagtgcgtgcacattagttcgcgaaaagacttgtcgcacgtaacacaaagctagaggataacactaatgttggaaccgtgagtctacttagtcatcgcacccgatgtgcacaactaggaaanggagctctctaatccacagaacaagtggcattcactattgggaacgagtcgtcccaggcaatgactcgtcgcattgctcactttgtatttggttgcgttgccttgactaggttcgtgcttgagactttgttgacacgcctgggttcatacgtcctcgacaggacactgggtggcaagaacgctcgcatggagacctagtgcgccctcttctcgtccatttacgaccatctcgagcctgttagaacaacatacctcaaatgcgttcgccgtgcttttgacccaatatgatggcatttcccaaccttgcagcttccgagcctctcattagctcacgagaggcaagcattattgcgagcggaaaaattagttcaccggggaaggtcacgagctcactttgacaatttacatggacacacactcgtggcattacatcccccggacccctagataagccatttttgtggcgcatactcttccttggctttgtgacacttcggttgcactacatgctttgccttgggaagcccccattgttgccttaaacaattggcccttgaggtgtccccgaggggagtgggccaactggtgccaccccggtaaacagggactccgccaatgtccccgttcgtggcacccacggttggccttga

SEQ ID NO: 717953 - DNA, 222 bp, Homo sapiens
agtcttactacacgctgtaagacaaccttccatggagcaggcaggaaaacaattgtcacaacgagacatagcacacagaaggacaggcagctgaggaaaccagtttgcaccgcacactgacctcaggatacctagcctcgtacctcttctccgtccatggaatctatcatgctacacaccctcgaaaggtaattgacttatttatgtgtctaatgatctcga

SEQ ID NO: 717954 - DNA, 246 bp, Homo sapiens
attcgcggccgcgtcgacaatttattaaaaacctttgatattctgctttgtaatcaatcattttctcttactggaatgtttatgaaacacaaattgggaaattcgtaggaaaatgatttcatatttaaaaacaacattatgttatgatttcataaggtaatcccaatagcagtaaccgacaaacttaagttgcttttttagattcaagagagctaaaatagctctttatatttaaaacaaaacgat

SEQ ID NO: 717955 - DNA, 128 bp, Homo sapiens
gcaatctccccatgaggaaagcaagcctgacccaccgttgacacattcagctcacatggaaccaccacaggcaggccctgtccatctgagcacacactgaatgtttttgcaacctccttggtataaag

SEQ ID NO: 717956 - DNA, 137 bp, Homo sapiens
gggcagttactcctcctcctgaatatagtggcactataaatgggtggacaggtggatggatagcataggtcgatggaaggacagatggataggatagtagtaggtagaaagggtgtatagtatgtatagtgtagtat

SEQ ID NO: 717957 - DNA, 201 bp, Homo sapiens
cccgtcaatttctacacatgatggattttgtggatatgtgttgcctgtgctaagtgtgttttgcacatgtttttaaagcagtttgtgtttggactttgcaatttctgggcaaatggtgtattttgcagttcaatcacagtcacccaaggcttgctaactgctgagtgaggcttgaaacttgcaagtggtgtagaaattgaa

SEQ ID NO: 717958 - DNA, 154 bp, Homo sapiens
gcctggaattcctgctgctgaaggttcggtgctttgacagattgccttggacttggtcagaagcaagaagttatcatcaccaatttcctttgtaaaggacctctgttgaagaaaattttgctgaaaataccaaaccaaaagggtggcctttcgc

SEQ ID NO: 717959 - DNA, 349 bp, Homo sapiens
tgtgtgtatgtgtgtcagtgtgtctgtgtgcatgtccatgtgtatgtgtatctgtgtctctgtgtgtctgtgtgtgtctgttcacatgcctgtgcatgcgcacaggcatgtagtgtgttccagtcagttccattggagttccaggagcatgggaagagcgttattttcaaagctgtgaatgatagttacattatttttctctcataggcacccacagaattattaagaggcttccaataaaggacatctccaaaacagctgtgattatggtcaaatagtggtgactggtggatttattttctgtacattttctgtcgacgcggccgcgaatttagtagtagtagtagta

SEQ ID NO: 717960 - DNA, 585 bp, Homo sapiens
ttaaattaaaatagagaggtaggcaccacagatgccagaggaccactgtggtttttggtggacggccccagaggaattcagggttaaaccttgagtgcctgcgtccgtgagaattcagcatggaaggtctctactatttcctgggatttctgttcctggttgcaagattgccacttgatgccgccaaacgatttcatgatgtgctgggcaatgaaggaccttctgcttacatgagggagcacaatcaattaaatggctggccttctgatgaaaatgactggaatgaaaaactttacccagggtggaagcgggaagacatgaggtggaaaaactcctggaagggaggccgtgtgcaggcggtcctgaccagtgactaaccagccttggtgggctaaaatataacattggcggtgaacctgatattccttagatgccaaagggaagatgccaatggcaacatagtctatgagaggaactgcagtgaggctggttaatctgctgatccgaatgtttacaactgggcagcatggtcagaggacagtgacgggggggcaccggcaaggccataatcggtttccttgtggg

SEQ ID NO: 717961 - DNA, 236 bp, Homo sapiens
tctaagacttacggaatggagaaatttgtatctacccatccaacaaagatctatatcagaacttacaggaattaaatcaaatttacagaaaaaaacaatccataaagtcagcaaggatatgaacagacacttctcaaagaagacatttatgtggccaagaaatatgaaaaaactcaacatcactgatcatcggagaatgcaaccaaaccacaaagagatagcatctcattcccagg

SEQ ID NO: 717962 - DNA, 1187 bp, Homo sapiens
  misc_feature (23)..(23): n is a, c, g, or t
  misc_feature (102)..(102): n is a, c, g, or t
  misc_feature (1187)..(1187): n is a, c, g, or t
cgctctgtgcgcatctggtgttncaccatgacagctgactgccacccatgtgtcccacatataccactgcatgctccactgccctattcgctcctcgtgccnctgcaaatggtgcaccctgcgacgacgagtaacgactaacctacttataaaagtattgtaccttattgtggagcattcttggttgtatggaacagagtaatctacctgtactacgaatttactacgaaattgagtattaatctatggaacagcaatgagcacacatatggtatgtacgatgttttgcaacaaagaatgcactccatgtgtttgattgtgacaatatcacatcaaatggcacaagcatatagtggacacaatgcaatgtggcaacatgatgctgatacctgatgtctataaaacaatacagacataatatatacgttggagcttgtagtgtgccttaataatgggtttaatggacatttgctaaaaacaatctcacattatgaaaattgtagaggctgatgggcttgaaagaacttgatgatgatctatgtcttgatagtaaacaataggtaatcatgcatatgtgggcaaataagagatgatactatgtcaatctcaagggcaagttacctacagatgaaagcaagagcttttgtctaaatgaatggtttgtacatacataagaaaaattcggaccatagatctacaatttgtttgaagactgattatcaggacaatatttaaaagagacttacctgaattgtgtctccagatagaaagtgtagacaagaagagaaaatgaattgtattccaatgacaacaaatgaggagtccatataccaagttcaccaacaagacagtaggaaaacaaggccaacggtggcgttggtcggccagacactttctacttgacttattctctactccttataggttggtcgtctacagcacttacacatgaggggagagagtagaaaaaaatagaggaattatatgagcaaaaaggggaaaaaagaaaagaaagaagagaatgcgaagtaataatagatatataaaatgtatattggtatagtttcgtattattgtggtagtgaagtaaaaatagaggtggagcacaagacaaaatatacgttgtttgtttttttcgtgttttttttgcttttttgttttcttgctggttgattattgaagagtgn

SEQ ID NO: 717963 - DNA, 139 bp, Homo sapiens
gggcgcgtggtctacggccgagtgacaaagacgctcaggctgtgttctcaggatgacccagttggagacaacagcacacacgccgttgcacgagagacccagagcactcacagctctctttgggagtgtgaggcacccc

SEQ ID NO: 717964 - DNA, 305 bp, Homo sapiens
aggtctacaacatggcatcaactctagggaccccaggtactaggctattaacactggtacatgactgaggacgagatgtctaggaaaaacatatctaactacataaaaaaaaaaatatgaagggaaatctattcaaaacaacaaaaaaagatacaccaacaatacaaaatctagaatatttactggtagaaaatttactgtaagaaaactatagtgtttcacttaaacagcataaggttaaggaaatatgatttctttctaaacatcagttaaagtgcaactgcacttctagtgggtagagcatt

SEQ ID NO: 717965 - DNA, 957 bp, Homo sapiens
  misc_feature (38)..(38): n is a, c, g, or t
  misc_feature (66)..(67): n is a, c, g, or t
  misc_feature (932)..(932): n is a, c, g, or t
  misc_feature (939)..(939): n is a, c, g, or t
gatgaggcagatctactggagtggagagtaacctggancagatcgaggtggccaagctggatgggnncctccggaccaccctgctggccggtgacattgagcacccaagggcaatcgcactggatccccgggatgggatcctgttttggacagactgggatgccagcctgccccgcattgaggcagcctccatgagtggggctgggcgccgcaccgtgcaccgggagaccggctctgggggctggcccaacgggctcaccgtggactacctggacgaagcgcatcctttggattgacgccaggtcagatgccatttactcagcccgttacgacggctctggccacatggaggtgcttcggggacacgagttcctgtcgcacccgtttgcagtgacgctgtacgggggggaggtctactggactgactggcgaacaaacacactggctaaggccaacaagtggaccggccacaatgtcaccgtggtacagaggaccaacacccagccctttgacctgcaggtgtaccacccctcccgccagcccatggctcccaatccctgtgaggccaatgggggccagggcccctgctcccacctgtgtctcatcaactacaaccggaccgtgtcctgcgcctgcccccacctcatgaagctccacaaggacaacaccacctgctatgagtttaagaagttcctgctgtacgcacgtcagatggagatccgaggtgtggacctggatgctccctactacaactacatcatctccttcacggtgcccgacatcgacaacgtcacagtgctagactacgatgcccgcgagcagcgtgtgtactggtctgacgtgcggacacaggccatcaagcgggccttcatcaacggcacaggcgtggagacagtcgtctctgcagacttgccaaatgcccacgggctggntgtggantgggtctcccgaaacctg

SEQ ID NO: 717966 - DNA, 410 bp, Homo sapiens
  misc_feature (71)..(71): n is a, c, g, or t
  misc_feature (112)..(112): n is a, c, g, or t
  misc_feature (213)..(213): n is a, c, g, or t
  misc_feature (239)..(239): n is a, c, g, or t
cacctgtagtccccagctactcaggaggctgaggtgggaggatcatctgagctcgagaggtagaggctgcngtgagctgagaccataccactgcactttagcctaggtaacnaagtgagactctgtctcaaaacaacaaaaccccataaaaaaacaaagcaaaaactgatggctcctcagtcagtctattagccttgttcttccctggggttncctgagggatataaacccatgccccnaggcacccatttctgattcctcctctcttttgcagttagaatggttctctgagcatccttggaagggatgaggggctggcacagtggctcatgcctataatcccagtgctttgggaggctgaggtgagaggatcacttgaggccaggagtttgagaccggcctttccctga

SEQ ID NO: 717967 - DNA, 423 bp, Homo sapiens
tcaccatcttgatgccccttatgcaggtcagggatgttcacaagaagtggccgtgcttggaagatccaggtactgtggatcatctccctcctcactcagactcactattccacctcggaatcccgacacggttgtcaggaagcgtgagaccgcaggagaccacaaagctactggctgtgatttcggtcccagcattctgcaagtggccacaagcaggagtaatgagggagtcgtctctcctgtctcggtattgctggtcacgggtgtgctggtgctggtggtggtgatgtcccagcgagtcacttcttggtggtcgtactgctggatgctgatcagctggccctcgtctatcacaccaggcttcaggcctttgatggtcgttgacctttagtggcctggtatggtagcttccttccaacggcc

SEQ ID NO: 717968 - DNA, 1512 bp, Homo sapiens
gctctgttcctccttgcggtgtctgaagatatgatcgccgatcatgaagcgagcatccgtgagactatcgcgctagctatgaaagttacatagaccagatccgactagcttcagcaggatgacgaaatgggtcatccgagtgtcctctcaccccgtggaaggctgatcaggtgcctgaagcactagtaagattcgggagaaactagcctgaaatgtacaagacgcactagcgcggatgtcatctgttgccatttcggaattcagcaactgcattttggtgtgctggtcagagacagactgcgattttggctatgatgttatgacttccctgggattgatgcatagggagagcatatgaatgccaaagcatagacttgcacagacatggcctgtactgagaagaaaaggacctcacgaaagcaacgaaacggaacgctgagaccagactgccgacacgtcagcgggactgcaatagggcaactgtcggtgctggcaaaaagccgagaggatgtcccggtgctgcatggtgtagcgtgtgcgccactggtgtgactgtttcgcatgaactgttagtaaacgtattgaactttccggtctggctacaagctgcagaagggcctaaatttttggcgccggggccgcgaccaggttgaaacgctcctgtggagcccagcgctgaaaatcacagatcaccgttggtacggaccggccgatgtggggaccccatgagaactcagggcgcgcgctgtggcaaacagggagttcagcttgggaatccaaggccgattacctacacgcgcgcacaatatgaggacacacgatgttaatcaatgtgagttgctaccgctctgtgtcgtttttttgcataacatatttcttttcgccctaaacacacccacacgcaattagtacacgtagctcgagccggcaactctcgaacataggacaaggacggggagtgtgggggtggggcgaaggcgtcattccggccgcggcgtggaggacgggcggggggaaggaggagggaacgacggcgggcccggcgccgacgcagcaagacacacgccaacgcggcaggagagagaccagacgacgctggccgcagctgcaaccagaccgcgcggcgcagcgcagacccaaccgcagccacctatacccaacgaaataactaacaacaccctcgacacgcaacgagaacgcacaacacaccacctctacacccataccgaaaatcacgctcttagcctggcgctatgcatctatatcaatctaagtcccatcgggacagggaggggtgaggcggcgtacagcggaggagccagggctgggcagcgcggagcggctgtgcaagacgggcgacagcgagcaggagggcgagcccgagtgcgcgagaaggaagcggaggagggaagagggcgggccgggcgcgtgcgccgaggacggagcgtggagaggcgggcggcagcggcagcgacggacgagcgggccagagagacgcgacggcgcgagagc

SEQ ID NO: 717969 - DNA, 127 bp, Homo sapiens
agaagaaaccagatagtagaggctaaggtagaggtgggctacgtagcctaacagtcccagagctctggggggcaccaaggtgggatgggaagatcactatgatgccaggcagttcaagaaccaaccg

SEQ ID NO: 717970 - DNA, 1077 bp, Homo sapiens
gttccaaagggtgtctgctttggccaggcgcagtggctcacgcttgtaatcccagcacttgggaggccgaggcaggcggatcacaaggtcaggagttcgagaccagcctggccaacaaggcaaaaccccgtctctactaaaaatacaaaaattagccgggcatggtggtgtgcgcctgtaatcccagctactggggaggctgaggcagaagaatcgcttgaacccaggaggtgaggttgcagtgagctgagattgcaccactggactacagcctgggtgacagagcgagactccgtctcaaaaaaaaaaaaaaaaggggagggctgccggcttttggtaccttgaaaaacgggacttctatgttatttgtcctcagggttaaattttttcccaataaagttttttaaagggaaaaaaaaaaaaaaaaaagcaacaacaacagacgacactgatccacgcacacaaaccacagaccaaaaagaaacagaacagcaacgcataaagagaaccagaaaaaatgaagcgaggcccaccaaaagacaagaccatggcaggggccccggaaaacaatctacttaggcgcgacgacgcagacatagaccaaagggaccagccctccatggcagagcagacaacaccagcaagaggccggaggtcggcagccacatcgacagggcgcagagcacgccagcacacggaactggcgagccacactggacgaaacaggcaccaatggcggcggacacaaccaacagcggagagagaaccgaagcaaagacacagaagacgcgcaaacaagaacagacaagagacgcgcggcaagagacgacagcagaggagcggggggcgcacaagacagacagcggacgcagcgcaaaggaaacaagatcagaagaagagtaagagagacgggcaacgacggaacgaacgcaaggccagaagcacaagcacacgacgcgacacaaccgacagccggcggaacatgcaggcaagcgcagccggcggacggcgaccccgacgagcgacgaacagcccgacgagcgcagcccgcacggaggggaggcgaggcaggagcca

SEQ ID NO: 717971 - DNA, 307 bp, Homo sapiens
tttgttgggcctttagccctaaaacctgcaggtggtgggggcggctaccaaaaaggaacaaaggtttttggggaggagtttgggtggtccagcccttatgattggccccccctcctgttgccccataacccttttttcatttggggtttttcatttaccctcatttagagccctttgcagagatttaaaaaaatttccagtaacgaatggattcctatataaagattatttttttactttttgcagcaaaaggaaattgtaatttttgtccagggttcaagtgaataaaaaccatgcctaaggctta

SEQ ID NO: 717972 - DNA, 380 bp, Homo sapiens
gcgtcgtgagctgggcatctgactttgggctgggcatctgatgtgggctgcgcttcacctactttttgtcctcgtcagtgcgtatctattatttacttttaagaagatgccccgcagatatgactcaagtgatgaaagcacttgaccgcgtgcaagtggaagacactcagccccgcgagaggagggcggtttcgtaaacagatgaagcccaaggtgggccggcggcgtggcagagcaaatgtgttggggctggacctgggagcctccactcagactcagccagacctgctgggctctgcggagagatgcacatgggtgcccgcaacatggccagggagcaaatgtgggaaggcggggaggccacgcaggaggagaccctg

SEQ ID NO: 717973 - DNA, 863 bp, Homo sapiens
tgcggactcggtgcatagtaggtgatgagtggcgagtacgttgaagtaagcttccataatggatgtgctagaacttcatgtaatctcgtattggtagatagcagtggcgatctggatagcttcccaagggcgatcggccccagcattgctgacgttaaacaatcgagtgacctgctcgaagttgtgatgtgcttgatcgcttgtacaagaatgtagcgctggaggtcgcccgatggaccatagggcgagtcttaacttgtataactcgtcaaggatgagcatcacgcaataataatcataatcgactggtggacacatagtatcttcgcaactctcttgaccaggttgtgctcaagcgctgcgactccatggactcttggtgtaggacatttggccaaaagtccacagaaggatgtcgtagaggtgtgagtgaatgggtgtgcatcatcaatctagatcgtatgttggaatgcagatggtttgtgaacgagaaagtgaggaagctaattggttggaggagagggtatggcgggggcatacgagagttagtcattcgagatggttacgcagcgacaggccaacacaggtgagtagcttaaataaagataacaagaagaattgtctacagaagtgttggaacgaaagggcataattcacaagatgggagctagagcgacatgctgttgtcaacaacgttgtggcccatggaggggttgcattgatctcgcaagagcatgagatgtgccgaggcaatgaatagattgtacgattagggtaaatgaatggtgggtggtggggaagtgatggtgctctgatggattttgggtgaaaggttaaaatggttggaatcgagaatgtgtcag

SEQ ID NO: 717974 - DNA, 155 bp, Homo sapiens
atattgtgacagatgattgactaagcatttcacacccttcaattactccacatcaagaatgaggggaaagcgtagtaaaagtagactactgccatgctacttatacttcttgctatagaaccaggaagcatccatatcaagagagttatcatctc

SEQ ID NO: 717975 - DNA, 295 bp, Homo sapiens
gcacactccagctggtgcacgaacggtggttgtggcaacgcccattgctgagacatcactcagcatatgagggtatcatttatgtgcttggatccagtattctgtacgcagaagagctacaaacaccgacacaggacattgactcgctcactgtcacacccatgcagacaaggcctcagccaatcagtgagactggcaagtgcaggtcgggtggcttgccggcaagtgcttccgcctgtataccgcctgggactatcagcacgagcttgaggaaaacacagtgcctgcgatccag

SEQ ID NO: 717976 - DNA, 311 bp, Homo sapiens
cccccgcgggagcagcggcaggtggatctccccggtggctcgctttgtttttgttttgttttttcttttaagacggagtctcactctgtcgccgagatcgcaccactgcactccagcctgggcgacaaagcgagactccatctcaagaaaaaaaaaggggattgcagggccaggtgcggtggccctcacttgtaatcccaacacttggagcggccaaagttggaggatcgcttgagcccaggagtttgaggctatagtgagctgtgatcatacccctgcactccaggcagggcaacaaagaccctgtttca

SEQ ID NO: 717977 - DNA, 996 bp, Homo sapiens
atttatttatattatattaattataatgctaaatattagtttattttatcagtttttgtaatactatccagtataactcacttttagtgtaagtcgtccagtttgtgtacttcattccactatatgatttactgccagtagactcatacttagttactgcgagattattctacttgcacatagtttgcatatttgtcaggtactgagactcttgttcccgaagctctagatagattatactctattttctcacagttgtgtcccgtttaaaaacattctatgagccaggagaagagattacagtattatcctgcatagccaggtgcttatgtatttcctgagtgagggattatgaaatgtatattttgccactgattatagagactgttgttccatcaatcactcttgttctgttcatccttattgtattgtccattttctctagtaatcgttagtaaaatatggagctcgattcgtatatactaagttatctgatgtataaccaaacacagatctattattttattttgtaacattagtagtcttaatcttatatggttactcaattttcaccattttgtctcattcttgattgattaacttgaactctctgaatctttttcttttatctctatccatctattattgccctctacaatctcatacttttcctttagtaacatcttgtatattcttattattattttattaatgtaacatacggtcttcatcttagttacaactatattgatatttaaatgttcttaccctacatttccaattttaagataattatttctactatactcttgtacagtttacataataaggtgtatttattttaccccgcattgtagttagtttcaaacttctcttcactatttttaaccctaccactcatgcttttattatttaccgtatattcgatttcattacctcgttcactttatggatttaagactattctctaatgtatatttcttcaggattatcaat

SEQ ID NO: 717978 - DNA, 371 bp, Homo sapiens
acggaaccagatgtcccttctcctagaagggtctcttctggccttagctggagtgtcctatttatgtgtccaatattcattatctactttatactatccttgtactgaggctactttatacaagggaatacgaaaagacacattcgtacctttgggcacaggaactggtacctggacttttttaatgttgtacttgtaactgggccctctggcccaggagtatggctgtgtgtttatcctctttgtatagcctggttcctccttcttctcgtttgcctttttctgcttctgctgcatgatctccgagtccctctgcttgcgggcggcagaagaaagcccgtcatctcggcgctttcccttaaccgagtcgc

SEQ ID NO: 717979 - DNA, 339 bp, Homo sapiens
  misc_feature (5)..(5): n is a, c, g, or t
ctttntaatccgcaacatgtctgtcatcgcccacgtgaccatggaccgtccaagtttgacagactccctggtgtgcaaggcggcctcatcgcctcggccgggccggcgagactcgcttcactgatacccggaagcacgagcaggagcgttgcatcaccatcaatgtcaactgccatctccctcttctacgagctctcggagaatgacttgaacttcatcaagcagagcaatttttgtgccggtttcctcatcaacctcattgactcccccgggcatgtcgacttctcctcggaggtgactgctgccctccgagtcaccgatgacgcattgatggtggtg

SEQ ID NO: 717980 - DNA, 776 bp, Homo sapiens
gagcgggcgtgtatgtagtgtgtgtcccgagaagcggttagatactgagactgcatttgcctttactgtggagtttggttgccggttatgctccctaatcttccttttctgacagtgcctgagcatgtgcagatgagaatctgtgagatagcgtgagctgaaaacaggtttatattgtcagagacatgccaagcgagcggacagacgggggcacagaatcactgaaggggaaaaatacagaaaatatgggtttctacggacagcacttaaagcatgactttgatagcaaagatgaaaacgaaagttggaggcatggtgtctgaggtccggcttcttatttcttagggaaagaaaccatgcaaagtctcaggaatatagaaagtagccactgggactatgtaccactgtgcagcaaacacaacaacttttggggaccgtcagagcagccaagtggccaagggcaaacaacgacgccgaattacaatctgtccagaacagctaccaggctccaggaatggataaaaactgtttcaagagactggacgtggaccagagaaacttgcgttgctcttagaatgaactcattgctagttgtgaaaccaagaacaagtaaaacatatgatgcaagtgactagaaaccccaagattccaaacgaagcacttacaattcacacaggctccctaacaggcgatggaacaccacatgagcgcgcaacacccctggacacccaaagacaatgctacaaacacgacaaaaacggtcgctcactggagaa

SEQ ID NO: 717981 - DNA, 273 bp, Homo sapiens
  misc_feature (1)..(1): n is a, c, g, or t
nttacggaggtgtacgtgaccaccgtcttcgagaactactgtggcgacattgacggtggacggcaatgctggtggagctggcgctgtgggacacggtgggccaggaggactacgaacgcctgtggccgctctcctaaccggacagcgaggtcattctcatgtgctactcgggggacaggccggattcgctggagaacataccctagaagtgggtcccgagttgaagcacttctgtcccaatgtgcccaaatccgtactgggcctggggtaccg

SEQ ID NO: 717982 - DNA, 279 bp, Homo sapiens
  misc_feature (1)..(1): n is a, c, g, or t
ntaaatttgtggctgtgttgatggtgggtgcctgtactcccagctactcagaaggctgaggcgggagaatggtgtgaacttgggaggtggagcttgcagtgagccgagatcgtgccactgcacttcagcctgggagacagagcgagtctcaaaacaaaaacaaaaagcaaaattagctgggcatggtggtgcatgcctgtagtcccggctactcaggaaactgaggcagaccacaggacggggtcgacccggccgcgaatttagtagtagtagtcgacc

SEQ ID NO: 717983 - DNA, 275 bp, Homo sapiens
aactctggccaggtagcggaagcgagcggaaacgcttaccagaaccggaacgtgtcaagagctcttgtcctgatagattacccagcctcgggtatgcctttatagcaacacaaagggagtaagacacagctacaacgaagactggaatgttttaacttcatttactctccttcatgacttattggtgactattttcatgtattgatgagaattctaccttgattgaccccatagatatgattatattgactaaacaattagtggggtttttagga

SEQ ID NO: 717984 - DNA, 180 bp, Homo sapiens
taggtaaaggctctaagactcctgagccaactattatatgtacctggcttcctaggctggggcttgaactaatgtaactgaatgccaaggagtacatgatctagatcgcagagaagtcagtctcattctataaccattgcaactacctgttagacgtccaccccaatgcaagctgtactc

SEQ ID NO: 717985 - DNA, 535 bp, Homo sapiens
gggaccagagagaatggcatggactgctgtaaagggtcacagtgttggggccttgctgtacatgatcccaatgactcagaactacattctacgcacgctggcctggtgtcctggagaccccatcgtagcacctatgtcctctacacacggcgtgatgaactatgttgcactgtttcttgaatactatgcattgactctcccatcccccgtgacgactatctccatattcatcactactagatctctcctatggtggttaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttca

SEQ ID NO: 717986 - DNA, 351 bp, Homo sapiens
  misc_feature (147)..(147): n is a, c, g, or t
  misc_feature (211)..(211): n is a, c, g, or t
  misc_feature (277)..(277): n is a, c, g, or t
  misc_feature (301)..(301): n is a, c, g, or t
  misc_feature (322)..(322): n is a, c, g, or t
  misc_feature (331)..(331): n is a, c, g, or t
ggaaatccagctgaaccatgccaaccgcatggcgtgctgaggcctgaggaactacaggaacacccaaggcatcctcaaggataccagatccacctggatgatgctctccggaccaggaggacctgaaggaatagctggccatggtgnagcgcagagcaacctgctgcaggctgagatcgatgagctgcggggccactctggaacagacagngaggagcagaaaatccgcagaaccaggagctcctgggatgccagtgagcgtgttcaactacttgancacccagaacaccaaggcttgatnaacacccaagaaggaagcttngagacaagntattttccaaaatgccaggg

SEQ ID NO: 717987 - DNA, 123 bp, Homo sapiens
acaatgcagacagttctgtctgttcatgtacaaggtcaggaacctttgagctgcttccatgttggcagtctgcccctacctcaagacgcaaagcaaatgttagggtgaacggcatgtttccta

SEQ ID NO: 717988 - DNA, 309 bp, Homo sapiens
  misc_feature (4)..(4): n is a, c, g, or t
accntatagagagagagagagagagggagagagacaaggagacacacagagagaaacaaaagcaaagatcgatgcaaagagatggcaaaaggtcaggcgcggtggctcacacctgtaatcccagcactttgtgaggctacggcagaaggatgacttgaagctaggagtgcaagaccagcctggccaacatggtgaaaccccatctctactaaaccccatctctactaaaaatacaaaaattagccgagcatgatagcggacacctgtattcccagctactcaggaggcaggataatcttttgaacccag

SEQ ID NO: 717989 - DNA, 654 bp, Homo sapiens
  misc_feature (151)..(151): n is a, c, g, or t
  misc_feature (278)..(278): n is a, c, g, or t
atgaaccgtggaagtagggaaacccgccccctttccccgtgcaccaaagtgccactggaatccgggctctcaggaaggatctgtattcggcctcctctcccaaatggttaatgggcctggggggaggcccgctgctcttggggatataccngcgtggcgattaaaaggaagaacttcacctcttaccggagtgggttcttcggaaaggggacatgggtctgccttccggaagcagttgatataatctcgctttgtacgagtagcctgcatgcgctaanagcattactgctcttgctaaacgggaacaggcatgtcagggtcaggcatcactcgtgggcagatacatgcccaggctggcatcgagcggctggcatagaaccgatactggcacagcggtgtgtagtccttaggacacgcgcttattggcttacccgcaatcaatggcagctaagtacccatgacgtgtcactccctttcaagtttacaaagtccagcagggtcatcaaaattcacaagaagtgcactaggctcctgtcaacaacatacccagatcagctgcattatatgtacacgcccaacttttttttaaaataacatcttttgagtaccatgcaggactggacacaataatgacaatgtgtgcaagaaattact

SEQ ID NO: 717990 - DNA, 802 bp, Homo sapiens
  misc_feature (462)..(462): n is a, c, g, or t
taggcccccggagcgcctagttgccgcataagccccgcgagttcgtcagcacttgggaacattgccaggggccttctgctccttggaatcgcaaggcctagcccagcccgacacctcatagtggcaggtctctccctgaggatgctggaactaggctgctcaacggctgggggctgcgtcgcggcaatcgcaccgttctgacggatggaatggactcgcatctacggtaggccttccagcctcctgagtggacatgcgtacagcccactggataaggcgttcccgttcacaagctccagcctcagcgaatttcgaacgaggccaagaggctgtcagccgcccctggccgttactcgtgcttgtttggggaccctgaccattcaagtcttctggcaggactaattgaggaaggaagtataacgtacgggcattccgtgagatgcgacgaaggactagcgggcntgcccggccgatgcctcgcccagcgatcctcatatgtcccatcaccgattcatgcgggaaacagagctcctccgtatacatccacgctgtcgccggccaagacagtgggagcgcagccaccccacgtcacttgcagtcctggaggccagcccccactcagcatgtatgcctgggaaccttcgccctgcaaggcgtttgctatcttcagccactgggcggagctgcagccctggaggagggggagggtcgagactgcgtggtgatggggtctccgccaacacgacctgaccagggcagggctaggagctgaacagaagccagtgcctttaagtcaggttaa

SEQ ID NO: 717991 - DNA, 112 bp, Homo sapiens
agctgcccctcctttagagcaacctggtggtcccccggctcccgtggaggtcaccatacttgatgccgcaacttacgtgcggaacacccagagtcggcataagtcgcactac

SEQ ID NO: 717992 - DNA, 384 bp, Homo sapiens
tatagtcccagctactcgagagactgaggcaggagtgattgcttaacgcccagaaagttgaggctgcaatgagctgtgattgcaccactgcactctggcctgcgcaacagagcgagactcttgtcttccaagaagaacaaaaaaaaaaaaaataaaataaaaaaaagcaaacaaaagatggtcaggcagaaaaaaggggcagacagccagacaggtcacccctagaggaaggcgcacgcagacagaataggatgagatgagcagggaaggagaagtgaggtgcagagaggatgggaactacagattcagagtgggaggcctctgaacttgtacacagttccttgttccctccctaggtcagcaatctgaagatgggcttacgga

SEQ ID NO: 717993 - DNA, 1369 bp, Homo sapiens
  misc_feature (298)..(298): n is a, c, g, or t
  misc_feature (1130)..(1130): n is a, c, g, or t
acaccaggatgcgattgcccctgagaaataattgaccttacctgacgttgtacacttgcttggggttcgcttgtggactagtgtgccaacccgtggaactcttatcttgggtgaaggagcaggttgaaccccatatgaccctaaacatacggtcaaatacatctaagctcagtcatttcacaaggtagccgcagaatttcgtactatggtcattggacacaaggtcaatacgtagtgtacatatgtagcgtatcggtgtgtacatagctactacgcaatagtcgcgccagaggagccntcacctggaatatacatgcacaccataggaaagcacatgaatacactatgtacttgctgatgttctcgtgtaaaactcggagctacatagcgtggaaaactggacacaagtttggtgagcttaggtcaggataatatctctcgatgaatggacagaacacgaagaccgcaacctaagcgggcatatacctatgcggtatgcgctagaagaacacgtatagccccccacccggggaccgattgggattgaaatgccccaggtgccaaaaatccgcatcagaaattacccacatgtggatcgcgtcccaaacgtaacctcgaaatcggcgtttgagatttgcgaaattagagacctacaaattccgttatttgaatgtttggaaatcgaaatttgccatccaaggctgtgtggcccctttcttattggatgaccaaggaaaaaggagaagaacgtgaaaaccattattcctctaatgcaagtgaagacattccctattccgggggaaccgagttttagagcaactaccataggtatagcctgggcaatctacgttttgacttccaaattacgccgtcacacaatttagttaaaacatgtaacccaataaggaaaaacgatcattgtccttccaaaacgttgaaaagcaagtttaaggccccaacaggtgacaaattaagttctcccggcaacaatattttggcgacacatagggaaatagttgcatctattccgtcatcacaaagagaccgtacatcgggatggaagaacaaggcaccctaggaccatcgtttcggtgtccaaaccattaacgcttgtccatagtcgacgaagnaaagctcctctgttggaaactgttgccgtagccttggttacaacggaaagatcgcacacgtggacaacggcctaactatactcctttaatttcgtacactgggaatgcccatagcatgttccacatctctcaagtatctcaattgtcaagcaacgcccctttaacacacattcatcagagcgcacgcatattgcgtttctcacgggaacccaagatcctcttatgaaaaagcaggaaat

SEQ ID NO: 717994 - DNA, 416 bp, Homo sapiens
gcctgtagtgcatgtggcaacatcatagttcacttgtaaccttgatctcctgggttcaagtggtcctctcacatcagcttcccagatagctgggactgttggcatgtgccatgacaccttgataattttttaaatatcagttatgtaaacatgcaatctggctatattgcccagtcttcagttctacttcctctttcttttcttttttcttttacttttctttctttctttcgttctctttctttcttcttcttcttttttattttttccagtaagggggcaataggtcgcatttgtttgcttgaaagatttctttgggtgttttctgagattttgacgcacctttcttctgacctgtgtacagtgtaccctttgtgtagtcttttgtccctcactgccttccctttttttctctc

SEQ ID NO: 717995 - DNA, 336 bp, Homo sapiens
tgaaaatttggtccccctttttgtttcccccttttggtttttaataaaaattgggaaaaacttttttttggggttaaaaattggggggaaaaaaaacaaatttacctttttttataagaacctatctcacttataaaagttgtgtggtccacaatatagccaaaaatttggacccggtggtaaacccgtatgtagctcttattatcaaaaaaaactgtgtatcttgtggcactagtggggagtgatgatacgtgttttaattccactatagataattaatagtggtgtcctctcgtagtgctaatcatggcacaaaaaaaaaaacaagaagcgcgg

SEQ ID NO: 717996 - DNA, 329 bp, Homo sapiens
aattttttttttccccccttaaggcccaactattggaaaacatctcccctgtttcctatgaaacttgcttttccaggccaatcacccttgctcccttaaacttttttttttcctgaaaagttattctttttttttttttaaaaaacccccccctgccccttccccaaatccaagtgaaatagtgaaaaccaaaaacccacccccctctttttgggggtccttattaatgttttttgtttcccccccaattgttttttgcctgaataataaccccccatgtgggggtttgtatatatatccttttcccttaaaagggggttttgaaggta

SEQ ID NO: 717997 - DNA, 289 bp, Homo sapiens
cccccccccgctggttccgctcccccctggccggggtggtggtttgggcctgctgtcaaaaccctgggggggggggatggggccccccttagacccggaggaaacgggggtttgcctggggtttcggaaaaccccttaagggggggggccggcccaaccccctgtttcaaggggggtgggggggggggggccaacaaagcatccccccccctgggcaaaaacttttttttgttttttaacccccccggccccctttccccttggaaaaaaggggggtttttaaacccga

SEQ ID NO: 717998 - DNA, 890 bp, Homo sapiens
  misc_feature (232)..(232): n is a, c, g, or t
  misc_feature (737)..(737): n is a, c, g, or t
  misc_feature (739)..(739): n is a, c, g, or t
  misc_feature (743)..(743): n is a, c, g, or t
gtggacacggaacgtcgtctgtcgtcgctggcaccggtgggagctaggcgcgaggctcggagtgcggccagcgggcggaggcggtctcgcatcggcggcgacggagggctcaggcgtcgtcgtttgggtggggggccgctgaactgacaagcgacatttcagctcctttcaccctgcctggaaccccgggagcctgtgggccctgctcagcctggctgttaccatgaccaanggcctggtagcaatggtgctgggaacctcctgctgacaaagcttggactgtgcaactgaacttggacctgatgcctcagcgacctgaatgacggtccctggtgaaggagctggctgcccttccaaaggccaccatcctggatctgtcttgtaataaactgactactctaccgtcggatttcttgtggcctcacacacctggtgaagctagacctgagtaagaacaatgctgcatgcagctgccagcagactttggccgtctgtgtcaacctccagcacctggatctcctcaacaacaagctggtcaccttgcctgtcagctttgctcagctcaagaacctgaagtggttggacctgaaggataaccccctggatcctgtcctggccaaggtggcaggtgactgcttggatgagaagcagtgtaagcagtgtgcaaacaaggtgttacagcacatgaaggccgtgcaggcagatcaggagcgggcagaggcagcggcggctggaangntagnacacgtgaggccagagacagacaggcgttgacgggcttacccccagcaagccatagcggaaggcctccaggacccgggaacactgccggacaccgcggaagacacggccgaacgcagcacggagccccggacacacggacgtctgac

SEQ ID NO: 717999 - DNA, 286 bp, Homo sapiens
ctttcccagggtcgaaggcccagccttcaggcaggcagcctcctgcttccagagccctgagaccttccttccaaggcccagataatacggccttctccagggagacttgccgccccctcaagagctctagctctaactggcccctatgctggtttggcacttgatacaggtgacagtgccggcgcatctcttgcaggagttcagggtactgaccgtccaagattgagcaacagcctcgatcaatataaaaccccctgccataacccaatacgagacgcctgacact

SEQ ID NO: 718000 - DNA, 206 bp, Homo sapiens
tggcttaatttagtactgatggtatgggtacgtatgaacgtaacctgtgagatgggttgatcagcacaccgccgccgcctggcctagttaccatcacaccccgtgtgaggagcctgcagctgcctgcagcctggccccagtcaccatcaccgcaaccatgagcatgctgatggccgagacccagcatgctgcgtgacgtgcagaaa

SEQ ID NO: 718001 - DNA, 246 bp, Homo sapiens
tattctaacattagttcaggctcccaccgtcctcgccagcctgcgtcccagggcgggcgggacagcacagaggcagcgccacctcgcttgttttcaaacaaaagactattaccagttggatggacactaaaggaatcaagacagcggaatcagaaagtttggatagtaaagaaaacaacaatacaagaatagaatccatgatgagttctgtacaaaaagataacttttaccaacataatgttagag

SEQ ID NO: 718002 - DNA, 916 bp, Homo sapiens
gcatggtgccatgtgtctatagtcccagctgctcagaagtctgaggtaagaggattgcttgagctcaggaggtcaaggctgtagtgagccatgattgcaccactgcactcccagctggatgacagagtgagacgttgtctcttattaaaagacaacaaataaatgctggtgaggatgtggagaaaggggaactcatacattgttggcaggaatgtaaattagtacagctgttatggacaacattatggaggttcctcagaaaattagaactaccatatgattcaacaatcccactactaagtatatagccaaagaaaatgaaatctgtatattgaagagatatctgcaatcccatgtttattgtaacactgttctgaatagccaagatatggaatcaacctaaggtgttcatcaatggatgaatggattttaaaatgtgctatatatacacaatagaatactattcatatgtaacaaaggacaaaatcctgtcatttgcagcaatgtggatgaacttagaagacgttatgttaagtgaaataagccaagcacagaagaacaaatactacatgatctcactcatgtggaatctaaaaaagttgactcatagaggtagtatattagttagttttggatagtattaaagaaatacctgaggttgggtatttataaataacagaggtttattaggtcagggtctgaggtggacagggagctagtaccggatctggttctggtgatgttggaccaaaggttggaggatgttgacctgaaggagacgggatcaccttactaccacgtggagagagagcctatcaagaaaagaaacgagggagatgtacagagtaatattaaaggaagaagaaaagaagaggaagaggaaaacaaaacaagagtacagattatattttttttt

SEQ ID NO: 718003 - DNA, 126 bp, Homo sapiens
cccatacagagtacgtgtgcatctttacgtttgtttacatttctctcaatgtggatggtaccatatacggtctgtaagagtttgtgtgcataagttttgataacatctcacactttttattaaata

SEQ ID NO: 718004 - DNA, 1076 bp, Homo sapiens
cccagtagagacaccagtagtaacccaccatggccccctttgagcccctgtgcttctggcatcctgttgttgcttgtgcgctgatacgcccccagcagggcctgcacctgtgctcccaccccacccacagacaggccttctgcaattccgacctcgtcatcagggtccaagttcgtgggtgactacctatcaagtcaaccattacgcaccttatatccagcgttatgagatcaatgatgaccacagatgtataaagggttccaatgccttagggtgagtgccgcatgcacatcctggcttcgtctacacgccctcgtcgatggagcagtgtctgctggatacttccactaggtcccacaaccgcaagcgaggagtttctcattgctggtgaggcaccgttcccgcgaccctgtgccacaccaaccagtccctggggcgcgtcctagcaatcacgatgtgggcgaggctcctgatcgggaatgcgtcccagctggaaatggggaccactcccaattgtcaggtctatcagaaaggccaggtgcctttgccatcttgagcagctcatggcaatctacaaagctgctttgtcggatccccgaccccggcttatctcccttaggaaaatctagcacggatggacgtcttgcacatcgatcgtaccgtgcaagttctcgatggcgtcccttggcaacagtcctgaagcgttagctcagatgccggaggcttcgaccgaagacctacactgtttggctgttcaggaatgcacatgtgagtgcctggaccccttgacctccaagcggggagatccttccccggcggccattcccttgcatccgtgggcttggttcttgctccctcgtgtctattctgttgtccctggttggctgttcctccaacgcgtaagtgggctgtccccttgatctctcttggctattgccccaagggccgagactgctcccttacaaattctggctggtcccttttccttgtgtccataccggtgatcggctgttcctccctggtccctctaattttccttggtgactatcggaatcccgtcccggttcttggccccg

SEQ ID NO: 718005 - DNA, 347 bp, Homo sapiens
  misc_feature (23)..(23): n is a, c, g, or t
  misc_feature (80)..(80): n is a, c, g, or t
  misc_feature (114)..(114): n is a, c, g, or t
  misc_feature (329)..(329): n is a, c, g, or t
  misc_feature (339)..(339): n is a, c, g, or t
ccacagcttcctccttgaggggnagacccctgcccaaaatagaaaaggggcacctagagtattcagggtagataatagcnctttgatatggcctatttatggggtcctagaaanactgatggtggagccaaggtctcaggaagttgtcagtcatcatatggaatgtaagattgtcacagtccatcattgggatggcccaccatctctgcacactttggaatgtttcagtccccttcttcctaaattgtacatgctactgtagtgagaatgtgtcttctcagtaaggttcatggtactttgttcttagtacttccttatttcagagaagntccttaaagnaaatacct

SEQ ID NO: 718006 - DNA, 308 bp, Homo sapiens
  misc_feature (71)..(71): n is a, c, g, or t
  misc_feature (74)..(74): n is a, c, g, or t
  misc_feature (78)..(78): n is a, c, g, or t
  misc_feature (87)..(87): n is a, c, g, or t
  misc_feature (106)..(106): n is a, c, g, or t
  misc_feature (109)..(109): n is a, c, g, or t
  misc_feature (115)..(115): n is a, c, g, or t
ctagctctctcatgtagatatcattacaattatctttttatacatgataaaattgaaacttgggagcctgnaangaancaaatgaangggtgggggcaaagccctnatncaatanaactggtgtgcttgtgagaataggaagatgccaggagtgtgatgcacaggagaaggaccatgtgagaatgcagcaagaaggcagccatctgcaagccaaggaaagagacctcaggagacaccggcggggggggacaccttggtcttggactttccagcctccagaacagtgagaaaataagtttctgatgttt

SEQ ID NO: 718007 - DNA, 431 bp, Homo sapiens
tgcaggggacagcttattttgttatactgctttttctaatggaaataactaacattctgggggaaaaaggctggaattgtttgtcttttgttttttcggccgggggatctttattttaaaaatcacacctacttgttcccataagcccttactatcaacaagataattatttgtaatcacttttttatcccaggttgcaattgctttccccttctaagttattttcccttaataatatttatgacaccagcacactgagggtttaatagcaactgtactgaggttttcaaaaatcctgcatatatggcctcagttctttagttattcgaattatatctccctatattattttatctaccttgggttctcacaagattgccaattttaacactcaatagcacagatttctcttctattcaggtcgggtccct

SEQ ID NO: 718008 - DNA, 784 bp, Homo sapiens
catgaatgagttcactaatatgccatcttagcttcaaaaccgggacaagcgctggagatagagtcgagagggatattcgagcgctgggagctgccattcgagcccacatatatgtacatgactcctgacagttaacaataggtcaagcctgtctgacaggggtcgactcggaagactgcttgagtgaatgttatctataggcgtatcattctaatgttggactctcattgaggaaatgtggagccttatcgaagctgctcatcaccacagtaattgtgagaacatttatcgatttccggaacgtgacccaagaagagccaggtcggtcgaatgaagagagagcaggaatgtaacattaggtgcacatggagagcgaggagtgacactggtgagacaagtgggcccccggaacaagatttcccgtcagaccgcctaggcggtgatctcgtccagatcgtccaagtcaccggcatgttcggtggagacatcaggtctgctggtttactcagcagagttcagaagaatctggtcacatttgcaagccatttaatcacgtcgcagtatggggtatccatgttagacaaagatatcgtcacagtccaggatgcactgtgagagtgtgtggtggccataggagaagtctgtacgcgggggttatatcgaaaaaaatgaaagaagaggtgtgacgatacagtcgagagagtgagatctggaaaaactcctctcctgtgctcgatgattggagtggagaagatgcgtttatgagaagactggtgggtgcaag

SEQ ID NO: 718009 - DNA, 470 bp, Homo sapiens
aggttcatagcgttcagcacgatggcaaatcgctcctccagttcacctggtctggcatcggcagcttcaaagcacttgtgcgccctgaaatcggtctgctgcgaatccatgctccctggttgcccatgtcggcggcgcgccggggcgggggctgctccgggcccctaggtgcgcgtcggaaatcagaacagctcccggcggtcgctgcgccgaggcgcgacctgcccgctccccgccctccgccgcgcccaggcgggtgtgcggcggcaccgctccctagcagcgctccaagcagccccccccggcctccctcatgctctcaccccccagcgcgccccggcctcttttcctcgggaggggtagtcggcgtgggcgcctatgtgcatggttccgctgcacaccgccccctgccagagatcgcgcccccggcgcgtggtccctcctaacagcccttctgccggccgcggccc

SEQ ID NO: 718010 - DNA, 575 bp, Homo sapiens
agtggataggcagtctatgttttacattgaacttttcttcacttgatatataaagattatatataatgtacttattgatgagctctaagaaaggttaggcatattattcattaaggtggaaataaacgacttgatatatataacctggttttatcaaaaatttaatcgagtggcttgcagtatgagatcttgttcaaagagtattttcctgaaagatttatttcatgagattatgtacagatcctgtagctggtgtaattttaaaattaattgcttgtgaacctcagtttactaataatagtagtattgatctttcgctaataatgcgattgaactgattaatcaggtgtttaaagtttttataatacatactcttgcaaagaagtttagttctgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaacataacatctgaagttcg

SEQ ID NO: 718011 - DNA, 128 bp, Homo sapiens
actataatggtggctatggcaatgtaccaagccttgatgacctccccttttcccaggtcacaggggaatttgtacttgcgatccagactggagtcaaacttatgtgccatctaactagccagcctagt

SEQ ID NO: 718012 - DNA, 579 bp, Homo sapiens
  misc_feature (176)..(176): n is a, c, g, or t
  misc_feature (180)..(181): n is a, c, g, or t
  misc_feature (186)..(186): n is a, c, g, or t
  misc_feature (196)..(196): n is a, c, g, or t
  misc_feature (200)..(200): n is a, c, g, or t
  misc_feature (202)..(202): n is a, c, g, or t
  misc_feature (206)..(207): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (221)..(221): n is a, c, g, or t
  misc_feature (227)..(227): n is a, c, g, or t
  misc_feature (248)..(248): n is a, c, g, or t
cttttggggttttaagaattttttgaatttttatagccggcctcaaatttggatccttattttttttattttgtcaggggcccaagataaccttccttttttagccttcttttttgtccccaccatttttatttgggggccatggaattggaaaaaggccgcatgatctttttggntccnntcagngtttaaggcncccngnttcnntngntngnatcccncagacnatttccctcatcctatttaangcagcaaatttttccttagttgaagagagtgggtttatttccctttaaaaccccaacctatcctgaagggttggtcattgtttgcctttaaaatccttcctcttttttcctcctctattttttaaaaaatgatgggggtaagttaaacccaaagctccctttacaaaatatttcctcagtactttgcagaaaacccccaacaaaaatgcccttttaaaaaagggggatttttttttttaaaatgtaagctcctcaaaagcagggacaatgttttttgtatgttttattgtgcctagtaccctgtaaatgctcaataaatattgatgatggg

SEQ ID NO: 718013 - DNA, 151 bp, Homo sapiens
gggataagccgctaagttctctgccgttgtaggtcaggaggctgcaggcctcttggaactcttgctaacctgttcagagccaggaagtgagactgcacagtatatgaaaagcacagccgtcaggtccggctctgcgtctccctctctgcag

SEQ ID NO: 718014 - DNA, 394 bp, Homo sapiens
gcctcatgctatctacccaatctgaacgacaccgagagacaaaaagataaaacataggacacgaacgactgaggaccgaagataacgggaagacacaacaatgaagtcccagggacggctgactaactatctaaaagtctgccatgccaactactggaatcctagaagacaatcatagggtagaacacgtatttgcagaaatactatgcaacaatgtctaaaattgggagaaatatattgttatacaaccttaaggaagagtaatacaacttcaaacaaaatacagataaggcatacctacccctatctataagagatcacctttaaagagacaggtagataaaccagtcaatgaatagaaggatacataccatgcaaacagttaatcttaaga

SEQ ID NO: 718015 - DNA, 731 bp, Homo sapiens
  misc_feature (176)..(176): n is a, c, g, or t
  misc_feature (180)..(181): n is a, c, g, or t
  misc_feature (186)..(186): n is a, c, g, or t
  misc_feature (196)..(196): n is a, c, g, or t
  misc_feature (200)..(200): n is a, c, g, or t
  misc_feature (202)..(202): n is a, c, g, or t
  misc_feature (206)..(207): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (221)..(221): n is a, c, g, or t
  misc_feature (227)..(227): n is a, c, g, or t
  misc_feature (248)..(248): n is a, c, g, or t
cttttggggttttaagaattttttgaatttttatagccggcctcaaatttggatccttattttttttattttgtcaggggcccaagataaccttccttttttagccttcttttttgtccccaccatttttatttgggggccatggaattggaaaaaggccgcatgatctttttggntccnntcagngtttaaggcncccngnttcnntngntngnatcccncagacnatttccctcatcctatttaangcagcaaatttttccttagttgaagagagtgggtttatttccctttaaaaccccaacctatcctgaagggttggtcattgtttgcctttaaaatccttcctcttttttcctcctctattttttaaaaaatgatgggggtaagttaaacccaaagctccctttacaaaatatttcctcagtactttgcagaaaacccccaacaaaaatgcccttttaaaaaagggggatttttttttttaaaatgtaagctcctcaaaagcagggacaatgttttttgtatgttttattgtgcctagtaccctgtaaatgctcaataaatattgatgatggggggcagtgagtttttattataagggggaaaaactgaaatccccaaccctgttttgttggttgttttattatgcccccaaattaaattgggaaaaattggcccttttgaaaaattgtccccaaaattacattcaaataaaagggcaatgggga

SEQ ID NO: 718016 - DNA, 1026 bp, Homo sapiens
ggaggccttacccccttttcccacgggacggcgggaatgattcttcaaagggaatcgagggcgctttaattgggaaacataaggtgtcccggagtagccctctccaaattgatgcgctttgccctctggggaaattcattgtacccccatcctttcctcccaattcgctgggctgtgttacgctaagggaagggatactgccaagattggccttactcactggcaggcccactgcccaggggtcgcgtccaactggtccttccctcgggggaaccccttctgctggcaggaactgacacaggtatgccattgctggcctcgacttgctgaggagagaagaactgagatacctcggtgttatatatcgctctcagtatgacatgacgccgtggactacacgagctgcgtagcaaggcaagtgacacgagcgtagcaaagtgttgcgtattttcagtacaaaggcttcctgtcgtaatgtgcttggacactgtacttagaagttgcctagtgctgcgggtacctaggctggataagaagctgtatgaaaagaggcatgttacttcccttgcgtttcgcagagccaagctttcgctcggagattatgaatctgttggttagttttgcaaactagagaagaagtagtcttggccacttgaacaaactttgactttatagaagtcctttcaaaattagttcctgtttctagaaatgttaccaatcaaggtgtcaagagcagtactttgtcgatagatcttttgttaggtagcaaagtgataaaagtgtataaagtgcacatggaactgcgcatagctacttcattgtggatagtaaagagtgtatgatatgtattggaaggttttagcataaagtcaagaggaagaaagcacatttaaaatgagaaactaagaccaatgttctgtatttaagaggaaaaagaatgcttgatgtatcataagtattgttatttgttgtctttatatccggtgccttgcttgagttgcttgtgaatgctctgtgagcccgtca

SEQ ID NO: 718017 - DNA, 555 bp, Homo sapiens
tgagatgaaatgaaatgaagtgaaatgaaataatgaaatgaaattgaaatgagatgagatgaaatgagataaaatgagatgaaatgagaagaaatgagatgaaatgatgaaatgaaatgatgagatgagatgatgaaatgaaatggtgagatgaaatgatgagatgaaatgaaatagtgaaatgaaattgaaataaaatcgaaatgagatgaaatgatgagatgatgaaataaaatgatgaaatgatgagatgtgatgagatgaaatgatgagatgagatgagatgacatgaaataatgaaatgaaattgaaactgagataagatacgagatgagactgaacctgatgacgatgaaactgatgaaatgactgagataagatgacaacgggtcgagactgatgagatgaaactgagactgacaacagatgaaatgactgagatgaacactgacactgatgacgactgaaactgacggtgaaatgaaacttagatgaacatgtaatgagactgaaatgaaatgacctaatgaaactgacataactgaaatgagatgc

SEQ ID NO: 718018 - DNA, 142 bp, Homo sapiens
ttgtttaaaagtatcattcaattcacattcaaataacataatgcttcctatgtgtcagtcactgtcgtacgtgctgaagacagagtccttgcctcaaattcacattcagaaggctcctcattaacacacacacaaacacaca

SEQ ID NO: 718019 - DNA, 447 bp, Homo sapiens
tgtgatcgttctaaggtatccccccggctgcactgcagagtgtgatcttggctcactgcatcctctacctatctgttgttcaagccattctggtgtcctcggccaattgagtagttgggatcacaggtgtacaccagcaggcctgtcttatagtttttgatatttctactatagatgagttttgccacattggccaggctggcctgaaactcctggcctcaagtgatcttgctgtgttggcctcccaaagtgttggtattacaagtgtgagccactgtgcctggccctgaaactcattattctatttccattaatattaatctctactcgttttccaatcattgtttgatttcacaagtattagtcccctataatcattgaatggctaataatattatttatagcaaacagattatttatctgccagcagtctgatattagtttcgg

SEQ ID NO: 718020 - DNA, 371 bp, Homo sapiens
ttacccggaacgacttcgcgtttcatacgccgacggggtgatgtatgtgccatgatccagaggaaccagagcagtatagaaactgtatattggtggtctgagctttgagactacgcatatagtttacgagaacattttgagaaatggggcacactcacagattgtgtggtaatgagagaaccccaaacaaaacgttccaggggctttggttttgtgactatattcttggtgttgaacaggtggatgcagcaatgctgtgctcgaccacacaaggttgatgggcgtgtagtggaaccaaagagagctgtttctagagaggatactgtaaagcctggtgcccatctaacagtgaagaacatatttgttggtgg

SEQ ID NO: 718021 - DNA, 190 bp, Homo sapiens
  misc_feature (88)..(88): n is a, c, g, or t
  misc_feature (112)..(112): n is a, c, g, or t
ccacctactcaggaggctgaggtgggagcttgagtctggaagttcaggaatgcagggagctgtgtttgtgcttgtgaatagccactgnagtccagcctgggcagcatagcangacctcatctcttaaaaaaagaaaaaaactatttatttttaattttcaactcaaggggcacatatgcaggtttgttac

SEQ ID NO: 718022 - DNA, 774 bp, Homo sapiens
  misc_feature (648)..(648): n is a, c, g, or t
aggcattgaggcagcaggcagaggttctgctgagggggaggcggagttttgaggaaaccgagataagttttctctttggaaagatagagactaatgcaatacttaaaaaatatagtcaataggtcactaggatatggctaagcgtaaaagtttaacgcgtaatttaaatagcttaagatttaccgagacactatgaagattacgaaagagtagccaatgaggaaggcacacgctcacaaggtttctaaaacatgacggagggtcgacgatgaagcttctccagggacgtacacacaatgtcttaacacgacacatcgacgagaaaaggactcaagagcgccgaattaaactcaccaatagaaggcccaaggcttgagatcaaaatgaagggtgacctttaaacagcttaaacgtagagtttaaaacagtgtgtcaggtgatcaacataacttggaagggcgatcttttaaaaaggacgatcaacgcggagggtggatcaacaagaccttgaaacctcctgtgacaggcacggggcaggaacctggcgtcaatttaaagggccctaagctaaaaggcattttaactaacagtgcacaggaggacaacatctggacaagaatcaactgcggggaggtggctaggaacttnaaaccaattgggggagacaagtattagacatttgggaaaggtggaccactgtggaaacgacagacagttcggggacaggcgaagcaccaactcatggagacacatcagggaaacttacacaaccaa

SEQ ID NO: 718023 - DNA, 211 bp, Homo sapiens
tctgcccagcaactgcctgtacaacctcacgctgccttcacccttgttaatgatctttgtagccaaagataaattttcaaaaaaactatgtgcccagcgcacgcgcccgcctatcatcccaacattttgggagcccgaggcaagaggatcgcttgaggccagtagttagagaccagcctggccaacatagtgagatctcgtctttgaaaaa

SEQ ID NO: 718024 - DNA, 414 bp, Homo sapiens
  misc_feature (214)..(214): n is a, c, g, or t
  misc_feature (216)..(216): n is a, c, g, or t
  misc_feature (292)..(292): n is a, c, g, or t
tcgacccagactggagtgcaatggagtgatctcagctcaccacaacctctgcctcccggcagcaattctcttgcctcagcctcccaagtggctgggatgacgggcgcgtgccatcatgcctggctaattttgtatttttaatggagaacagggtttctccatgttggtcaggctggtcttgaactcccgacctcaggtgatccgcctgccttgncntcccaaagtgctgggattacaggtgtgagccactgcgcccagcctagaaaataattttaataaaatctaattttanggccgggtgcagtggatcacttgaggtcaggagttagagaccagcctgggccaaaatggtgaaaccccgtctctactaaatacaaaaacttagccaagcgtggtggcgtgcgcctgttgtcc

SEQ ID NO: 718025 - DNA, 152 bp, Homo sapiens
gccggaccgcatcttctcccatcagatttattttttaaatggaatggattttgagagaaaacaacgtggcagaagtatggaatagaaaataaatacaaatgtagtgctattctgctaattgttttataaccacctgatgggacgcagactgg

SEQ ID NO: 718026 - DNA, 630 bp, Homo sapiens
gggccctactgtgcagagacacaccggcgggacacactcttctgcggtgaccctcatcttgcaggcccgggcctatgtgggaccgcatcgtcctggacaggtggtgacccgcacagggttctgcacggcaaaagggggcctggtgagctcctatcgttgcgacccgccggccctatctaatcttcatatgttctactaaactactagctatgaagattatgttggctggcccttctctgttcctggctctctctcggtgaccatctgacagcatcttctatcctcataccgaaacctgggtgcctctgaatgagattgtaatccagggctctcgatctggtgatcgtggtgtgtgccagctgcccatgcctgctgccatgactgtgtgcacgctctactgcccagagccgactgcggagacagggcattttctgcatccacccactgcgcatcaacctggggggcaagctgcagctggtgtgtttcgacaagacgggcaccctcactgaggacggcttagacgtgatgggggtggtgcccctgaaggggcaggcattcctgcccctggtcccagagcctcggcgctgcctgtggggccctgctcgagcactggcagctgccatgccctca

SEQ ID NO: 718027 - DNA, 136 bp, Homo sapiens
accgcagctgccccatcaggaagatattaggttggtcctttcacggggcatcaacacttatgaggtggtttagacaaattaatgaccacttccatgtaaaaggatgctcttatgttctatataagcctcatgggag

SEQ ID NO: 718028 - DNA, 543 bp, Homo sapiens
ctctctctcccgctctctctctaactgtctctccctgaatgaatgtgtctctttcaaaaaatcgatttttgttgatacaggggcattctcgatactgcaatcaaactggtgagagagacatgaaacgttagacaattctaggtgcatcgtgattaaaagatacagtgggaatttggataaactgttgtatctctctctgggcgatatgggcaacatcagcgcctatttgaccaatataacaaagacctggaaacttttggggggtcaagacttctgcctttttgagaggcggagagggattggtacgaatagctaaccgttgtacttggctcgagctgttgagtggaaagtgccataaatcactattgggcaaagtgagaggtgccttctccgaccctattggccatatgtgccaattcgtgccgaatgtctggggcccggcggatccacgaacgctagagcgggcgccaccgcgaggggaccaccagcgtttgtctccttaagagagggttaatgcagagcttggcgtatttcatgctatag

SEQ ID NO: 718029 - DNA, 216 bp, Homo sapiens
  misc_feature (57)..(57): n is a, c, g, or t
tacaaccggccaagcgatcgctgggtgtttggctgttgcattagatgatcgctgggngtttggctgttgcattagatgatcgctgggtgtttggctgttgcattagatgatcgctgggtgtttggctgttgccttagataatcacttgtctgtttggctgttgcattagatgatcactgggtgtttggctgttgcattaatgatctccttggcgtt

SEQ ID NO: 718030 - DNA, 446 bp, Homo sapiens
attcgcggccgcgtcgacgaaatttcaactcttatggagcttccattctgaaattgttttcattttacctttttagaatgtgtgtgaataattttggacttacataaagtttaaaaaaatctatatatggagttcccacatccatttcatacagcttctactaatgttaacatttcctgtatccataatataactgccaaaatcaagaacttaacattaattcaaaactattaactaatctatacgtcttatttacattttcacctcatttttgaagggcagtttttttcctgagataaattctaggttggcagctgttttaccattccattatcttttggtttctactgactttgttgagaagttgctctcagttttattcttgcttctttgaaaataatcctttttttaaatctctggatggtttttggaattttctactttgg

SEQ ID NO: 718031 - DNA, 153 bp, Homo sapiens
attctctatcagatccttcctctcagcgtgcatgcactacgatactcacctcataaagtaccatttccaatcagtgttgccagtgtgtgcttcaggatgtacttaggaattacttagccatagtatttgcaacatatgcacatgcatagctga

SEQ ID NO: 718032 - DNA, 162 bp, Homo sapiens
ggtttgtctttctgagcggtgtgaggtgtggtttgtcttcctgagcggtgtgaggtgtggtttgtcttcctgaacggtgtgaggtgtggtttgtctacctgaacggtgtgaggtgtggctttgtcttcctgaactggtgtgaggtgtggctttgtcttcctg

SEQ ID NO: 718033 - DNA, 804 bp, Homo sapiens
  misc_feature (1)..(1): n is a, c, g, or t
  misc_feature (715)..(716): n is a, c, g, or t
  misc_feature (772)..(772): n is a, c, g, or t
ntttacttttttgtcactagcgcgccatgtgttggtaacgggattcggcctttggccgggccttttttttaggggggggccagagccattcctaaactcctcgaataatcctccggtatggggtgacaattcaaattgctgcggagatccacacctattactggggactacctgaacaaactttttcatttaagacagggggggtgaaaaaccaggccttttcattaatggtttaggtcatccctgtaaccggtctatgatgatactattaaatactttttatcaagaaccaatactttccagatctgaacaacatggccccctaacaacgcccattcagaccgaagaaaagtttagaattcaagttatgaaaatgccttttcatctttaacccaagcaagggaccataagccgcgaaaaatcttaatgaaaacaacctccgctgcctggccctctaacataataacctcaatagagaaggcccggagatgttgcgcctaatcccatctttctaggagaagagaacggttttcacttctcaagagaaggattcacaatggtcttttattccaagcgactctttttttaaagggacacacgtgtgaattgcccctttgtcgccaaaaatacacgttcctatcctccctccctgttaaaaaccttttaaatttaaaagaaccccccctaaaaaacacccctctgcaatttaggatgnngcccacatttaaaccctcccctaggcctctctcccaatgggaagatttgtatttanccccaacccccaccgggttttattattcctcg

SEQ ID NO: 718034 - DNA, 221 bp, Homo sapiens
tgattgtataggaggtgtataagttggccgtagcggaatcgggggtctgcttgtacaaatacataagagcagggaggttagaagtagtgtgtcttggttgacaaaaatatgtttgtagtagagttcatggggagagtgcgtcatatgtttgttcctaaggaatgattgtatgtggtgatgggtgtttattcataatacatgttttgtgtatactggctata

SEQ ID NO: 718035 - DNA, 417 bp, Homo sapiens
gtgctccgctgggggaaatgctgactgatctgaaatctgcttgtgccggttatatgtgttattgagtttaggtacttttacaaaccaccataacccactgagataaaaggacaaaatgggttatttctgcaaaacctgaattgctagttttagaatttaatagagtcattaaaaattaaaccattatgagtacattgggatcaaagaactatgaagtatttagtagaagtctgaaggattttgtactcaaattgtaaattttggtactcaaatatccattatgtaattggtggtgggtatcccaattatacatacaaattgtatgaatgtattaaattaccacagtaccctggaaatatgtacatctattatgtatcaataaaatgtaaaattttaaaaaggtaaaaataataaaaa

SEQ ID NO: 718036 - DNA, 1156 bp, Homo sapiens
gaggtgctgtgtaatcatcaaggagcggagtgcgttaggagctgctaacctgccggattacctcggtgccgatcagatggaagaccaaagaggatgagaaggacgacacagcccatccgagctctggactgagggggataatatgccttgtttgacacagacttactggtcagagcacttactctaggcagatcaagcacaggttgacagcattgacgcattgcaggcaaacttgctccgaagacacaagtcacagtgagcctcacctggtatttcagaggcaattctgatcactggtgcctgggatcccacaaccaagaaacctcgtgggaactcttgggccttgcaagactaacgggcgagacagctccaggaagtgcaccaggccgtattaacacgggttggcccaggggtggtacacaaacggactaacgtcacagggcctggactttcgcgaaggaaccccaaagaccataccatttattccaccgttaaaaggacacgtgaaggccaacagatcacggttggatgggaacccgttcaggtggatccacgggtggatcactctaaagtgcgcaatttgcacgaacaggggcaataagcagataggcgcgttggactcagcaacactagcacttatcacaacatgcacacttagccaatatgtggcgtcctcaaggaattcgaaccccaacaagttatgagcatggaatgccagagatggaaagcagtaaacacccgtgcatatcaagcatatgacagcgtacatgatcaggagcggacaggaaaagcgaaacaggaaattagacgacaaccatgcgagggacagacagcggaaaagcaccccataaagagcacaacccacgaaaaaggtataggcgacaaccaacgggcaagtagaaaggactacccaaagggcggagacgagcaaaccagtagggaagcacaccgggaaaacgaggccacacaaaacactagagtgccgacgagagaacaagacacacggggacaagagagcagagtcacagcggaccaaaactaacagcacaccggacagtacagagagaacaacaagcggagggacgggagaaacaggaagcggctgcgaaaacacataaagaaccaggggagaacaacgaaagggcagaactgagta

SEQ ID NO: 718037 - DNA, 200 bp, Homo sapiens
aaaatatgtattgaaattacaaatcaaactttttccatatgattcccaaggaaggttaaccaaaaccaaccaaaccattaaaaggcattcaaacagctcttttatacatcacagtgttagtggcacaaatgtactgacatttcaaaacacaatcaatctgtttgtttgttacacactgtcaatctacgtactgtgcatga

SEQ ID NO: 718038 - DNA, 106 bp, Homo sapiens
gcacatgcccgcagagaattgtcgtggatggtctccaccgcccccacggactcggtgcggacgtccacgcccggcgcgcacttcactgtcttcatcttgtaccggg

SEQ ID NO: 718039 - DNA, 1675 bp, Homo sapiens
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 718040 - DNA, 132 bp, Homo sapiens
ctgtctgtcagtgtaggtgtggctacaacgcccgcattggaggggtgcgcatgcgtgcatggcgcggtgaccgatgcagtggaggcacgctcgttgggcctgaagcccaaacacatccacatctactgtgcc

SEQ ID NO: 718041 - DNA, 1143 bp, Homo sapiens
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttata

SEQ ID NO: 718042 - DNA, 403 bp, Homo sapiens
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaactttgaagttcattctgaatgtgactgggcactatcatgcaaggtactagggggactcagtgactccgctacttatggcccaagc

SEQ ID NO: 718043 - DNA, 915 bp, Homo sapiens
ggctcgggctgcgctgtcgtctgcaggcgccaccgctgcctctttccggctgtggaccctcctcgccgccgagcgcttggctgcgtcctccgactccccgggcctgcgagaccaggctcccgctccggtttgccggcgcgtatcggccctccgcagagccagaccactgaggcgattcatgacgatgcgcagtgtcgttcctatggtgtgaacggaaaccatagaaacttgggcattctactcctcctacttcactcgttgggcctcatgtgactgctgcccttccaatcatgactccgcacttctaatccgtctggtctacgtacgagtgaacgttggctcgcaacaacgtgggagtccaggtatgtcgaatacacgattggtgagagatcgatggccatcattgactcgacgtacgtgatctcataccccattgcgtaatttgcgttcggcttcctgggagaattgccttcagccttggagagtgccggatcgcgcacgtgatccagagaaaggcaagcatacgcccactggctgagtgcacgataccggacgtacacattggaccgtttggctacaaacgtactcttggaatggaatgaattcgaactagatgggcccaattcggctgtcccgacatgacagcaggttagcaacgtacacttttgtaggagcacgtcgcgcttacatcgcgcgggggtacaagggggtcacacgtacaatttgcccttcatggacccagattggcaaacgttgccccgattcctatggtcaaccatatggtaacaccaaaggaggaaaatggtttgattccccacaggatgggtgcacgtgatcccagtggacccattggttagagcccttgtggacgcggaatcctaagggccgttcctggagagttgtagtcaattaccg

SEQ ID NO: 718044 - DNA, 810 bp, Homo sapiens
  misc_feature (603)..(603): n is a, c, g, or t
  misc_feature (650)..(650): n is a, c, g, or t
tacaagctaaattaatagcactaactcctgccctaactctaaccaaaggacgtgcatgttaagtatctataccaaatccaaatatgcctatccagtattctacctacacactcatgctgtcagtacttggggcagaaagaggttttcttcactagagaagggccctctattatcaatgctcacgtaataagagccctccttttaggactgtcccgtcccttccagacgcaagagctggaggtaatctgctgctaatgggtatcaccgaatagaacatctctgaacgccattgtcctccaggataatacctgatgtccggataataagcagcacaaaacatcgcaggcaaactctcccgggtatctggcatgcacgcagatggcgtgaatacttgtcatctgtatgctgcatcatagtacacgtccataccatgaactgcatcacttctctaaacacacttaagactaccagatcagattcccaattcaacgagcaacctgtgtatgaatagatcaatggaagagctgcgattcgtccgctgcggtcgtcaaagacttacttactgtcctttcgatcacttgtcacgatggtagattccaggtngagaactatacaaccatttgaatctcagcatatgatattagaacctncgtcatatgaacgtttgtccgaggctagggtagatcagtagcgagactgcttagtctctagtaaggagtttacacaataagcaaaaaagttcctagcacaaaagaggtctgcaccgaaggagattctcccaagcgggggcccgcagaattgcaggacccg

SEQ ID NO: 718045 - DNA, 320 bp, Homo sapiens
gactttatatcagctgaatgatgtcattagtgcactgtcttctctctgcatggctgagatttccacaaaacatgaaaattttttgctgtgcttcctctcaagacagaccagtctcgtttaagacctttaagagtataaagacaagggaaaaatgtcactctcaaattagtacacgcggtttacacgtgtaaaaacaaacaagaaaatgttcaagtggctcctcgaattgtctacacgaaaactaaggattaaggacatacactctaaatgctattatacagtatataattaaaatcaatggttcaacaacttgcagaatg

SEQ ID NO: 718046 - DNA, 350 bp, Homo sapiens
gagagttagttgagggttgaaaaaataacaaatgataaatttggagtataaaatcatattggagatccagaaagagaatgtttctacatctccttgttaatctgagctcttgtttttggtgggttaactcttttagctggatgctgacaaatatgagaatgatccagaattagaaaagatccgaagagagaggaactactcctggatggacatcataaccatatgcaaagataaactaccaaattatgaagaaaagagttccgctcttgttgcccaggcggaggttacagtcagctgagaccgcaccattgcactccagcctgggtgacagagcaagattccgtctcaaa

SEQ ID NO: 718047 - DNA, 2388 bp, Homo sapiens
  misc_feature (1685)..(1685): n is a, c, g, or t
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactgaaaaaaaaaanaaaaaaaaaaaaaaaaaaaaaaaaaaaaaaaacaaaaaaaaaaaaaaaaacagaacgaaacaagaagaaaacaacagaaagacagagacaaacacaaaaagagagaaggacagacaagacgagaaaaatacaaagaagaggaggcaaagcgaggccgggagcggggcagccgccgcggagacacacgacgacaagacgacagtgacggggggcgcgagacggggcggcgggtagcagcacactcaccaggtcagaacaaagaacgaagaggaaccggggcaacaaaacgaggcacgagctgacagagaggagccatagatggacagagaaacgagagaaggagcggaacaacaacaacaagcacaggggagcaaacaacaaggcggcggagactaaagcacagagagaagacaaggacgaaagacgcgcgaggcaagagaagtcgagcagtcaggcacacatactatagagcgcgggagcacgcgccaaggaggagagaagaaaaagaacaaagaaaggcaacgagacagccagggcgaaaagcgagaggaaggaggcgcgggacacaggacgaagccacagcagagcgaaacaagaacagcgcacaacaaccgacaaagaacaagaaaagaccgggagcagccgagagaaaagaaagaagcgagggaacacgagagccgacaagacgcgagacacaagagcc

SEQ ID NO: 718048 - DNA, 738 bp, Homo sapiens
agcgggagcccagctccgggtttaatgactcctggcccggcccgtcgcacagctctgctcataactcctggccgccccgttccgtccatctgtcccgctgccccgcggtcctatccaagggtggcctagctccactcctcggaaccaagatgacggtcagttgccagaacggtgtattacatgtcggagactcagctcagacacgatagcctggcccttaatgggtccagggatacgacaggcaggacgaagtcctgaccgacaagcatggtcgaccaggctgaaccgtgcaggacatggatagctacgattgcacagaactcacagtcagctttcccatcttgacactcttgacggcaccttgtggagcaatgaacccactcttgatatggacattgtcgacgtgggctagctattgaagccgtttcctgccattctgttactcatgccaaaatcgccttaatgctagggccaacagttgggcttacccttcgtttttgggaccgatgcggtggttggactattcattgggctttaggcttttaatgggacagaccaattggcgagaaccctgtgccgtggggaaggccatgagtaacccgcgccacagggagcttgattgccaattaaccgccgcgtgactgcctgcggttacaacgaggttggctgccaacacagcttcaacttgtgacaggcccttgtgcaatcagtgtctttcccagtgggcaatgtttcgca

SEQ ID NO: 718049 - DNA, 254 bp, Homo sapiens
ggatcccaacgcgcgatagctcccgagtagcgggatacaggtctgtacatcacacctaattattattattatttgtagaggcagggtctcatcatggttgtccagtccgcggtgtgaactcctgggctcaagtgaaccaacttgccttagtctcccaaaattggcagggaccacagggctcgcaccaaccacgcccaagccacttttgtgtatttttgtgtagaagaccagagttttttggtcatggttgctta

SEQ ID NO: 718050 - DNA, 104 bp, Homo sapiens
gtaatggttgctgcgtcaggactctggagaggattttttatttggaacgatataatttttggaatggccttaaagggaaaaatacatattgcttaattataaaa

SEQ ID NO: 718051 - DNA, 262 bp, Homo sapiens
  misc_feature (176)..(176): n is a, c, g, or t
  misc_feature (198)..(198): n is a, c, g, or t
  misc_feature (208)..(208): n is a, c, g, or t
  misc_feature (224)..(224): n is a, c, g, or t
  misc_feature (246)..(246): n is a, c, g, or t
  misc_feature (258)..(258): n is a, c, g, or t
tcaatttctacactcggaaaggaggtctacatcaagaatggggataagaaaggcagctgtgagagagatgctcaatatgccccaggctatgacaaagtcaaggacatctcagaaggtggtcacaccctcggttcctttagtactgagaggagtagagtccctaatgctagaccccnacatacttgcagaggtgattcntggcggcccncttgatagttcacaangagaagtcgtttcattcaagtnggtgtagaaatntgaa

SEQ ID NO: 718052 - DNA, 502 bp, Homo sapiens
gacagacagacaactgtaagtagagatacttggcaaaaatatgtcatataaatgctcagtagcatagagttgaaggcacacaggcatttgtataagagagtgggttggtatgctggttcccttgctatgaggtcttgagtaaattacataatctctgggcactcatttttccatttgtgaagtggaaatacgaccaactttgcagtttgggtacatgggaaatgatatgcattggtgtccagagcaatgttccctgcactatggaaggatattaaacagttgccattgttatttcagtaatgggtcatgtgcaaactgaacacacattttacctccttccccatgttatctattgtcctccacagattattgtaatccaaatatgcaatgggattccatactggtggaaaggcgccccgaaatggatatgttttcccctagaacataaaagcaaacagaatcaatcaaaaagagtaatatcttaaatttgaatggtgttcta

SEQ ID NO: 718053 - DNA, 1613 bp, Homo sapiens
  misc_feature (28)..(28): n is a, c, g, or t
ttaggcctaagtagagccctggagttangtcggcgagtggccgacataacgactgcgttgtcagctgtattgacgagccggcgacggggaccacgccgaccggcgcagtggctgagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 718054 - DNA, 382 bp, Homo sapiens
  misc_feature (1)..(1): n is a, c, g, or t
ngtgtgtttctagatgtgtctctccttctcagaaagtgtgcatatatccgcatgaaaggtatatgtttcaccattacactctttggaaacgtatgtttcatcgacttccagagctgaaaagcatgttcgcttctcatgcaacacacatacctggttcaggcccgcgaatagatagtcttctgcacaggccattctttttgcttcagaatgtttacacacatttgctgcccacttttcataggtttcttgacactctctacaagagttgaagttgacacttggggtactctcttggtgtaacgacctaatagcgcattctggaatttgcactctacaatctgctcaaagagctcacaattgtgtgagattaaactcctcgtgc

SEQ ID NO: 718055 - DNA, 893 bp, Homo sapiens
gactggcgaaaacaagacccatcacatgagggtaaataacaccaggagcaaatatgtagaaccacgcgtcgactcaacacccactccctcttagccaatatgtgcctatgccatactagtctatgccgctgcgaagcagcggtgggactagacctactagtctcaatctccagcacatatggcctagactacgtacataaactaaaactatccaaatgcataagaagatacagtcggtaccacaaccaattatgtgtttccataacgcagatgacactgacgtgataccaagaaaacacagtaatgttagaactcaacacaaagacacaccacagcactaattatgagaactccataacccctactagtatactacaacaaaatacaagaaagcaagcctagtttagctggtatccccaaaagacatatgtccgcgtaccgaaaacgcacgcgtaaagaaaggaccgcgcactcccatcaaaataccgataaagctaacgcctgaccgtcacatcagacaccgtcgacaaaatacaatgggacagaagcagcaaggcgaccaacgaacaactagaaaagaggaacgcacatgaggaaaggaacaacgacacaaacgtacgaggacgcacagataactaacaagaggcaacataacaagaagaaatacaccaaacaatacaaacagaaaaaacaaccaagacaagcacgacaaccacaccaccaaactgacgaccccagaacaacacacgacaacaccaacacccgaaaaaagtaaacacaccccactgggactacacccaagccacaaccgaaacgaaagagacagacacgacacaagagagcacacacacacaacaaagaacaccacgaacacaagtcactaaacaacacaa

SEQ ID NO: 718056 - DNA, 1609 bp, Homo sapiens
tcctaaaggcccaggctgtgtggccccgtgtcctgcaggtattgggagatccacagctaagacaccgggacctcctggaagccaaaaatgccggtccctccattcggggtccctgacttcctgcaacactggagtttgttgttcactggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 718057 - DNA, 411 bp, Homo sapiens
  misc_feature (5)..(5): n is a, c, g, or t
  misc_feature (319)..(319): n is a, c, g, or t
  misc_feature (321)..(321): n is a, c, g, or t
tcgangctgctgtgaaccgtgtaatggcaatgatctcagctcaatgcaacctccacttctcctgcctcagcctcctgaagtagctgggactacagcgcccgccaccacacccggctaatattttgtatttttagtagagatggggtttcactgtgttagcccaggatggtctcaatctcctgacctcgtgatctgcccgccttggcctcccacagtgctgggattacaggcgtgagccaccacaccaggtttcagacacaatttttaaacaatttctaagttgctggctaggtactgcagtcgtcgtccctccagcagntnccaagtgggccgactcctcccacctgcccagcacccggtgttggagcttcagacaagtcacatggcctcgctgtctatgggaacttgtgt

SEQ ID NO: 718058 - DNA, 211 bp, Homo sapiens
caacaaatatttatcgagtgcctagtatacatttgacattgtttctaggcactggtgacacagatatgaacaagataaaccaggcccttgtcatggagctgaaattctaagggcgaaacctacaataaacatgaaaaagcaacatacgaaataaaacagggtaaggtaaccaagaatggctggtggctattttagatggggtgggacaagg

SEQ ID NO: 718059 - DNA, 104 bp, Homo sapiens
ctcccaacgatgaggaatagaccctttggaatttgacgtatacgacgactattgatgatggggattaaggaaaagggcacagatggcaacgccgggagaaactc

SEQ ID NO: 718060 - DNA, 1610 bp, Homo sapiens
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagaaaatcaatcactttctctttgcttttagaggatagccttgaggctagattatctttcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 718061 - DNA, 164 bp, Homo sapiens
agagtctgggcatggttgttgatactactaataaaccgtgcagtcattctgccaggtcgctcggagaattttaccacaatgttcagaaaatagagacacttccggtatctctgagcacaacggcccgggagcatgcattaacctgcatagagctcgcgatcgag

SEQ ID NO: 718062 - DNA, 1618 bp, Homo sapiens
agcgggtccacgcctccctataagacaaagcgcggccgacgggctccgagcgcggcccctgggttcgaacacggcacccgcactgcgcgtcatggtgcaggcctggtatatggacgacgccccgggcgacccgcggcaaccccaccgccccgaccccggccgcccagtgggcctggagcagctgcggcggctcggggtgctctactggaagctggatgctgacaaatatgagaatgatccagaattagaaaagatccgaagagagaggaactactcctggatggacatcataaccatatgcaaagataaactaccaaattatgaagaaaagattaagatgttctacgaggagcatttgcacttggacgatgagatccgctacatcctggatggcagtgggtacttcgatgtgagggacaaggaggaccagtggatccggatcttcatggagaagggagacatggtgacgctccccgcggggatctatcaccgcttcacggtggacgagaagaactacacgaaggccatgcggctgtttgtgggagaaccggtgtggacagcgtacaaccggcccgctgaccattttgaagcccgcgggcagtacgtgaaatttctggcacagaccgcctagcagtgctgcctgggaactaacacgtgcctcgtaaaggtccccaatgtaatgactgagcagcctttgtaagattatttgatcagaatattttgtaatgaaaggatctagaaagcaacttggaagtgtaaagagtcaccttcattttctgtaactcaatcaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 718063 - DNA, 1282 bp, Homo sapiens
tggtaattaagttttatattccataatcataactttaactctgcaacccagctaggcttgggagggaccagggaaacactgtggaccccaaagagggaacacgtgcagcgaagacagccacaaagaatctctaggaactcacgtgcgaaccaacagtgggggtggagggggtgcctcctccgtgaaccctcacagaagaggcaactgactcggggtgcgtaaacaataacacagccaagagtctaaacaccttatatccgaagtgtgtgctccgacagagttacgagcagagtgcggtgaactcttatcgtgtgcgcgggtctcgtgtggcacaatctcgcgtggacaccacaagaggggccctccgagatggccatcacaaacaatatctcagtgcccttttatatagcccactatttgtgcgcacaaacacacaccccacagtgtgtctgtgtgccaactcccagaacagccactctcaggaggactcgtggggacaaagtgtggcagagacagtgaaacaacacaccgtggggacacacgccaaatatgtagcgtcgatgagggggtctccagaggcaatatagtgtgacccaagtgagacaccgaaagcgaaagtggccgcgaggagacaaccccgcgagaaaagtgacccatatacagaggggacagctaagacgagccctctcaccaacaagtaccttctccaaaaaacatgaagtcacatcgcccccacaaatcgagaaagtgggccacacatgggcaccacaacgccaaggagaggcccccaaataaaggatgcgggcagctgtaggagtaacaagggtcaagcaagcgacaacaccgccgaggacacacacgcaatgtaagagcgcgccgcggtggggaaacacataaaagcctgccgtagagtcaaagacgcaggcgaaggagaacaccccgcgataagataatcaagagaccgcaacaagagcacaccatagtaacacataaccaaccaccgaaggaggcggcaactcaccgcaggagacgggagcgcggacaaaagaacaatacatacacgacgcggagacgcgaggaaccacatcacagggggagggcacacaccccttgacagcttcacgttcggaagcaacagagcaagacgagcctcgacacacaggagggtgaaagaacaagcgaggcggggccaccccacagagaggagggagatctcacccgaccgccacgacgcagacgacaggcgacggcaaaagagtccggctccgacggaccaggagca

SEQ ID NO: 718064 - DNA, 849 bp, Homo sapiens
tcgtcccaacgctgctcacaaagactggtgggtccatggccctgtgttagttcatgcattcagttgagtcccaaatgaaagtttcatctcccgaaatgcagttccttagatgcccatctggacgtgatgccgcgcctgccgtgtaagaaggtgcaatcctagataacacagctagccagatagaagacacttttttctccaaaatgatgccttggggtggggagtggtagggggaagagctcccaccctaaggggcacacactgagttgcttatgccacttccttgttcaaaataaagtaactgccttaatcttatactcatggcttggagttaccttatattcaggtatatgtgatattttgcctggtttgttaaaattgccccatttagattccttctataattgttcttatagataagtaatttatatatgagctgtgttagtattttttcagtgtgagatctctggattctttcacaataaagctgttgaattttaacaggagtattagtacataaattttctactcaacaattccgagataggattatgcctagtttgtcatatcacagaaaaactccaagttaacttcatgttttggaagggcaggtcgtttttaaagtatttctttttttaactggatgaaaaatcttcatgttaggattaattttcttaatcacctccacactgtacagaggaaactcaagccttaaatgtttaagtaaactctgtctcagttttaggattaaaatacccaccggtggtgtgatgatgccatataccgcagggcttgcttctgtcaagtgtgactctatctcagtaattaaaataagtgctgatctactga

SEQ ID NO: 718065 - DNA, 109 bp, Homo sapiens
  misc_feature (96)..(96): n is a, c, g, or t
tcactcggtacctatctgtgttcggggttggggcgggttgttgggctgggggttccatctacaggcacggcagccagggagacctcagccagaggnggatgcctgaggg

SEQ ID NO: 718066 - DNA, 1005 bp, Homo sapiens
tccaaagaacagttaggagcaggaaaaacaactactactatctttcaagccagtactgccgaaatttcttcatgatcacgttgatctacaagtcagtgccctgtatgctctccaggtgcactgctataacagcaacttcccaaaaggcatgttacttcgcttttttgtgcacttctatgacatggaaattattgcacagacagcacagctcttcttggcttggcaacaaagcacagcaatcatccaccccaagagtttcccgggcaaaaggccacaggcttttgttcccaggtgaatccagtggctaaccctggttagcacaactgctgcaagcacacgaagcacatccagcaggcacagccaagctgcactcaacagcaacccagcccaaagccctttccacattgtgcacacaccatcactgtctgctcatgcatgtaactgcattctgaccctaaccactgcgaaaattcattccgctgtaatgtttctcacaatatttaacgcagaagcacgtcagttcaggatttccttctgcataaggttatctcgtcagtcgtaatgtccttaatccatagtctaccatcaactattcacggagtctctctaatgttctcagcatagtatattagccgcatgcaataattacatcataagttctcaagcacgaggcagtctattgcagaccttctttcgctgccagttatccatagctgtttgaagtagcaaaacctgactagcaccactgactctgtagacaatgcacttgctcagtatacttgcagtgtgcccatactttgaactatcccatttggttggtcccagaccaactctctcaccgtcattgcacgctctgtgccgacatctatctgctggtctcgttaactccacaaagggagtcagtgccacacctcatatcctgcaccgggccacggccagtcttacacaacgttcccgccacacgcacctacagagcgtacccccaccggtccgcggggcaacagg

SEQ ID NO: 718067 - DNA, 647 bp, Homo sapiens
tagtattaaattagtggatttatttaatggtaatttcaaacaattaaattatgaataaggcaaggtacagtaaaatcacgtttggattttattaacactggaccaagtttaactccatatgaagtgtaagctgtgatatcgttaatgatgtctatcaactggtgaccaaaaggtaaaacatttaaaaacaatcatctggaatggtcaagttttctctccataaagggactggccaccttaagggaccccaagtctggcgctgaaacatggagccacatcaaggccgggtaaaggcctgcatagacctaatctggcgatccgggaaacctcttttggcctggagctccccagccccaaactaagctgggtctggggagagggacgcaggcaggtcccaggagtcaagcacacgctggagcaagcagcacaataatccatcttaagactcctcattcggggagggctccacctcgcgggccttcgggggtacgtgccccgggatcttcagcacccggggccgccatcgccgtcgctgggttcttcgggactcatctggggccactggtccggttcacactccgccgccatcagggtgaagctcgcgaaggcgggtaaaaatcagggggaccccaagaaaatggtcctcg

SEQ ID NO: 718068 - DNA, 483 bp, Homo sapiens
gcaacaatagacactgggactactggggaggggagaggaaaggaaatgttgaaaaactgttgggtactatgctcagtgtctgggtgatgggatcattcatacaccaaacctcagtattacacaatattacctagataacgaacctgcatatgtaccccctgagtctaaaataaaagtttaaaaaatcctaaaaatgccaaaagatttataaaaacaacaacaaaaagacattacatggggtttccaaattgatctcttaaaaatcagaagtgggaggagggtgagtatcaaacaactacctattgggtactatgcttattacctgggtaatgaagtaatctgtacaccaaaccgtcatgatacacaattttcctatgtaacaaacgtgcatatgtacccccttaacctaaaataaaagttggaaagaaaaaagtttaaaaaattaaaattaagaaaataaaaaacttggtactaactgaaaaa

SEQ ID NO: 718069 - DNA, 171 bp, Homo sapiens
cacgcgttcagaatacgacctcacgtgccacttgacatggcctagagagatgcctcaggtgtcaccttcacctggactgccctcaatgtggggagacgcgctgttcaatggaccacctgaccgtgacctcgtgtggcttgctacatgggtgtccatgtgtcctgcctgggc

SEQ ID NO: 718070 - DNA, 183 bp, Homo sapiens
attcgcggccgcgtcgacgaggacgtttaccactgcagggtggagcactggggcttggatgagccttttctcaagcactgggagtttgatgctccaagccctctcccaaagactacagagaacgtggtgtgtgccctgggccttactggggttctggtgggcataattattgggaccatctac

SEQ ID NO: 718071 - DNA, 114 bp, Homo sapiens
tctaggttaagcatcagtttgccactctggttgctttgattggatgcacttcgtgagttcgtgcagagcgtcattctgcaatccggattccgtggtccgcccgcaatttttcga

SEQ ID NO: 718072 - DNA, 430 bp, Homo sapiens
  misc_feature (13)..(13): n is a, c, g, or t
  misc_feature (35)..(35): n is a, c, g, or t
  misc_feature (97)..(97): n is a, c, g, or t
  misc_feature (136)..(136): n is a, c, g, or t
  misc_feature (138)..(138): n is a, c, g, or t
  misc_feature (187)..(187): n is a, c, g, or t
  misc_feature (254)..(254): n is a, c, g, or t
  misc_feature (265)..(265): n is a, c, g, or t
  misc_feature (328)..(328): n is a, c, g, or t
  misc_feature (330)..(330): n is a, c, g, or t
  misc_feature (336)..(336): n is a, c, g, or t
  misc_feature (349)..(350): n is a, c, g, or t
ggggggggggagngggggggagggggggggggagnggggggaggggggggggggggggggggggggggggggaggggggggaggggggggggggggnggggggggggggaggagggggagggggagcgaggggggngnggggagggggcgggggagcgcagggggggggaaggggcggaggggccangagcggggaaggcccggggggagaggggggggacaggggcggggagcaaggggggaggggggcaggngaagggggggngggggggggcggggggacgcgcgcgggggcgcgggacggggcgagatggaggaagggaggaananaagggnagggggggggagnnaaaaccgcaccccattcctccccacactcatgggcctacacgctactccacctattccccttttatactaataatcttat

SEQ ID NO: 718073 - DNA, 615 bp, Homo sapiens
tcaggttatttaagttcattggatgggggctttgtccatatttcttgggttttttttgccttttttttctttaaattaggggaaatgtttaacctaaataaatttggggggtttttcatactgattggtttggattttttggaaaaattagggattttgtgtcaatttgaagggggggccgagtccccagatccgccctgtacagtagactttaacatttatttggccgtggtttaaaaactgcgggactggaaatacattggatagtgtgcttatggctgaatggctagtctttcaattgcgatagggataccttcggtagattctctaatggccactttagatccttttaatcctgggctccttccacgcctttcgctaactgtatatgtatcctttattacttgcaagtatgatttttatcttttcgaagactttttggtcatggtaccacctctgttattttcaactatgatgcccctattattttatgcttgaattgtccttagtataatatccatttattatggtaatgatctttgttttaatggtgtttttagttatggctctctccccttttttatagggtttatttctcaaggtctttcaataata

SEQ ID NO: 718074 - DNA, 292 bp, Homo sapiens
  misc_feature (63)..(63): n is a, c, g, or t
  misc_feature (93)..(93): n is a, c, g, or t
  misc_feature (119)..(119): n is a, c, g, or t
ataaggaaagctatataggaatacgcaaaacaggacacagtctctaaccccgtgaccttctanaaagtggacagacctctgctgatgacgcanggaacagcacctaagccctgtgcttnggcatccccgttttctgggttcatgcaatgcttcatcatcagcagtgcagagagctcaacagtctttatgagatgggacataactaagtgcactccaaacataccatgcttttcaacaatctcaaatcaaaatacgaatctacttttaagaaatgtggtaatagtttatgctg

SEQ ID NO: 718075 - DNA, 867 bp, Homo sapiens
gctctatcgcacgcctaagtctgccattgtctattcacccaggggctctctcccacttccaggtcaaggaaactcaacgcctcatatcgatttgcgcccctctcccattctccacgtcaaccttaccttgtacatattctcgtcttttacgcttttatcgaaccccaatacatctggctcccaaccttgccgactattcacttccacggcaatctaccttcccctctacgaccactcggtcaagtagcttacttatctctctggatatcgatctcgggtacattggagacggaaagggagtgataggcggctatatccgtgaccaccttaaatcgtaagcattactagatcattctcaatgcctagtatagtcctgatattgatgtgatctttcgttctttgtattacacctctttccatagattcatggcccaacacagtatataaaagagtggggaaggaactgcatttgcaaatagttcaaatcattgctccatctcaactacgcagttcacaaagtgtgaagaaatttgatcatctcaataaagataatggggaaaaaaatatgttttgttctgtgactttaaagtcctgcaatattttacataaatgataatgggtgctttaataagaactcttgatacttttgctattgtattcaatatatgcatataatacaacaggatgatattgttttggatttggaatgtattctttcttatgcaatcttatgcagtatatgttgaatatagtactgaattatattgttttttttgagttgttgtatatgacaactctacatatctggtgccggatcagtcattagtactcaggtatatttctcaactaaactgacaggtgatactt

SEQ ID NO: 718076 - DNA, 1088 bp, Homo sapiens
ccatcatgtctagtcacgtgttttggtttcggcaccatcagtatcaaatgtacaaacggttcttgctaaccaagcgccaggtatatctgatgttcagatgagttccaataaagagataatttttcttgttttttcaaagggggtctttttcttgagtgctggagggcttccaagcaagtccagacagctctgtgtagccccacgactagtctagctctcatctgggccaaagctgttatctcattggtgtcaggggagtccttcaaggtaaattgggggtccaaactgggagggcttggggggcaagaaagtgggggtgtgagtcctgaggtgggaaatgagttcaggtgtcttcttccagggcagcagggtccagtgagcacatgtaagttggggcagtagatcctctgagcctactttctcttctactcagtgaggatgctgcttcctgtggcaggtgatggtgatgtgaagcttagtaagtcatagacgtgcaggtgtctggagagtcctgacatgcagtgggggttccgttccctttgggaatcttcaaaggcagcgatttcatatggcctcaaaccctggcgggggcggggggctcgtgggaccactgtgggggacctgctaaatcctcttcagtctgagcagttcagccatggtcagttaagtatgggtctcggatttcacttgcagaaagagcttgcttctataaaggactttaaaagtactccaaagagatctagttggggagtaaggggagacggttctcaacttagggcgagcttgagatgctcaggcagtagccctttcatcagttccttggcgggtcttgagcaaaatgatggctctagaccgtgctgccaattgtagcgtatcctgtgcactgtaggcctgtgaacggtgtgggtccaaactgtgatacatgcaggtgtaacagaagacgaatttgaaggttggattgtataccaacagaagggtgttacatttgcacaagttttatattgtgtgacattggattgggtgaaaacattattagtgagaaagaaaagaaataaacaaacaatataaataaataaaagaaatcataa

SEQ ID NO: 718077 - DNA, 129 bp, Homo sapiens
cacttaaggacccgcacgttaggaccgaaagatgtactatctggaggcgagcagagaatctgtgaggtcgtagcggtctacgtgcaatcggtcgtccgacctggtataggggcgaagtcacgatgtgtc

SEQ ID NO: 718078 - DNA, 1421 bp, Homo sapiens
ctcactgcgtacgggaagctgcaggctgacagcgggacggggagaaccagatgtccccagtgcgtgaactgatgatacactggagaaagagagactatccacacagggagcagctgcgcgacactcgtaagagccaagatacgcaattcgtctggtgcaacagtgggcagcgcgcgctaggaatgtttcacgtaatgtgtagttggcaaaccgtgtgtagtgttgtggcttgtattgattgttattattaacaatacattgacggaacaaacgcatgggaaaagtagatacaatagggacgtacttgtaaaatttgtggtaggtaccattgcggattattcacgggacgatgcaaattatctgatcagactatactcaacttgaagatcatgagtaagcgaggtggtagagaacggatgggcacacgaagagggaacacacccagggggccaccaccaggtaccatccccgggggagaattgggaggatccatggtgatgatggaccacacagtgcaaccggggccccaagaaagagagacatgaggatgggggaccctaagaacgcaaacccaaaggcacccccagtgagacgcaagacagaaaggggccccgaatggggggatacaccaatatgggaagcaacaacccatcaagctgacagagcaagggcacagggaaaccaccaacagcgggggacaagatcaccacgagcaggagcaaataacacccaaggcgataggaccatccaacacatggacaaaaaagaggacacacacacaaaaaaaaggtgcatagaagagcaccaaacaatctacactcctaaaacacaagagagcccaatccgagcagcgtaacacgaagaccaccacaggggccaaccatatgagcagagaagaaccgccataagatgcagacaagaagtccacaagagaccaaaaatcaaaggacgaaaagaggacatggcaacaatccccacaacagaaacaccgactagaaggcaaaaaaaagaacaacagcatgcacaccatgaggacagcatgaacccaaacaacacaataaaacaacccacaacaaaacacagagaaaaaccaacgaactagcagacaacaccaaaccggcaacaagtacacccacaaccaagaacaagcgaagaacacagacaactatgagagcaaaaaatgaaaaaaacaagcacactcaacgacacacacgcaccattgccacaccacaacaggatacaaacaaacgaacaaccagaagaccaacaacgcaaccaagcaaacaaaaccacgcagaccaaaacaacagaagataccacgaaaacagcaaataacaacgaaccacacccacccagacaacccccacccacacagaacaaaacaagaaagaaaacaaccagaagcagaagaaaacaaaaaa

SEQ ID NO: 718079 - DNA, 247 bp, Homo sapiens
ctccccgatacagggtcaatccccacccaccaccctgtaatcatcatgccacagggagctctagcactagagtgtaagtgggcacccccccatgtaatccccatgttctccttatcagggaaagacaaagaggtggcatcagctccttaagcatctcaatcatgcagattagccagacactgtcttgagccggttcccggactggatcgtcctttcactccagcggactgcaaagcgggtgggtgag

SEQ ID NO: 718080 - DNA, 174 bp, Homo sapiens
gggtactggggacagtgggcaacaacgtaaatccacacaattacaagcaggaaagctttgatcagggagtcacttacacagagcgtgacacagaatcacaaacacagagtactatacacagcccacggaaaattcaggcacaggctccgttggcaggcaggggttttttgcagc

SEQ ID NO: 718081 - DNA, 256 bp, Homo sapiens
acgggtcaaacatgtaggtggatgtgtatatgcacgaactatgggtgtatctctgttcacacacaccctagtttggaccatatttggcttcattactacattatgataacatgggtaaagcaaaaactctcatttaacagaaagctgtagtaaacgacgcaatcagcagccaggtatagactctacatcccaaaccgaacacgaggctatatatttacgaaagaaaatcatttacctccaacaaccctacattggt

SEQ ID NO: 718082 - DNA, 383 bp, Homo sapiens
cattagcccctgaggctatgatagttaaatctaagatcctgtaacccatcttcccttcgaagctactgggaatggctgtataccttatacacataattgtgtaactgtctatgaatccaggagaacggagacaaagcccaggtaaatgcgaaatttaagccattctacaggcatgtaattaagtaactgagctgatgaaacaattaaaattaaaaaagaaagagagagagaaaaaagacgccatttagagctatgcgtgacaaagcacgagagagaccttagtttgcggaaagtgatggctgataagggacaggccacagatcattaaaatgctgggggaaagcaaaatggctcataaaatgtgatatcatcaggctggaaat

SEQ ID NO: 718083 - DNA, 1126 bp, Homo sapiens
ggcgtgtcggcccgggatttttgggatccaccggaccaggagtgtcctgccggactggagaggtcaggtgtgacgtggctcaccctcgtgagcctggtgaatagtgaggacttgcctgtgacatgacccagggatctgctgctggcttctggcagacagggccttgggctgacttctcaggttgtattgaggcctcctgactagcggagttcccaggctagaggtgattggctgcaacaaagatgcttctattagtctattagcagtgccttcgggaccctgggattttgctctctctagaaaggtgttatatatttttaaatttaattatctccccctttattcctggcttagctccagggattagagtattatgcctgtatatagtcctgctctattaaaaaacgggattgaaaactcaagcctattcctgattcaaaccataaataatacggatacttaaagataaacatgaaaacaagttagggcataatgtggacaaggggcatggacagcatcggaagacatccgccatgcaaggaaaggcaatcttctcgcacatctgaaggcaaaagagcataaagcccgatggaaaactcccacgtagaggtagaaagagatgagccagcaaaaattaggaacaccaaagaaacgacattgacataatacagccaaagccaaactgtggaggaacacaataccagaaagataagcaaatagagagactcactatgaagttttaacacacacgatcacaaaacagaataagaaccttatacacaactaaacacatccagagaatagacaatcacccaccagacaaaatcaagagagaataaaggcaacaaataacaaccgaagagaaaagagagaacacaaacgtggcacacaacaacaaaagataatcacaagcccccggatgggagaacgaggaaatatatgtaaaatcacatccaatgaccacattcattacaccaaagagaagaggaaaaaaacacaaaagaggacaagatagaaaagtagacgacataacaacttaacaaaagaagaaaaaaataccactagagatacaccacacaccacaccaaagacaagcaaagtgaaaccagaacacacaacaaaaaaa

SEQ ID NO: 718084 - DNA, 147 bp, Homo sapiens
ggtcgctctagacggatccctctatcgacggtgtactgggataaatatcaacataaaaagcacgccggaactgtttgcacacacagcactcgtttggtatatgctataatacagagttcttcagcaaagtctttatatatacgattt

SEQ ID NO: 718085 - DNA, 871 bp, Homo sapiens
  misc_feature (213)..(213): n is a, c, g, or t
ctcgcgtttcagcggctcactgtttgtgcgcgggccccttggtggggggaaacggccccccacttggtccgggaacagagcacgtgttctcggccacgggcggtccggcgggttgtcgctggcgcccccgttgttagagtgggcccgttatgcgccgttttcgggcccccccattagtggggacagcccgcgggcacaccaccgacgtgtttncctgtgagtgcggttctctcccccagggctttacaatctaagagggacacctccccggggctgtcccactccccccctgcctgtattctatgggcgaaacagcgttatttggggaacacccgcccgcccggaaaggcgcagaccgctcagaaccccggggtgcacctacagtaagccgccccccctgccgccgccccccaccggttctacccccatgcctcccccccccccacatagatgcgagagcaccaagacattaccaacaacccggcagaggaccaagcgatatgaagacaactccacaactaacaatgggggaggggactcactagcccaaaaaaataaagggatctccaacagcagggtacaatctggccatagagacacaggccaccacctgcccactgcggcgttaggcaccccaagacccaccgggaacaacccaatgtccaccgccggagcaaacacggccactaagaactgataagaacccgaagtagagaagatacaacatggacccgggaggcctatggcgtagtgggcccagcgggacgccagcaccacgacggggtgagtcgcgagcagagacaccccccggagttgcaccagagtgagggcccacccgcgggcccccaggggaacttctccccaaaaaaca

SEQ ID NO: 718086 - DNA, 249 bp, Homo sapiens
ccccccccccccctgcccccttccaaccaatgaaaattggattttgggggggtggggccccgtcccctccttaaatggtggcaacccaatggcccccccttcaggcccttgggggattcccccagtgggccccaaacacccccatattttgggggggcaccttttttggactttggagttggggggggtccaacccccccggaactgtccccccccccggatgggccaaaaaattggtggggggcggga

SEQ ID NO: 718087 - DNA, 876 bp, Homo sapiens
agattgctacagcatgcgtctgactggcgagccctgcctggttactgaaccctggtgataggctgtcctatacgagagtcctgagagggccccattgggggcatgcacatacagtccacaagacggctggaggtgaacgagggcttctagagatcagtattccaggaattgcgaaggttcatgcacggtacgattaactggagtctcataaagagcggatgtctcaacccggagtggcgcatatctaagatccacaacctggcctgaggctcacgaggctgcacggagggaggacttgggcacagcctgagtctggggtgactccatttcagtgacctcacagaggaggagtttggccagctctatggctatcgcgagggacagctggaggggtccccagcatgggcagagcaaataaggtctgaagagccagaggagtcagtaccctttccagctgtgaactggcggaatggtggccgggccatctcacccatcaaggaccagaaaaactgcaattgcttgctgggccatgggccagcggcagtgcaaacatagagaccctgtggcgcaatcagttcgtgggatacggtgacaagtcttccgtgcaaggaaactgctggactgtccgccgcatggggagatggcctggcaacggggctccgactggaaccgccgtcataacgtgtcctcacaacaggcggcctggccacgtgaaaaggactaccggtccacgacaaggtagagccaaggtgccacccaagagtacaaagggggccggatcaggacttcatatagtgaaaaacaacagacagaatggcaaactggccataggccaacggcactaaagaacctgcgtaccgaagtgtcgcccacatt

SEQ ID NO: 718088 - DNA, 126 bp, Homo sapiens
taaatcagaatcacagaaacgctgatcagctgaggcatggtggttttgagtgcaatccggccatgctctgagtcagaggcagcccatccagcacgtgctaggtgttcccatacgcccaggtaaaca

SEQ ID NO: 718089 - DNA, 382 bp, Homo sapiens
  misc_feature (51)..(51): n is a, c, g, or t
  misc_feature (100)..(100): n is a, c, g, or t
  misc_feature (186)..(186): n is a, c, g, or t
  misc_feature (291)..(291): n is a, c, g, or t
agcccccggggaaggccaaactggaactggtggggggaaaaaaaccccctnaagggactttggtgtggtggtggtggtggtgtggccctttttctctccnagcttcaatcactggataagaagatttcacccagaactcccccccaggattgccctattttcccagccatcttgttaaaaagttgntccttgtgttaaactaaatttgtctttgaataccttggtccctggctgagcctcctgataccctgcagatgcagtccacccatcatccactcaacagcctttcanccaggcaaggataatgaccatgttggcattctccccacctcctgctcactgtctttttcctatttttttttactgagagcccatctcatta

SEQ ID NO: 718090 - DNA, 153 bp, Homo sapiens
ggtctcaaaaacaaaacaaattacactacagtaaaattctagtacagcaaatcgggatagcaaattagcaaaggtgtgatattctaaaagtaacctagggttggactaacaggaaagtctatccaagggcggggcgtaggggctcaccagggg

SEQ ID NO: 718091 - DNA, 532 bp, Homo sapiens
gtctgggcgcgcgcgacgtcagttagagttctgtgtactccccgcccgtgtccgaccgaccgtgcccgcgatgctggcgctggctgcggtcccgatggtcggcctgctctccgtacccggctccgtgccagtggcctccccgcggccgcgcctgcagcaagggctccggatgacccgtcctcttcctcctcctccgggaacccgctcgtgtacctggacgtggacgccaacgggaagccgctcggcgcgtggtgctggagctgaaggcagatgtcgtcccaaagacagctgagaactacagagccctgtgcactggtgacgaagggcttacggctacaaaaggctccaccttaccacagggtgatcccttccttcatgtgccaggcgggcgacttcaccaaacacaatggcaccaggcgggaagtaccatactacggaagccgctttcctgacgagaaactttacactgaagcacgtgagggccaggtgtcctgtccatggctaattgctggtcctaaaaacaaaggtcaca

SEQ ID NO: 718092 - DNA, 598 bp, Homo sapiens
atccagttgttgtcacacctcttgtacaaatggcgaggttcaccctgcggcttccaaggcgctgtgatgataggacgtgagccgcactgtctgctggcgggtgaattttctatgaggtacgacagcccaaaggtgccgctatggacgcggaagcctgtggctacaatacaagctgagccaccgttgcctatggaaatttgtaatgtcgcctctagatactaatagcattgggagcgggcactgcatgaacgcagtaatgccgcactgaggagtgcacggatgagtcgaaaacggtggctgcctaaaacactaaggcgagcgaatgacgatggtgctcctgatgcagagtcctacgggagtacagagtttagacacgtctacaggatggacacaagcactctctgtgggactgcagagcaccaataggttgggaacacggaaatccgtcggtataggaggactgcgtagaaaaagggtagcaagggagaaacttcccaggttagtaggcgggcactctcggttttcaaacctttggggtcaacctgtgttgtctagacttgttaaacgcgtttgccacctaccaacctacctttgaata

SEQ ID NO: 718093 - DNA, 339 bp, Homo sapiens
taaatgcagagtactactggaaagtgcctacaggctttcatagccatcttcgtgtcattctaacatcagaatgaaacttactaaaaatctcttccatataatctagataatggtcccttactgatttcctctttaatgctgtgcttatttccagctgttatcagggccgaatttgaagacagaaaagagactatgttaatacgcagtctccctgaaagcaggaaggaagtcctttggactgattaaggccagcatgacgttcacagcgaacaagctcattctggcgaaatcaaagcagtaattccagtgtttgttccctgtcagccatgtcagcagcca

SEQ ID NO: 718094 - DNA, 484 bp, Homo sapiens
  misc_feature (30)..(30): n is a, c, g, or t
  misc_feature (73)..(73): n is a, c, g, or t
  misc_feature (216)..(216): n is a, c, g, or t
gggaattccagtaatcagagatttgggggnaagctatgtggctattattattaaaactgagttctaaccaggncaaatccagagttgaattacttctaactctggtaccacagcagttgcctttttttcaccactaacaaactttcttaaatatacgtacgaaatatttaaagcaccagccaccccaacaaagagctgcttatggccgggcggtgngtgtgacgcctgtagtcccagcagtttgggaggctgaggcgggtggatcacctggtcgggggatcgagccatcctggctaacacggtgaagccccgtctctactaaaaatacagaggattggccgggcgtggtggtgggcgcctgtagtcccagctactcagagaggctgaggcaggagagtggcgtgagcccgggaggcggagcttgcagtgagccaagatcgtgtcactgcacttctgcctgggcgacagagcaagactctgtctc

SEQ ID NO: 718095 - DNA, 872 bp, Homo sapiens
aaaggctttgctccaggggcaaaatcctagagaattctgcacggagctatcagctatcccagtttgcacaattcatgcaagacacttatgccgggggtcacctggctacaaactcatgaggcatctcctggaaagcttaacttcgttatccatcccatctcttggacagatgatgccagttaattaatctcgaatgggtctgtcacacgcagcccaactcaacatggagtccatgatgaaggtgaacagatccatggatggatggccagggaactcaccagaagtccccaggcatcagaacaaggtcgaagcatcctgattagggtaccagtaggccctaggcagtacttttgtggtaaacgaggtacagacctttggctcctcactgtcttcaagcccacatagaaagcatagagcagatagtaagacagacgagggcccatctggcccaactacctgttcttgtaaataaagctttattgaagccaggtgctcaccttctagcacattcttcagagtagttactctgaggcaagccagcacgccatgtcatgaggacactcaagcagctccatggagaggtccgatgggcgaggaacagaggatcccccagctctactagctcacatgaggaacaggcctcctgccacagccgtgacaaagccggagacagccaaatatgatcccgcttacctattacttaggatgcccctcttgctaatgagcacaacgtagctttcactgcaccaccaacaggagcgtacctgaagcctctcgtttttcagctataaagccttcccctcggcctgcctttgagtataccacgaaggcaggacagtgcgcataccggggagctcgtaaaacatggaccc

SEQ ID NO: 718096 - DNA, 398 bp, Homo sapiens
  misc_feature (21)..(21): n is a, c, g, or t
  misc_feature (180)..(180): n is a, c, g, or t
  misc_feature (186)..(186): n is a, c, g, or t
  misc_feature (236)..(236): n is a, c, g, or t
  misc_feature (377)..(377): n is a, c, g, or t
aagagatggggtatcactatnttgcccaggctcggtctcaaactcctggactcaagctatctttctgccttggcctcccaaagtgctaggattacaggcatgagccactgtgcccagctagttgcttacttcttaagtgacctaatggtgacttcagtgctccgagggcacttcctaggntatttnggtgggccctcagtaataaagagattgtataatctttgtaatactgattnagccaatttatcttccgtacagtatcatcactttcattttcgatactacttgcaacctgaaaaaactaaagcctactaacatatgctaaccaaaaatacctacctttttagtgccattaaattgtaaaattccaaaggtcntggaattttcccaaaaatttt

SEQ ID NO: 718097 - DNA, 162 bp, Homo sapiens
caggctcttttccatcaaatgcgttgttgtactttcagagcacgtttaaacgtcagtttgttttccctatatccgacttgttggcctctatgaaattccctctgccgcgacctttgtacgcccatctactgtctgaaggggaacaactgcgtttcacgggga

SEQ ID NO: 718098 - DNA, 275 bp, Homo sapiens
cctccagggttcagttcaagcaattctcgtacctcagcctcccaagtagctgagataataggcgtgcatcaccaagcctggctaatttctctacttttagtagagacagggtttcaccatgttgaccagatgggtttcgaactcctggcttcaagtgatccacccacctcggcctcccaaagtgctaagattacaggcataagccactgcacccggccacattctctcttttccttagatgcagataagtcaagagagagcgatcagagaaaggg

SEQ ID NO: 718099 - DNA, 264 bp, Homo sapiens
tcttgcgcttgccatagtaaaactccttgtaagctgtttcgattatgaagaaatgccacaaagccttaccagtatagaagtgtttaatctcttaagcggttaaacggtaaaaacagttaaaaataattaataatatgtacccagtattaacgacgctgtatgggcgggtgcatttgggctagcgttcggtgccgcgggcgatggcggtcaatgaagcgccactggggtgcgaggatggaccgaagctcgccggcgagtgcaacg

SEQ ID NO: 718100 - DNA, 1276 bp, Homo sapiens
ggagttgctcaccgtgcttggagtctgtccatgctgaggaccctgtgaaccagaggtgtgtcgcgtgtctccgtgttgcactatactggcactgactataattcatgttaaccatagaagagatgtccctcagaaaatgaagggaaatggtcaacatatgctggtgtagctggtcatggaattcaagaagacaacactcctcacaccactggaaccacctaggtgatccctcctggactcagcactcagcaaccagcacaaacgctactggtgtccctctgtctccacgatctttccctgagtacaaacaggtagccctgcgtgagtaggcatcttccatcatcagagatctccaactgaagctggagctgcagccagtcacctggttcttcagcaccaggacaagaaatggaaactcagtttaaaaagatcacgtcaaaaggctaaatggtacaagatgacccatgggttgggaaagacagaccccttatatgatttattgactggttacttcaggtatggaatattctcacattggattccacatgttaacttagtaatgtccttattgggcgtcctacttgattcttagatcaatatgcctgcatctctatctaaagtgtgtgacgaaactaactctgatagtagaggctgaattttacacgccaattcttggaagggtgaatctcggaccattcctggcctgtgtgtgcgcgaataggcaactccagttagggggcgccttcccaggaagaagcggggctgcgggatgtcttcttacgcctccagagcgacatgttgtcgtgctgttcactggactctcttaaataacaaacaatgcgccgccgtcccctactcactcctccctccgcgacacgcgctcctgccaagaccgcagcccgccggccgaccgtgctgcacctccgtagactacaccagctccgcgatgcggcatcggcgcctgctcccattcctccgacacttcctaccttctgactatgcctcgtctgagcgggcacggccggggacgagagcgacggcgcggcgcgcccacggcgcgccacggccgcgacgcttccgccgccagccgtcgcggtggcgaagcagcaggatgccgccgtgcacgccgcccgcgcctgcgtccggctgctggacgtctctgtgaactgcacccgccgactgcatggacgggacgagtgtgtgagggagtcgttgcagcgggctcgcgtcgagcgcgaacgtccaggtgatccgatgcgagtgggcctcactccgc

SEQ ID NO: 718101 - DNA, 344 bp, Homo sapiens
  misc_feature (212)..(212): n is a, c, g, or t
  misc_feature (224)..(224): n is a, c, g, or t
cagtgaagtttaataaaagtgctggttaagggtggacagaactagaagaggtagatagggattttcacctgtgaggtccatggtgtatactagtttgcatacgacgttcactgcaaggggggcaacgtgtgggttgctatattaaagaacaacgagcccgtgatgtagaggtgggaggagtaggaggagtgagggcaaatcaaagaggtagntgacaaacatanataggagattgaaattagggagatgtggtatacatgttaaaatataagaacaggctgcaggactgtatgctgggcagtatgtccactcctccttgggaggatatttattgtatcccatgt

SEQ ID NO: 718102 - DNA, 1331 bp, Homo sapiens
  misc_feature (1321)..(1321): n is a, c, g, or t
tccatgatccaacatcgaggtcgtaaaccctattgttgactatggacctctagaaattaggattgcgctgtttactcccatagggtaacgttggttccgtgggctcgaacgttatgggactcaatgtgagtatagtagtatcgcttagactggtgaagctctaagcatgtactgcctcgagaggtggggttctgctaccgaggtcgccccaaccgaaattcttccaatggcaggttagggtaagttaaggacctggtgggtatggtcaaggtactgagttcggctttcatataattttaagagtctccataagggtacttctacgtactaggctggtggtcatgagcccgctctcttcacgggcaggtcaatttcactgggttcaacaatgtaaagaagacagtctggaaccctcgtgggagccattcctatacaggtccctaatttagggaacaagttgacttatgctacctttgcacggtttagggtaccgcggccgttaaacatttgttgtcactgggcacggcgggtgcctcataaatacgggtgatgctaagaggcaggcaaatgttcttgggtaaaacacgggcggggtacagactctgcccagagttcctcttcacttgtttctataaaccctttccctttattgaaagcattgttcttgttcttcgcgctttagacacgtcgcacggcgtaaccacctgcaactatggctctcggcagacactcggtaacaattctggagcaccgtgacacatctggccaccaggcccacgggtgtcaaaacaccctcgtgacacccacgcaggctataatcatgaccggcgcgagcgaacaccaacggtgttcccacacgcggcgccacgctacatacccaacacgcataaagtatgacaacccaaaaaaaggggggcggacagcaaacagtgccgcccccacaggcgggcgcttgcgagagagaaacaccagccaactcgttccgagtggcgagaataataccggaaccaagacgggtgcagagaacaaacagcatatacagagagaacgagcggaaaaagagccgacccacaaggccgacgaaataaaacgactcactccgagacgatgagtcctcgttaacaacaacaacgtcgtggtcgtactagcaaaacaaaaggagcgaaaagagatggacgacaaaactaagcatcatttactcacaacatgacgatgagtgtgcgccacttcaataacgatgcagaagtgactcaggtgctcatctctcttctcttgttgcttgtcttcctctttctgtccgtcctgttttgatgctatacanaagaaaggaa

SEQ ID NO: 718103 - DNA, 200 bp, Homo sapiens
tggatttgaaatggtttttctccatggcaaaattaagctagggaaacactaacccaaaaactttctgtagagcggatccttggaaggcagcatcacttatgggcagtaaagactcagtataaaagcaccagaggtaacccttaatttaaaacaccaataaaataggtgtcacaggagaaaaaaggtcaaaaaaggggcgg

SEQ ID NO: 718104 - DNA, 474 bp, Homo sapiens
  misc_feature (297)..(297): n is a, c, g, or t
ctaacttaggtgcatgaagagtcccatctgagcaggaagacatttctctttcctgcatatgccacttcttgctcgaggtagcagtgctctatcttcgtcctcagtggtcgtgctcgtgtttccttgtgtgccccagctggacggttccctgaggtggaacttcctctgagaatctggcgatgagctagggagatgaagtcggccattcttctgtgcaaagtattctacaggcaaaagtgatgcgcagtttcctctgagactgctaggagtaggagaatccaacgagcgatgccctgngagactctgggcattcctgaaccattatccatgcatgaaaaacccaaagtggtccttaccctatatcactctgaatgttgtgttttctccactgtctcagcacgcctcctaaattgaagtgcctagtgaagagtcccatcatgagcaggaagacatttctctttcctgatatgccat

SEQ ID NO: 718105 - DNA, 193 bp, Homo sapiens
  misc_feature (8)..(8): n is a, c, g, or t
gacgggtnacatgttggccaggctggtctcgaactcctaacctcaggtggtaccacccacctacaattaattttagtcttgcggttaagttaaagggacagtggcttctagctgcccttactgatctcacttagtggattagtgtataaaccgaggctctacaacagcccaagatgtcactttgaatctggga

SEQ ID NO: 718106 - DNA, 186 bp, Homo sapiens
  misc_feature (174)..(174): n is a, c, g, or t
ccaggtaggaatagatacagtcagtctggttcagagcctgtatgacaacctgtagttagaagtgaattgagagcaagatggaatatcaaaatgcctttaccatcctgtacagataagtgtttttcctattccgaaaagatggctgctaagtaggtatttattggtgcatctgtnatgggcagggca

SEQ ID NO: 718107 - DNA, 684 bp, Homo sapiens
  misc_feature (4)..(4): n is a, c, g, or t
  misc_feature (92)..(92): n is a, c, g, or t
  misc_feature (165)..(165): n is a, c, g, or t
  misc_feature (180)..(180): n is a, c, g, or t
  misc_feature (188)..(188): n is a, c, g, or t
  misc_feature (255)..(255): n is a, c, g, or t
  misc_feature (328)..(328): n is a, c, g, or t
  misc_feature (403)..(403): n is a, c, g, or t
  misc_feature (421)..(421): n is a, c, g, or t
  misc_feature (423)..(423): n is a, c, g, or t
  misc_feature (448)..(448): n is a, c, g, or t
  misc_feature (462)..(462): n is a, c, g, or t
  misc_feature (464)..(464): n is a, c, g, or t
  misc_feature (494)..(494): n is a, c, g, or t
  misc_feature (498)..(498): n is a, c, g, or t
  misc_feature (552)..(552): n is a, c, g, or t
  misc_feature (579)..(579): n is a, c, g, or t
  misc_feature (591)..(591): n is a, c, g, or t
  misc_feature (615)..(615): n is a, c, g, or t
  misc_feature (657)..(657): n is a, c, g, or t
agtncaggatttttttcaccagaggacattgcttggtccccagagctcaggaccctgtgttttgtcttacttccacccacagagctcctgtntccaggcatcaactccaactcccacttctggaggccgaggcaggaggatcacttgagcgcaggagttcgagancagcctgggccacanagtgagancttgttttcacacaaaaattttaaaaatagctgggcttggtggtggcatgtacctgttgttctagcnactcgagaggctgaagttggaggatcactttgagcccaggaggtggaggctgcagttagcagttatcactgtnctccagcctggtgacagagcgagatcctattaccgccccccgccccatcaaaaaaaaactgagtagacaggtgtnctcttggcatgaaaagtntnaagttccctcccagaactgtgaaanttgacaggtgtgtntncctctggacctcggtgtccccatctgagtnaganaaggtagttgggaggtggatcttccagttgaagcggtatagaagcacgttttanaagccataatccaaggggctccaagtncagcgcacagtnccagaagggcccagcaaggcagcnagggcggcacaggcaccaggtcccaaccttcttccctgtttncccactcttagaccccggagttcatca

SEQ ID NO: 718108 - DNA, 311 bp, Homo sapiens
atcgaggtactgtcgagcgcccatatcaactttaccgatgcctcgccgatgaagccatgggccaacacacccgctgttgcaacgcctgggttgtcagtttcattggcagaacctgtggttaccgcgacttccaggatttcctcgacgccctgagttcacgcaaggccgcaaacatgctgcgcaacagagcgcgacacaagtggcagggcagggtatcgagttcgagtggttgcaaggccatgagctgagcgaatcccagtgggcaatatgtttacgcctgctacgccaacacctacgcggtggtcggcaat

SEQ ID NO: 718109 - DNA, 148 bp, Homo sapiens
  misc_feature (51)..(51): n is a, c, g, or t
  misc_feature (97)..(97): n is a, c, g, or t
gcttttcggaaggcggctaagtcccggcagcgggaacacagagagcgaacncagcctggctttcgaaaacatctgggcctgctggagaaaaagaaanattacaaacttcgtgcagatgactaccgtaaaaaacaagaatacctcaaag

SEQ ID NO: 718110 - DNA, 872 bp, Homo sapiens
taaatatgagaatattttaattatttaatcatacggaaaagattaaatgtccacatacatgctttttggaccattttggtagtcggttttaattttttaatcttatttactatatgcttaaataaaatggtcattttgtggataattatagattcacatccatggtaagaaataatacaagatactatacaaggataatatctggccaaactacaggacaatattatacccaggatatggacatgtgatacagttaagatatagaacatttccatcatcaaagggggtccctcagtgtggccttattacagccacacccagttccctcccacatcaacctgtccttgactcccggaaaccgcataatttggtcactttcaagaatggctatataagagggaatcatatattctatgattgaacaaatgaccttgtgagatggccttttttacttcataattggcgggaaattcattcaggtggctgtatcaatagtcattccttttcactggctgaggaataattgctgatgagatatacatgcttcttttttagcatggtcctagaaaattaataagaacagcactttcaacctagataggtctttcctaaggtctaaatacttatattgtgccgggtgttgggtggctcatggctgtaatatccagcctttggaacctgagcaaggtgaatcgctgaattcacgagtgagagtcccggccacagggtgaatctttccaaaatacacattactgcctgtgttgtaccacatagagacaggaggagaacggacagagtagggttaggccattgtcactcaccctggtgataaaacgacatatatgattacgaaaacacgactggatgagaca

SEQ ID NO: 718111 - DNA, 363 bp, Homo sapiens
  misc_feature (34)..(34): n is a, c, g, or t
  misc_feature (67)..(67): n is a, c, g, or t
  misc_feature (121)..(121): n is a, c, g, or t
  misc_feature (132)..(132): n is a, c, g, or t
  misc_feature (342)..(342): n is a, c, g, or t
gttctttgatgccaggcatggtggcccacaattntaatcccagcactttgggaggccaaggcagggntcacttgaggccaggagttcaagagcagccttagcaacatggtgaaaccctgtntctacaaaaantttaaaaaattagctgggcatggtggcatatgcctgtcattccagctactcaggaggctgaggtaggagcattatttgagcctgggtagttgagggtgcagtgagttgtggttgcaacactgcactccagcttaggcaacaaagcaagaccttgtctcaaaaaaaaaaagatttattctatttgatagttaaagaattcaatgctgggtnattctgaggcagaccaaattt

SEQ ID NO: 718112 - DNA, 503 bp, Homo sapiens
cgcaggcaatcataactcattggaggataaagttagtgctggatatgtggttcctgatgcatttgacttgtctgggaaaatgctttatcttgtactttaaatgatttatttcaataaaactaattgggaccacccgtatttcagtaggacctgggtagggattggaagtacttggcagggcagcagcaatcttgctgtgtttgatataacatgcatccttgggcaggttgcccttaaatcttacactgtggtgaagggatgtttttttttgtaatgctgcagtagagttggagtacttagttctcttgttgtccagtatatctaataagtgtttttcatattatttccacgtaagggaaataaggtagtacttttctttttatatttctatgcttaaaattctctttcctagtcaaaaattgcccaaatctgtgtttgctttctgcttgctacatttgtctcccttacttttcttgagctaaagacaggctttttccaccggc

SEQ ID NO: 718113 - DNA, 815 bp, Homo sapiens
  misc_feature (472)..(472): n is a, c, g, or t
  misc_feature (815)..(815): n is a, c, g, or t
taaatgcagtaccacgagtatagccctggatgctggagaatgagtttgaatcctggcttcaccacttatgatggaatctacttaagttctctgcacttctttggacttcagtttcctcactataaataattataataataagatctccctcactgggtcattgtgagattgaatgcatgtcatccatgtaaaatgcctagaacagtgcctgacacatagtaagttatatgaatgtctgctattatgataaggtagtatgatattctgctatggtttgagatcaatatgcaaaaattggtagtattctaaacactgcaacaaatagcgaaaatatataatttgtaaaagatcacttttatataacttgtaatagcataaaaataaggtacctaggaataaatctaacaaatgaggcgcatgatctttaaaaagaaaattataaaattttatcaaatgtaattaaagagactanaaaaaaaaaaaaaaaaaaaaaaaattttgggggggcgggccgaaaaagttttaaaccacttcttgggcggggggccatgtttattacactggccaaggtccaaggaaacctcggcgctgagtatctgtgttggtttccccataaaaaaccgcggcgcaccggcgctgttggacatccaaggcgttcgggctaccggtttcacgggtccacgatcgtagccccccctcgccgtgcttggacccatcaaatcaccaacgccacattataattcttcaaatattaactaatagcgacaattatcgaacagaaacattcactttttattctcatctatttagctaan

SEQ ID NO: 718114 - DNA, 395 bp, Homo sapiens
gttatttgatctaaaccatcaggtctatgccgaccccagataagtaactcatacaaggagttaaagcgcaattatgtgttttatctccagtacattgccatcattgtcagttatgtagctgctctacagataatctcagtgcgtccttgctgggatgacacaaatctactgccggagaatatcaacaccaaacacattggttcaccgttccacgggagcgaacagcacacagcatatcataatgttctgaataatggccaaatctactgccggagaatatcaacaccaaacacattggttcaccgttccacgggagcggacagtacacagcataccataatgttctgaataatggccaagtcgtcgacgcggccgcgaatttagtaatagtagta

SEQ ID NO: 718115 - DNA, 347 bp, Homo sapiens
  misc_feature (295)..(295): n is a, c, g, or t
  misc_feature (329)..(329): n is a, c, g, or t
  misc_feature (338)..(338): n is a, c, g, or t
acaagctaactgtaaaggctgtttcaaatagcagcacacaagccatatcaacctgggaggcagtaaataaacttagaatccccaagttcatattccacctttcaattgaatgcaggtggaatgcaccaaagacctcgtgtgttttgttgtttttccctgcggtgtgtagtctttcatggctagacctactaaaatgctaaccatcactcctatgttggcttggctttggcatcaaacttgagagcagcaaattgagcattccctctgtgtgtggtgtggggaacgcaaccgaggnttctcatactgtgccagggatgagggataaaggnaagtgtgtncattaaaat

SEQ ID NO: 718116 - DNA, 105 bp, Homo sapiens
tggaatgatttggatgtaggaaaatttacagtagaattcacaggctttatgtgagtaaaggctcccccctttcattaagtgctgccatatctcttagctctgtaa

SEQ ID NO: 718117 - DNA, 136 bp, Homo sapiens
cacgaggggaggatagacgcctttgctcagatggacctcgacacccaatcggaggacgacacaataaatggaaggcttctaactccaaggagaccgaccgttaaaagagcctcccggatccccacctgatgtcacc

SEQ ID NO: 718118 - DNA, 495 bp, Homo sapiens
  misc_feature (133)..(133): n is a, c, g, or t
tatcttaaagacatggggtaggttgagggcactgtacacttggtccagtgatggtgctctaagcaacagaatcacagggtgttctcagtaactgatccccatggtggcaggacagtatctttaattagaatanacccctactcccaccccaccccacctcagtgcaattcccaggagcgcttgctaatgatcgttgcccttctgaccttcactttccgaacttcattggcctggaattcaggtgtacagttgtggtggatgaagccaataccgcctgtaagctacaggataaaaagagactactactaagtgacaagaagcaggactgaatgcctttggggaaaggcgatggagtccttgctccttcccccacaccccatggggctcaccgccattgctatggccatcccagccttggtcagagcagaagtcaggtcctgaggagacaaacgtcaaccagtgtgggaaagcatcccttacacctcaaggtgttac

SEQ ID NO: 718119 - DNA, 603 bp, Homo sapiens
agtgggtcctgccttgacctcctaaaatgcgggattacaggtgtgagccacgtgccggctggatggtgcaaattctttaaatgctggtagaattaatcagcaaagccttaaggtcctgggctttactttattgggaggtttttgattactgattcaatctccttacacagttatagttatattcaggtttctatgtcttcatgacattcttcctaggttgtgtatttctagcaattcatccatttcacgtagactattcaatttgttggtatacaaatgttcacagtactctcttgaactcctttttatttctgtaaaatcagtagcaatgtcccctttcatttttgatgttaattatttgagtcttctttctcttagtcaatctagctaaagatttatccaccattttcttgatcttttcaaacaaccaactcttggtttcattgattgcctctgtcgtttttctattctttgttttacttatctctgttctaatatttgttatttccttcctctggctagctctgggggtttttccttttcctagttccttaaggtggaaagttaattgttgatttagacctttattcttttttaatgtaa

SEQ ID NO: 718120 - DNA, 183 bp, Homo sapiens
agcaagaagaagaagagaagaagaagaattgagaacacacgagttccatggaccattgaataaagggcaatagactgacctgtgtatgtgtatacgtacaatacacactcacgcagtccaataattgaaaataggtcaaattagaaccagagagcagaactacctcgtacctacttggaaaac

SEQ ID NO: 718121 - DNA, 101 bp, Homo sapiens
gcgcagaagtgatagttcagtaagaaggatgtgattgagctgacagacgacagcttgataagaagtctggaagtgaagatgtttggatggttgagttctat

SEQ ID NO: 718122 - DNA, 538 bp, Homo sapiens
gcagagcttttgcggcgctttccacagcagaggcctaggacagcacacctgctctgtctctcctcctcctgccccatttatttcttctttacactaagcacttccagttccttcttcattcctctagggttcaagtttccagcaccttcagccatcctaaaatgccctcttcctttccttcctttattcttgtcccagtgttcaatcacctggttgctgagctgacctactgctcatgcaattgggctttttgcagagagctaagcattttgtctggagttggaagaaggggaacaggagatctaatggattcatggggctaaggctgatccaattaagaccctggcaggatcacctgcctttctgaccttgaccttgaactgccatctttgacataaatttgaactagtggggacatcataactcctaggaagcaaagaagacaaagaggtgaaaagtgacctcactcaacctcaaagacatacagagcccgagtagtctcgtgtccccaataagtcatgggaaagggcaccgcaaa

SEQ ID NO: 718123 - DNA, 120 bp, Homo sapiens
cgttcttactggcaggtcttcttgaccagtggcttagcatacaggcaggatggctgcgagtatcacagactgttcctgcgcaggtgtgagtgggtgggtccctagggccatcctggcctg

SEQ ID NO: 718124 - DNA, 985 bp, Homo sapiens
ctggccctacccaccctatgctcatgtgcctggcagagccagcgctcgcggatgcggctggtgcgcagtagcgggcctggacagctggctcgtgggcttgcagtggagggcggatctcgtgtgtcggacccgcatgccccagacgccgggcttggtgggttccccccgcccctggactcctgacagtcacgtaccacacccatagcctctccaactgagctctggcgccgtggagaggattaacgacccatggaatggcagtggtggactcccgtttatccaagtgaggtgggctgtgcatgtgtgtgcaccgacaggtggcagtgaaccagcaggctggggcactcctggagtcgaggagtgacgtgggcaaggttgacttggacatcagtgcagcactctcgagacagggccctactccgacatcaggcatgaactccaggaccagatctgctaggggctggttcagcagcacgccaatccaactctgaggtctgacctggaagctgccacaagatgggccaggctccgagagcaactaaacctcaggcccaagaggccacgaactatacagtgacaccagaatccctgatgcagctgggaggcacggccgggaagttgggtaacccaatggctttcctgtccttttggggaatccatcacgggtgacaacaggcctgtgcaggacggcctaggggcatctggcaacactccaggacaaacgaagagggctggagcaacgctaactacacacagagtagatgggcaccaaagtgtaacaaaacgtatcggaagcgccaaacagggaagggaaacgaaaggaatggacgacaggggaaaacaagagtgatgcagtgcattagaagacaataggctaccggagaacggccgggacctacatggaccatggggcgtggggaaacgcacccggatccgtggggccactgtgtagcggcaaagaactagctcttgggctgacacaagg

SEQ ID NO: 718125 - DNA, 231 bp, Homo sapiens
tagcatcctcaggagtagtgtaacgagcaaattctggaaagtaagtcctcaatcttcgatttcacagcaaggactttctcagcgagcagatcttgcattgtagaggaacagggtcacagagatggtgcgcagccatctgttgttccagattgtacttgaagaggttcagagcctcctgcaagcggttggtctggtagtcctcccggatgaacatgttgtagctgctgctgg

SEQ ID NO: 718126 - DNA, 178 bp, Homo sapiens
tcagatcgagcgaggatagagtcagttatacttttgggattccttctaggtagcggagtgttgagcttgaacgctttcttaattcggtggctgcttttatggcctactatgggtgttaaattttgttactactctcatacaaggttctgatccctagtgtccaaatgagctgttcctc

SEQ ID NO: 718127 - DNA, 971 bp, Homo sapiens
gggaaggtctggaaggccggggggttcgagatcggacccaggtccagatagaacatgacgggtgggatgaggacgtgaacagaacatggccaaggcaaggatctgggggagacagagcaggacgaggcggagctgatccgagaggacactcgcaggggtgctctgcactaattaccggtgcgcgcgccgcggggacgcgcaggcggcggcggcgtcaagggccacggcgaggaggagttgcagcgcgacgtgtcggccgtcgatgagagcccgcccctggaggacgccagtccggtcaggccgcgcagagagtcaagactaccgtatcagcggggcgcgggccgcggacgaccccaggcgagagcccattcccgaggccagaggaggcgcagaggccttgagccggtggggacctcgagcaacgctgatgtacggggcctccccgtgaacctgtgagttccccgcggggtcctgatcctggacgagatggctgcgggcggagacgggaaggtggagcgatcctgaaggcagagtgttcgacgagcgatacagagctttgtatcgagggctgtcgaactcggcggagcgcggacagggatgcttggagacaccgggaagcgcgggcgaggagccggggcagggacggctgggggtaaatgaggcaccctggggcgtgggagtattgaaagacgcatgccgaagatctgttgcagagagaggaccccgggtctgcccccagggtttgcagctagccgcaattggcagggtgaggattgacgggccaagttataaccggggtgcacctgtcgacttgatggccagggtgtgggagcccgcgatacccatatgcgtgggcgaatgtatacactctgaggggatggggagctcgggcacacgggcatcggcagggaagtacgaggtgtggaaaaaaaacgtatcacatggccggggtggagataagagagacaagg

SEQ ID NO: 718128 - DNA, 266 bp, Homo sapiens
tatttatattggttttttaccttctgttttgattgaaattcattatcagtaagcccagagccctttatgacattgttgaacaggcggtcgttcctgctattcagtgttaaataaaattcctattatatctctaatctcagattataaaatacctaatgtagtactatatgcatattatagggtcttttatgatcactgcattcccttgtattaaagaaagaaagaaaattctgtgtaatagatccttggtaaaaacttgaaactgt

SEQ ID NO: 718129 - DNA, 438 bp, Homo sapiens
ggcggaagtggagctaccgccagcgccgtcgccgattccggagccggggtagtcgccgccgccgccgccgctcgctggcgagcctactgctaggcgagcgtatgccgatcggcctggagtagtgggcttaggacggaagaggtcatctcgctcggagcttcgctcggaagggtctttgttccctgcagccctcccacggcagagtctccagagattcgggccggtatgaaaacagtgcattgttgcccattcggcatgtggatcagagaagcaggaagagcactggacttggagtcagggaatgagaatgtgataacacatgtgagctggtacagaacagccaagctcgctgagcaggctgagcgctatgatgcatcatggctgcagccattgaccggcagtcaccagagacaggggcatgaactctccaacgaagcg

SEQ ID NO: 718130 - DNA, 398 bp, Homo sapiens
  misc_feature (13)..(13): n is a, c, g, or t
  misc_feature (34)..(34): n is a, c, g, or t
  misc_feature (42)..(42): n is a, c, g, or t
  misc_feature (59)..(59): n is a, c, g, or t
  misc_feature (88)..(88): n is a, c, g, or t
  misc_feature (101)..(101): n is a, c, g, or t
  misc_feature (139)..(139): n is a, c, g, or t
  misc_feature (256)..(256): n is a, c, g, or t
  misc_feature (351)..(351): n is a, c, g, or t
aaaatggacatcncttggtttgagaaccctgagnaaacttgnccctgtcctagttaaanatcaacatgaatgtacggtgttttagtanttattgaatacancgattttaagaaacctttgactcttctttttcattaanttagctatagcagcctgttctgtttttgtttgtttgtttgtttttgagacggaatctcgctctgtcgcctaggctagagtgaagtggcacgaccttggctcactgccagctctgtancctgggttcacgccattctcctgcctcagctactcgggaggctgaaacgggagagtggcatgaacccaggaggcggagcttgcagtgagctgagntcgcaccactgcactccagcctgggtgacagagtgagactccatctc

SEQ ID NO: 718131 - DNA, 553 bp, Homo sapiens
actgcactccagcttggacgacagagcgagactctgtctcaaaaaataataggccaggcatggtggctcaaggtctgtaatcccagcactttgggaggccgaggtgggcagatcacaaggtcaggagttcgagaccagcctgacgaccaacatggtgaaacctcgtctctactaaaaatacaaaaattagccaggcctggtggcacgcgcctgtaatcccagttacacagaagactgaggcaggagaatcgcttgaacgcaggaggcagaggttgcaggagctgagatcgcgccattgcactccagcctgggcaacagagtgagactctgtctcacaaaataatactacaataaatgaacacacatgctgctgagtccgcaggggggcagagcagaggacagcgtgctttcgtgtactgttggaagactggctcctccgtgtacagcaacctcgtgagcccattgttgcacccgacctgaccaaggggcaccgatccaggtcctgggccggtgtgaaccagcacaaaagctgactcgggcaagcaaggctaca

SEQ ID NO: 718132 - DNA, 551 bp, Homo sapiens
tatacacccggatgaagaacattgagtgcattgagctagggccggcacctgctcaagccgtggtacttctccccgtaaccacaggaacctcaccacattgcctgtcctactacctgtgcgagttctgactcaagtacggccgtagtctcaagtgtcttcagacgtcatttgaccaacgtgtgacctacgacatcctccaggcaatgagattaaccgcaaggggaaccatctccttctatgagatagatggaccgtaagaacaagagtatattcccagaacctgtgtctttaggcccaagtgtatccttgaccatacagacactgtactatgacacagaccctttcctacttctacgtcatgacagagtatgactgtaacggcttccacatcgtgggctacttctccaaggagaaagaatcaacggaagcatacaatgtggcctgcatactagccctgcctcccctacagcgccggggctacggcaagctgctaatcgagttcagctatgaactctcccaagtggaagggacaacagggacccctgagaagc

SEQ ID NO: 718133 - DNA, 109 bp, Homo sapiens
aatgcagcggactcggaggaacgatgtctacagaaaggtagacaaaaggaggaagctggggaaaaagaggtgtgcggagaccaggtcaaaggaccggacaaagaggagg

SEQ ID NO: 718134 - DNA, 281 bp, Homo sapiens
cgggtgatctagagcgatccctactgtctcagtgtagatataattcgtatgtagttcacaaaagcccgctaggtatttcccaaattcttacgtctttttcaatactcaacttggaaaatatatatggctcacactttttttttttaattttttttttggaggattgagtctcagctcactgcaacctctgcctcccaggttcaagcgattctcctgcctcagccttccaggtagctgagactacaggtgtgcgccaccatgcctggctaattttttttttg

SEQ ID NO: 718135 - DNA, 967 bp, Homo sapiens
gagtgtggacgagaccctcatgtggctcttgtccagatcctcaagggccgccgacaagaacaagggggaaagtagcggggcgagttcaggtggggctggaatcgcgtggcagggccgagccgcgatcgaccgcgcaccgccgctggcatagttctctgcgctaagagctcaacgaagattacgtccccgcgagacaagcaaagcctgtgcgcgcagatgatgggagtagacttgttcgagaaggtctatggctgggcagtggctggagggagggggtacaccgcgcgaaacctcgcatcgagggcgcctcgcgtggtccacggggggatcactcgggaggccgttgggctgtacttccagtcgtgtatgtgctctatttcttaaactggaataatcgaattgatgccacgcgcggtccagaatccgcctgaggggtccctgggttacccctgggctcgtgagagtcctaagtggggttggaacctaggtcggcaaagcacgggaatcccccgggggggaggaaccgacacggagctcgtgcaggacactacccaccggggcggaccaccgggacagggcggcaccggggataccggagggggggtaccttcgccagccgcgttgggcttttgtgccccttcgaagggggccctggggcacgcccggggatacctttggggggggggcgaataggcagggaaattcatatgggggtgccttcgttgtggaaacacttttaggtgcggtgttccaggaaatggcatggcgggacttttttctggcgaaacagagaagcaaggagagcattcccacgggtttgtgggtatcaaacacggagcggtacagattcaagaacagcacacagcacggagaggagggtataacaaaggaggggagattatagacagaggaaaggacaaacacttggaataaaacaagggggaaggagagaagaacagggaaatgg

SEQ ID NO: 718136 - DNA, 1002 bp, Homo sapiens
gcgagactccgtctcaaaaaaaaaaaaaaaaaaaaaaaaagggtagtttcggggggtggggatttggccccccaaggggggggggccccaagggtgggaggtcatctgtcacctgttggtcgcaaaaaccggctcggcgctgggggggtaatcgcctctatttacgccgttttactgagaaagcgctaataaccgtagcacttgctttggggagcttccaaataggcggcactttaaaaccttcttttccccaacttgtgtacttgggccccattacgcactcggagtggggctttatattctcccaaaatggggcgtcttggcgccttataaaacgcccacaaagggcgtggtggtgctcttgggggggcgccaacaaaaattggtgggtttggggcataccataaacgcgcccccaaggggacttcttttaacaggtttataatttttggctcatctcatacaacagaggttaatcatgtggggcgccaggtttttaggaaaaaagcgccgagaagattacgttacacactattacgaggagaaggaaacttcatatcaaagggacttctgtaggccccgagggcatctttaaaagaagcaggaccagaaaggacgacctttggggggggatctttctcttcccccagcggccccagaaacaaccaagcacaaaagaacagaaaaacagacaaactgttttcgcgcggccacttgggcggcgcccagagaaaagaggtttccaaccaacaccatgggtgtgggggcgcggcggcaccccacaatgggtgatgcggaaacgcacgtgggcaaacagggcgtaccacaagaggaacacgcgggcgatacaaacagggggggtgggatctccgcccgaaagataaaagagcgcggccgggggacaaaccgagcggttctgtgaaacaccaccggagaggggatgcgaaaaggaaacaggggagatcacaacaggaggacccaaagcgaggacgataaaaatgc

SEQ ID NO: 718137 - DNA, 315 bp, Homo sapiens
  misc_feature (4)..(4): n is a, c, g, or t
  misc_feature (6)..(6): n is a, c, g, or t
  misc_feature (25)..(25): n is a, c, g, or t
  misc_feature (57)..(57): n is a, c, g, or t
  misc_feature (117)..(117): n is a, c, g, or t
  misc_feature (287)..(288): n is a, c, g, or t
tatncnagagggagaagtctgtttnccgatcgccactgctatcaattttcaggtatnctgtcacaccttgaaagcttcggttccacatccgctgagtgacgccctccccccagtaanatttccccatgtgccagagtctccgtcactggctggatatagagcaggagcccgtcgtggaaggatgctgggatggtgtttaccaggccatccttcatggtgaagttgaactgctcataggccaggtgttttaactgcttcaggaattccaagtactcgggattatctgnntctttatatgtaatgattttgtaagac

SEQ ID NO: 718138 - DNA, 203 bp, Homo sapiens
ttatcatggctctaggttgctcaatcgtagagacggagtattcaaatttcatcagtaacacttttttccaaggggagaacgcagcccgcagtcatgcgttgcagtaacgagtaggagcgtgtcccgttcgtctcgttttaatcgtgaactcagttcctcacgtcattcttgtgtctttcattgtttaaacgagtgcgtgatca

SEQ ID NO: 718139 - DNA, 194 bp, Homo sapiens
tttttttttaaaaactcaaacccttcccacggggcatgggccaaaaccgggctagtttcctcattgtggcctattccccaagcaacaagaccagtaaatgacatggttaggtaccatcccattcccagcaaacccaaccaccttgtttgtttttggttccttccagtcctggttcataaaacttttccctcgca

SEQ ID NO: 718140 - DNA, 166 bp, Homo sapiens
ctgcatgctcccgagtagctaggattacatggcatgtgcatcacgctcaggtaattttagtatttcatgtgtagagactggtgttttccccatcgttgagcagtgctggtctcgaactcctcacctctaagtgatccacgccgcctcggccctccctaaagtgctg

SEQ ID NO: 718141 - DNA, 395 bp, Homo sapiens
aaaacggccatgtagaaactttattaaaactcactcatgactgctcacattccagcgacatatgcccagcaggctaaagccatgataacatgtagctagtcagcatttaccataatcctcctaatatctttgcagctacattaatatttgtgcaaatctgtctatctgcacgaattcgcatgtaatgtgtcatttacaacatatatctaagtatcttgaatactcagactgcaaaacggccaatttaactaattgataatatttcaaaaaaatagtcttcgaatgtataggaagtagacatgcattaactgtgaccttattgcacctcagtttttttctttctttttttgggcaacctgagtactatctataggacatttgttatgttcgttttt

SEQ ID NO: 718142 - DNA, 106 bp, Homo sapiens
gaatttgggggcccgggcccccccccccttttttaaagggggttggcgccgcccttgggtttttttttttaaacccccggggggccttaaaaggtggtctttttta

SEQ ID NO: 718143 - DNA, 142 bp, Homo sapiens
  misc_feature (69)..(69): n is a, c, g, or t
  misc_feature (141)..(141): n is a, c, g, or t
ggaggggtatgccctcccccatgccatcctgcgtctggaccttgcttgccgggacctgactgactaccnaatggaggatcctcaccgaggcggggctaaagatttaaccaccagggccgacggcgggaaatcgtggagttna

SEQ ID NO: 718144 - DNA, 380 bp, Homo sapiens
aagctatagttggggaaatttgtgggttttttttaaataaaaaatgtttatttttgtccttatatttaaacatgatggaatttgtaaatcttggcattgattgtaattctgcccttttggaagaattttttctcccagcatgttaggtgagaatattctcttttttataaataataagaagtagggtgggttttctggtttctttataccagggctttttagctcaggatcatctcccttcatgtaagcagcacgtttttacttttaggaagctgaatgttgtgttatccctaatactttggacaggtcccctgcctactttaattgtccttaggacttggacaggctttatcattaaaaagggttttccttatccccga

SEQ ID NO: 718145 - DNA, 229 bp, Homo sapiens
tataccacaaagtatgtgttactacctattatttaattaactggtgtaaagcacatagaacaaagactagctcacagataattactcaaaaatgctggtcgtgatgataagccaaaaattcagcatcaggtcctagagatctttcctaaatggcagacaatattccaggctcactcaaaaaaacctatttgccccttcatgaaacgggacatactcttgagtgggagac

SEQ ID NO: 718146 - DNA, 592 bp, Homo sapiens
cttctgctcacctggggctgctagcttctcttcccgtggaacccttctctttacgtggtgtgtcctttttaccgttggtgtctcagcaatactttatagcatcatacagggccatcgactcacacagtgacactgcgcccaagacagcccggcaactggggctggttaagtgcagggtgaggaaccagcggtgggtattgggaaaggcctggcggaaagaaggctctagaaccggcttatagagccacaacagggtgcagacaactgtgatgtcagccaatgtcactcgtgcgcccagcagaaaagtcctcgtcttcaagtgagcatccagcagccccagaattcgcctcacttcctcctttgcattctcagtggcctgtttgttgtggtgcatgatgcccaaggtggggaacacccaggtactggctgggggcactatatcggaatcagcaaagctcacccactgcaccacctgggctgctgcctctggagtacttccccgcagctcctcattgctcacatagtaggcaatggcgttgctctcaaacacacagaatccatcatcaccctcaaatgctgggaccttgccggc

SEQ ID NO: 718147 - DNA, 968 bp, Homo sapiens
agggcgaaagggcattcgacttactgtctgctgaacgagagagataacgaggctcgccccaccaaacagcaccagctggcctaacattgcactagcagcactactcttctttttctcttgcacaacataaacagctgcaattcctcgcctaacaaacaacaacacccaaacaaaacaccaacaaaccctttgcgcgcccccccccgccccctccacaacactcctctcccccccccaccccccccggccgccccccgccccccccacgccccccccccccaccgcggccaccacaccagtcagactccaccactgagagcacaatcccagccgccccaccgtacatcaagcctgcagcgcgcactcctccaccaccgataccaacacacacagcccgtctgcgcccccaccccgacccgcctctctcgccaacacccacctcccatacctgagcagcccctcgcgaagcggcactccactcctgcgtgagccacccccctcctaccacgcgcgcctctccatccgccaagacgccatgaccacactccacacactatagcgaacccccccgcaaatcaatgcataattcaacctcctaaccccctcacccacatcacacacaccacccttctactacctcaccacacaccctacccagactatctccacctccacaaacaccacaccaccacatactactacccatctcagactgtcccagtcaccgccactccacttacctcactccttcccactctctctcctctctcctactcctctcaccgaccacttctcttatcacactatcactacttccacagtgtactatctatttccactccatagcgtgaacacacccgccacgctgctgtactacctctgactgctccacatcatcagcgaccgcttctgcctctctctgtatcctcaattctcacacacccctacgtctaccacgtctcctttct

SEQ ID NO: 718148 - DNA, 1209 bp, Homo sapiens
  misc_feature (544)..(544): n is a, c, g, or t
cttgtcaagtccaatgtacaatgcctccatcaccgacctcgaggccaagattgcacagctggagtgagcatggctggacaacgagaccaaggagtcgccaggcgagtcctgtcaaatcaggtgcgtcggaccgagaagaagctgaatggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagnctccccttcccagaccccgcagcacgcctctccccaccttcttgggactgctgtgaacatgcctcctcctgccctcgccgtccccatcccgtccctccaggtgtgtggggcattggcttcctctgctgcatccccttccagctccctcccctgtcaaatctgatacaaagagacagggcccgggcccaggcagagagcgacagagctcctcagcctctctgccaaaaagcacaagatgtgaggcgagcaggcagccccggggaggggcaagtttctatgaatctatttcttcagactgaggcctttggtagtcgacccgcagcgtagctccctgagttgcacaggcccccatctctcttcttgtgttgcaatcacagtggactcaaactctgcctggctccatccatgtctggggtcagaagacagcctggctcactctgtcgggaaaagcgggtgggaaggatctccaccgaccagcgcgcaagcagagatctctatctaagtcaggcagcgcccctacggagctgtgcagagcggaaggaagcaagccagcctcagctggcacataggaagagacaagacagaggcgccaggagtcgggcggaaccaaaaaacacagaggaagaccagaaaccaagacggccgaaaaaggagaaaaaaacaac

SEQ ID NO: 718149 - DNA, 233 bp, Homo sapiens
gccggcggctatctgtcgtggtgggaggctgcttcatcccgggctgccccatggcctcagcttcctcccttctgccctgcgcagcgcggaggcggccttcggtagtgtcggccgcgacctggtgctgtcagactcccgcatctctcccccaagccttcccgttctgccctgcgctgcaagatgtgaaacgctgctgtctcccccaccctcccgaaagttgtctcttgagccgc

SEQ ID NO: 718150 - DNA, 946 bp, Homo sapiens
  misc_feature (10)..(10): n is a, c, g, or t
  misc_feature (69)..(69): n is a, c, g, or t
  misc_feature (80)..(80): n is a, c, g, or t
  misc_feature (83)..(84): n is a, c, g, or t
  misc_feature (88)..(88): n is a, c, g, or t
  misc_feature (106)..(108): n is a, c, g, or t
  misc_feature (113)..(113): n is a, c, g, or t
  misc_feature (129)..(130): n is a, c, g, or t
  misc_feature (143)..(143): n is a, c, g, or t
  misc_feature (174)..(174): n is a, c, g, or t
  misc_feature (186)..(186): n is a, c, g, or t
  misc_feature (197)..(197): n is a, c, g, or t
  misc_feature (209)..(209): n is a, c, g, or t
  misc_feature (215)..(215): n is a, c, g, or t
  misc_feature (236)..(236): n is a, c, g, or t
  misc_feature (249)..(249): n is a, c, g, or t
  misc_feature (255)..(255): n is a, c, g, or t
  misc_feature (257)..(257): n is a, c, g, or t
  misc_feature (259)..(259): n is a, c, g, or t
  misc_feature (263)..(263): n is a, c, g, or t
  misc_feature (278)..(279): n is a, c, g, or t
  misc_feature (293)..(293): n is a, c, g, or t
  misc_feature (298)..(298): n is a, c, g, or t
  misc_feature (315)..(316): n is a, c, g, or t
  misc_feature (320)..(320): n is a, c, g, or t
  misc_feature (324)..(324): n is a, c, g, or t
  misc_feature (361)..(361): n is a, c, g, or t
  misc_feature (375)..(375): n is a, c, g, or t
  misc_feature (378)..(378): n is a, c, g, or t
  misc_feature (382)..(383): n is a, c, g, or t
  misc_feature (495)..(495): n is a, c, g, or t
  misc_feature (516)..(516): n is a, c, g, or t
  misc_feature (543)..(543): n is a, c, g, or t
  misc_feature (583)..(583): n is a, c, g, or t
  misc_feature (616)..(618): n is a, c, g, or t
  misc_feature (633)..(633): n is a, c, g, or t
  misc_feature (821)..(822): n is a, c, g, or t
  misc_feature (828)..(828): n is a, c, g, or t
  misc_feature (933)..(933): n is a, c, g, or t
ttgttaagtnttgccggtgaccccaacctccaccccctagcccctgagaagagatttggctgggcaganatcaatctatnttnnaaangccaccagcacccatcannntttcnactggcaccctgaaanntgcccaggttggnccgccagcttcgtccacaggccttggccagntggggccctcanggaagcaaccnagctcgcatctngaaggncaggtagtcccctcgggtggnttgcttgttgatntctctntntngttntttggttacgatttnntctaggacctcgcnatctnccttaataagctttttnntttnaggntctccgttcagcaaggaataggcaggtcccctaatgntagatgagcagaancanaagnngccggtagatgggtcccagggctcccaccccgcagccttgagtggacagaccctggggcctcacccactctccctgatgaaggcagtggagctgggctctgccttgctagcntcagcccggccaacaacagcnctttcaagatcctcctccaggcccttncagcccctgcaactacttactccaagttaacgtatttttnctcacatttggtctttttcgggcaccaggaacnnngaccggaaccactcntcacgagaacacacatcttcagccaacactcccagatcctgtggtgtaagtcaggccgaaagctccccacctggtgcgccccgtctcagggtccaccaccttgcggatgatgctctgccgggcatcccactcctccttggtcatgggcttcatggcctgggattcgggacttctgctcatccgtcagnnctgggncatcctcttcctccccagctgatcggtgccactggtccagcgaggggcccggcagagctccacctgctgtgcttccgccttctccttgccttcttcttcagcttnttctcttcttctt

SEQ ID NO: 718151 - DNA, 211 bp, Homo sapiens
ccactggctcccaaatgtgctgggattacgggcactacaggcaccttggctaactttctttatattgcggtagaggcaggttctctgtcacccaggcttgagtgcagtggcctgatcatagtgtcactgcagccttgacccctggggttcaagcaatctatcccacctcagcctcccaagtagcggggatcataggtatggtgcaccaccc

SEQ ID NO: 718152 - DNA, 454 bp, Homo sapiens
  misc_feature (201)..(201): n is a, c, g, or t
ggcgacggggttctcactaggttctggcctggactctcggatatgctgagctacatgcagagcgggcgcaggggcagacccaaacacaggcaggggaggagggcactgaacaacttttatgccccatctcacgtcctctgggcccacattcctacccggaccgtagctgcactcaggtgaaatcaaagacctcctcaccgntttctctcatgctccttctaggagccttctcgtgcgtgatgcagggtgggaagccgtgcaagagcccctcagccgtttcgggcatatgcaagtcggggacggcaaaggggtaaggtctcccgggcaaatcacggacaagggatgatgaaaccatgggacaaacaaccagcctcctaggcttgggggggagacagaggaccaccaattagatggaagcccatggtccacaggggtaaccagctcaataccctag

SEQ ID NO: 718153 - DNA, 170 bp, Homo sapiens
cagaggttgaggtgggaggatcctttgagccttggaggtggaggctgcagtgagccatgctcatgccactgcattccagcctgggtgacaaagcaagaccttctctccaaaagggggtgggggaagaacagttatggtatcaagtaatagaggagagaagagatggcatc

SEQ ID NO: 718154 - DNA, 205 bp, Homo sapiens
acggatactagatataagcagcatcaggttcgtcctttacatgttgtagtctggttatcatctgtctggcggttagttggatgagtcattgctgggtcgtgactggcgaagacgctgacgagatatttggaggtggggatcaatagagggggaaatagaagggtcagtactgcggcgggtaggcctaatttctctcggaccaatg

SEQ ID NO: 718155 - DNA, 366 bp, Homo sapiens
  misc_feature (1)..(1): n is a, c, g, or t
  misc_feature (87)..(87): n is a, c, g, or t
  misc_feature (141)..(141): n is a, c, g, or t
  misc_feature (148)..(148): n is a, c, g, or t
  misc_feature (183)..(183): n is a, c, g, or t
  misc_feature (195)..(195): n is a, c, g, or t
  misc_feature (237)..(237): n is a, c, g, or t
  misc_feature (298)..(298): n is a, c, g, or t
  misc_feature (304)..(304): n is a, c, g, or t
  misc_feature (360)..(360): n is a, c, g, or t
ntgcaggcatcaagacggagctgacacagatcaagtccaatatcgatgccctgctgagccgcttggagcagatcgctgcggacaaanaggccaatccagatggcaagaagaagggtgatggaggtggcgccactgctcggncggcggntggtggtggcatcggtggcgatggcagtggtggtngcggtggcggtngcagcagcggccaccagccccccaagagaacacaacttcttnaggcaggccttccccagggggaaagcacggacccgagacgacggcgattgaagggaagggntccttnacacacagcgaggaaagagcttggaacacagccagggacacagacgcggtttattnggacta

SEQ ID NO: 718156 - DNA, 172 bp, Homo sapiens
caagaattgtctgcgaaacctcaagctcgaagttacgctgcagatacgccggaggacacatcatcctcgacgtggacatcaacaaggacagccggggcgagaccacgcttgccgggattcgggatcaacaccaagcacgtaaagacccaagtactgttcgagaacggcggcc

SEQ ID NO: 718157 - DNA, 120 bp, Homo sapiens
gtggcctgcacccaggtgtggctgtcaggacaccagcctggtgcccatccttccgacccctacccacttccatttccgtggtctccttgcactttttcagttcaaagttgtaccctgtta

SEQ ID NO: 718158 - DNA, 130 bp, Homo sapiens
aaaatgatatcgcagcgtattctaaatttgggccaagagtcaaaaaaatgcatttgaaggtttggaacgtgcccacataagacaggaggctgatcccgaacagtagttgggggcagatacccacaaacca

SEQ ID NO: 718159 - DNA, 645 bp, Homo sapiens
agatggagttgtcactcaggctggtgtgcagtggtgcaatcatggctcagtagaacctccaccttatgaattccagtgattctcctgcctcagtctcccgactagctgggattacaggcacctgccacaatgcccggctaatttttgtatttttagtagagacgaggtttcaccatgttggccaggctgttctcaaacttctgaccacctcagcctcccaaagtgctgggattacaggagtaaaatagccaagatttgaaagcaacttaagtgtccatcgacagatgaatgaataaataaaatgtggtacatatccacaatgaagtactattcagccataaaaaataatgagatactgtcatttgcaacaacatggatgaaacgtgaagtcactatgttaagtgaaataagccaggcacagaaagacagacatcgcatgttctcacttaactgtgggagctaaaaattaaaacaattgactcagggagatagagagtagaaggatggttaccagaggttgagaaggggaagttgtggcaggagcgtggtagagaacttgaaaatttacccccttcctaagggctccaaaagagcttttttgtgaatccaaaatggtccaagggaaaaattttttattggtcaaaa

SEQ ID NO: 718160 - DNA, 801 bp, Homo sapiens
acagtttaggacctgggcatttttccccccctggttgcccgaaaacatccccttgtgcattcccggttttaggggccccccctgccccagtgacaccagtgtaaccggccgcagtacctttccgtgcaaaggtagcataatcaacgtgtgtccttaattagggacctgttatgaatggctccacgaggggttcaactgtgctcgttactgtttaacccgtgaagattgacctcgccccgctgaagaggcgggcatgaccacagcacagacgagagagaccctatggggactttaatttattaatgccaaaccagtacctttaccaaacccacaggtcctaacttcccaacctgccatttaaaatttcggttggggcgacctcggggcagaaccccacctccgagccagtacatgctaagacttcacccagtcaaagcggactactatactccattgatcccataacttgacccacgggacacagttaccctagggagtaacagcgccatcctattctagagtccaaatcaaccaatagggtttacgacctcgatgttggatcaggacatcccgatggtgcagcccctattataaggttcgtttgttcaacgatttaagtcctacgtgatctgagttcagaccggagtaatcccggtcggtttttatttacttcaaattcctccctgtacgaaaggacaacagagaaattaggcctacttcaccaagcgccttcccccgtaaatgatatcatttcaacttagtattatacccacacccacccaagcaacccgggtttgttta

SEQ ID NO: 718161 - DNA, 821 bp, Homo sapiens
  misc_feature (39)..(39): n is a, c, g, or t
  misc_feature (41)..(41): n is a, c, g, or t
  misc_feature (57)..(58): n is a, c, g, or t
  misc_feature (62)..(62): n is a, c, g, or t
  misc_feature (67)..(67): n is a, c, g, or t
  misc_feature (108)..(108): n is a, c, g, or t
  misc_feature (113)..(113): n is a, c, g, or t
  misc_feature (436)..(436): n is a, c, g, or t
  misc_feature (623)..(623): n is a, c, g, or t
  misc_feature (646)..(646): n is a, c, g, or t
  misc_feature (668)..(669): n is a, c, g, or t
  misc_feature (682)..(682): n is a, c, g, or t
  misc_feature (686)..(686): n is a, c, g, or t
agcgatttcatcttcaaccctggattacaccactcaccntnccagtgtgcttgaganncaanctgcncccactgaactccgcagctagcatccaaatcagaccttganattangaggccttggagactcagatcctgaacaagtagagaacaaagatctctacttggatggaacttccattctgtggggaagagactgacaataagcaattaaataaataagaactcagcagtaggccttgcctcagatccaaggtcactcggaagaggccatgtctaccctcaatgacactcatggaggaaatgctgagagaagcattcagatgcatgacacaaggtaagactgccaaaaatcttgttcttgctctcctcatttggttatttgttttatttttaggagttttgagagcaaaatgacaccacccagaaattcagtnaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgntgatcccagcagggatctatgcncccatctgtgtgactgtgtggnnccctctctggggnggcnttatgtatattatttccggatcactcctggcagcaacggagaaaaactccaggaagtgttaggtcaaaggaaaaatgataatgaattcattgagcctctttgctgccatttctggaatgattctttcaatcatgg

SEQ ID NO: 718162 - DNA, 105 bp, Homo sapiens
tggcagcacagtttatcaggaaaacaacgagaatatgagaaaagagttctggccattgttgaacaaatgctggaatgattcataatagacaactggtctgttaag

SEQ ID NO: 718163 - DNA, 556 bp, Homo sapiens
  misc_feature (39)..(39): n is a, c, g, or t
  misc_feature (41)..(41): n is a, c, g, or t
  misc_feature (57)..(58): n is a, c, g, or t
  misc_feature (62)..(62): n is a, c, g, or t
  misc_feature (67)..(67): n is a, c, g, or t
  misc_feature (108)..(108): n is a, c, g, or t
  misc_feature (113)..(113): n is a, c, g, or t
  misc_feature (171)..(171): n is a, c, g, or t
  misc_feature (358)..(358): n is a, c, g, or t
  misc_feature (381)..(381): n is a, c, g, or t
  misc_feature (403)..(404): n is a, c, g, or t
  misc_feature (417)..(417): n is a, c, g, or t
  misc_feature (421)..(421): n is a, c, g, or t
agcgatttcatcttcaaccctggattacaccactcaccntnccagtgtgcttgaganncaanctgcncccactgaactccgcagctagcatccaaatcagaccttganattangaggccttggagactcaggagttttgagagcaaaatgacaccacccagaaattcagtnaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgntgatcccagcagggatctatgcncccatctgtgtgactgtgtggnnccctctctggggnggcnttatgtatattatttccggatcactcctggcagcaacggagaaaaactccaggaagtgttaggtcaaaggaaaaatgataatgaattcattgagcctctttgctgccatttctggaatgattctttcaatcatgg

SEQ ID NO: 718164 - DNA, 554 bp, Homo sapiens
tacgaaaatctttatgcatagggtgacgtctgtaataccagcttctcaggaggctgaggcacgaggatcacttgaacccaggaggaggaggtagcagtgagctgagatcatgccaggcaacagaatgagacttgtttaaaaaaaaaaaaaagtgatttgatttgaggggaaaaattgacgggttatatccagtcagatatggcaaaaagtctcagggggttcaggtgaatgataagggtctgggggggggtgtcccctatcagactacagggtgttagaggcacagaaaagggtgcagtggggttcttaaggtgaaaggatgagaagcacaactccagtgtgtctcttggtgtagaaggtcagcagacacccctgtgttagatgtgcgggatcaggggaaagcattcccattggttactagatggtccagaagtttcaatttatgaggggggggggggctcatgcccgtggtcccagcactgtgggaggctgaggcaggaggatcatctgaggccaagagtccaagatcagcctgggcaacatagtgacaccct

SEQ ID NO: 718165 - DNA, 417 bp, Homo sapiens
  misc_feature (33)..(33): n is a, c, g, or t
  misc_feature (97)..(97): n is a, c, g, or t
  misc_feature (115)..(115): n is a, c, g, or t
  misc_feature (118)..(118): n is a, c, g, or t
  misc_feature (136)..(136): n is a, c, g, or t
  misc_feature (140)..(140): n is a, c, g, or t
  misc_feature (143)..(143): n is a, c, g, or t
  misc_feature (149)..(149): n is a, c, g, or t
  misc_feature (155)..(155): n is a, c, g, or t
  misc_feature (165)..(165): n is a, c, g, or t
  misc_feature (173)..(174): n is a, c, g, or t
  misc_feature (182)..(182): n is a, c, g, or t
  misc_feature (211)..(211): n is a, c, g, or t
  misc_feature (220)..(220): n is a, c, g, or t
  misc_feature (296)..(297): n is a, c, g, or t
  misc_feature (299)..(299): n is a, c, g, or t
  misc_feature (301)..(301): n is a, c, g, or t
  misc_feature (305)..(305): n is a, c, g, or t
  misc_feature (309)..(309): n is a, c, g, or t
  misc_feature (328)..(328): n is a, c, g, or t
  misc_feature (339)..(339): n is a, c, g, or t
  misc_feature (350)..(350): n is a, c, g, or t
  misc_feature (398)..(398): n is a, c, g, or t
aattagccgggcgtggtggcgggcgcctgtaancccagctacttgggaggctgaggcagagaattgcttgaacccaggaggcggaggttgcagtganccaagatcgcgccactgnacnccagcctgggtgacagancganacnccgtcncaaatnaaaaacaacnaaaaacannaaaaactnaaaattctttgcttgttagtgaccttgancatggttcnctttgtacgatagttgggcatctgtatttccacttgtgtgaatttgcctttaaattttggttatgggtttcacctnntnanatantcanacatatttatcttttcctntgtgataggtntttttctgtancttttcctgttaaacacacagacccctccccaatctggacattgaatnaatattcattttcctttgc

SEQ ID NO: 718166 - DNA, 399 bp, Homo sapiens
gatatcaaacagtgccagttctgcttaccaaaaatggcccgactaggcagcgtcgtattccacgccctgctctgcgcctgcgagctgggctatcttacgcttttcaaatttgagactatgtggagatcgtttcgtcccctagagttctaatgattcgctttaccggataaaactgcgttcggttgggtgcgttcgttctgggaaaacgcctgctatcctgagggaaacttcggagggaaccagctactagatggttcgattagtctttcgcccctatacccaggtcggacgaccgatttgcacgtcaggaccgctacggacctccaccagagtttcctctggcttcgccctgcccaggcatagttcaccatctttcgggtcctaacacgtgcgctcgtg

SEQ ID NO: 718167 - DNA, 397 bp, Homo sapiens
gaccccgtctctacaaaaataagtaaataaattagccaggcatatggtgcccacccatagacccagctactcaggggcctgaggcgggacgattgcttgagcctaggagttcaagaccaacctgggcaacataggagactttgtctctataaataatttctaaaaattagccaggcctagtggtacacccctgtagtaccagctactcagcaggctgaggcgggaggattgctggagcccaggatgttgaggcagcagtgagctgtgatcatgccaccgcactccagcctgggcaacagagcaagatcctgtctctaaaaagaaaaaaaaagaagaagtattcgtaggaggatcacagaagacccccaacaccctggtgatgtcaccctgaagtcca

SEQ ID NO: 718168 - DNA, 369 bp, Homo sapiens
gaattgggattgctgcatcaaatggtggttctatttttaattttttgaggaaccgccatactgttttccataaaggctgtactaatttccattctcaccaacagttcactagggttcccttttctccacattgttgccaacattctttatcttgtgttttttaataacagctatcctaacaggtatgaggtgatctctctcattgcggtttctgattgcactttcctaacggttggtgatacttgagcattttttttatacaccgggtcatttagtctatgatgttgacttgactcccttatatagtttggatacttgctgtggccttgatgtttgggtgcacaaaaaattcggatattggactctcat

SEQ ID NO: 718169 - DNA, 626 bp, Homo sapiens
  misc_feature (253)..(253): n is a, c, g, or t
gctctgggtctccaggcccgctgacgtccgccagtcgtcccgaggccactcttcacctccaccatgagcctggacatccagagcctggacatccagtgtgatggagctgagctgacgctagatgtggccgatgctcctccctcttgctccagcatgtgccaaagtgggtcagtgctgggactgacttgtgtgccttcagcgcgaaggcagctggctggcaatgggacgagttcatgtcgttcatggcaagctntccgaatggttcaagccccgtggcaacttggggcagaactgctcgaagccctgctgcagctaactgagcttgggcgcatgtctggctgtgcgattgcggtgctccgaggtgcctgcatgacccctctcctgcgaagatccatgaatgctgagcctccagagactgctgcctgactgggggcccgggctgcgggggtccttgtccatgcacacttacgcagcccttgcccacccttgcatggagcgtgcaacgctcaagctgacgaaccctcttggggcggaatgcggggcccttgcagccttgcctcgtgggcgagaaaggggaacttccctttgtggaaccccccgcccaaggattggtgcccggacccttg

SEQ ID NO: 718170 - DNA, 159 bp, Homo sapiens
cagctgggccttccactccttccacttggcgctggccgactccccatcctgcccgcttccctgtgtgtgcatgggtgtgtgtgtgtgtgtgcctggggtgtgtgccgtgtgtctgtgcatgggggtgtgtgtgcctgtgtgtgtgtgtgtgtgcatgct

SEQ ID NO: 718171 - DNA, 686 bp, Homo sapiens
  misc_feature (17)..(17): n is a, c, g, or t
  misc_feature (39)..(39): n is a, c, g, or t
  misc_feature (604)..(604): n is a, c, g, or t
acctcctaccccacgtnactcttataggtagtacaggantattaacctgttctgccatcggcctcaccgttcggctgagccttaggacccgactaaccctgatccgattagcgttgatcaggaaaccttagtcttgcggcgagggggtttctcaccccctttatcgttacttatacctacatttgcttttccacacgctccagtaaagctcacgcttcgccttcaacgctgagtggaatgctcccctaccgatccattaggatcccatagcttcggtaaaacacttaatgcccgattattatccacgccaaactcctcgactagtgagctgttacgcactctttaaatgaatggctgcttccaagccaacatcctagctgtcttagcaatctgacttcgttagttcaacttagtgtttatttggggaccttagctgatggtctggattcttctcctttaggacatggaccttagcacccatgccctcactcctgagatagaactaatgcgcattcggagtttatcaagacttgataggcggtgaagccctcgcatcttatcagtcgctctacctcacattagtaactctcaaggctgcacctanatgcatttcggggagtacgagctatctccaagtttgtacctttcacccccaccctcagctcatccggaagcttttcacgcta

SEQ ID NO: 718172 - DNA, 441 bp, Homo sapiens
  misc_feature (359)..(359): n is a, c, g, or t
atatgagtcataaatgattccactgcttcggtagacaacttatgcccgattattatccatgccacaatcctcgactagtgagctgttacgcactctttaaatgaatggctgcttccaagccaacatcctagctgtctatgcatcgtgacctcgtttaagtcaactgagctgtcatttcgggaccttagctgatggtctggattcttctcctttaggacatggaccttagcacccatgccctcactcctgagatagaactaatgcgcattcggagtttatcaagacttgataggcggtgaagccctcgcatcttatcagtcgctctacctcacattagtaactctcaaggctgcacctanatgcatttcggggagtacgagctatctccaagtttgtacctttcacccccaccctcagctcatccggaagcttttcacgcta

SEQ ID NO: 718173 - DNA, 181 bp, Homo sapiens
  misc_feature (142)..(142): n is a, c, g, or t
tctagaggatctcccatcatgactaacacatcttttcaacaggtgtgggataacccatatcctaatttagaccaaatcacgtctaagaatcctactggtaaagaacagcaggtgagaatctaccaagaagttctagaggttntacgaccttcattatccgccctctatctaaatcacctag

SEQ ID NO: 718174 - DNA, 457 bp, Homo sapiens
  misc_feature (17)..(17): n is a, c, g, or t
  misc_feature (39)..(39): n is a, c, g, or t
acctcctaccccacgtnactcttataggtagtacaggantattaacctgttctgccatcggcctcaccgttcggctgagccttaggacccgactaaccctgatccgattagcgttgatcaggaaaccttagtcttgcggcgagggggtttctcaccccctttatcgttacttatacctacatttgcttttccacacgctccaggatcaatcaatatcaccattcaacgcatatagaatgctcccctaccgatactttttatatacaatgctatcccgcgacttcggtatctgacttatacccgattattattcatgcccggatcctcgactagtgagctgttacgcactctttaaatgaatggctgcttccaagccaacatcctagctgtctcggggaccagacttcgttagactaacttagacagaatttcgggaccttagacgacgtaaggagtg

SEQ ID NO: 718175 - DNA, 397 bp, Homo sapiens
  misc_feature (70)..(70): n is a, c, g, or t
  misc_feature (273)..(273): n is a, c, g, or t
tgtcccagattcaaaggagaatggggttgagccctttgagaacgcagtctcccgggccccctgcatcttngagtttcaatgtccaaccttttggtttttgggccaggcaggattctttaaaagaagttttattttttggggccctctgctaatcatgtgggtgagccagtggaacagcgggagacctgtgttagttttacaaattccctcctaatgacggggctcaaaaggaaaccaagtggtcgggggttgtttttgcccccctgttttttnctcccccaaggaaaatggtttgggagaacccagcttttcctgtttttgaaaaattccagcttcccccggtcaagttaccaaggaaggcctgggccaataaaaggtttttcccccttgaggttta

SEQ ID NO: 718176 - DNA, 564 bp, Homo sapiens
gtccctcgagtaacgctgtttctactcctcgtatactttgattattgaacggatctccagtaacactagtctgggcatgcttggctttacactcatataccgtgcgcatggttcataatcttccttccctatgattatatttgccaaagactgctcctttgcttggatgtctagtaaacgtaatgtgtgcttgccattttgtctgtcttcttcactttgtctaggatagatgctttcaggtctccaatgtgtctgtccaatgtacaatatcaactgtcgtctcccaaattgtatggctagtctctcacagtcagcctacaggattattatggaggcctggtcagataactctataaggaattcccagctattgtgctgcttagaacaagatcactgtgtgttgtggccccaaatggatcaccaaccacaaggaatgcaacatcactgatatcagcatcctttaaaatattatctgcttcttgttccacttcttctctatcagcaacaaccaattttcttccataaaactcttccaaggcttccttccctacagttaggactgag

SEQ ID NO: 718177 - DNA, 114 bp, Homo sapiens
tatgtatacacctccacacacatagatctgaaaggcactttctgcttagaggcaagcagtcatggaataaagcatgtaacgaggcgggcttctctgtaccacaccagccaatgt

SEQ ID NO: 718178 - DNA, 338 bp, Homo sapiens
agcatgtaccctatatatagcaggacatggaagaagcagttcagtggttgatcagtgtgctcaagacaaataaaattaaataaaaattacaaatggcagaatggtagctcaaccactagagaacaggttaatgaaattacttggtactatactctcaaacatatacgtaaaacgaagtgaatgaaactccatttaaagttgtcgcaaaaattagcacactacttggcagcttcatccaattcaacacaggaaacaaggtaagcagacacattcattagatcaaaagaaattagatcaagttcactggaatcagtctgtaactactcaagtcacaatga

SEQ ID NO: 718179 - DNA, 715 bp, Homo sapiens
  misc_feature (13)..(13): n is a, c, g, or t
  misc_feature (40)..(40): n is a, c, g, or t
cagtggaattcanccagtgtgcctgtacccagagtttgcnggacagcgatccttgccttcagtcctacctttatcccatgagcacatggtgatcaccggaccggcatcggagaacgtggacaacctgggcttcttcatctaccgactgtgtcacgacaaggagacctacaaactgcagcgccgggaaacaattagaggtattcagaagcgggaagccagtaactgtttcaccattcggcattttgagaacaaatttgctgtggagactttaatttgttcttgagaagtcaagaaaaaacgtggggaggaattcaatgccacagcataccctgcccctttgtattttgtgcagtgattgttttttaaaatcttcttttcatgtaagtagcaaacagggcttcactgtctcttcatctcaataactcaattaaaaaccattatcttaaaaaaagaaaacaaaacctttcttttttctaagtgtggtgtctttgatgtttgaattagcaaatgtgcaggttcctagataagattcgcttctccttagagcttacctactaggaagaatctaaattgcttggaaatcactaatctggatttttgtgttaattctgcacttccatgagggaaagatgcctaaagaatagtcattcgcatatgttaaagggaccacagtgacttgcttgtagatgctagccctgctacctagtctgttagc

SEQ ID NO: 718180 - DNA, 1539 bp, Homo sapiens
tgttaaggaacctcaatgtaattttaatgacctcagaccagtgaccaagggcagaactgaccagtgggctgtggttggggactcccagagcaaccctcaagggcgtcctgtggtgtgctttaccaccgtggaacaacgtggtgaggtcgtggtgggagaaactccgtgggtggacccttagcgtggacagccttctccacgttcaatctcctctgcaagcgtcgacggcgcactcacggcgtagacctacgcgcgccgcacactcagtgggtgccgccccgcgctctgctcagcacacggctcctgtgcacgacacaacgcacacgcgacacgccctgacgcgcagcggcgacgcacttgcccagctcgacgcgcgccctcacatgccgccgctacccctccagcgcagactcccctccaacgcccacacctccttggcgccccacaaacagcacccgcccacccatagctaccccaaaaccccgtgaccacgcgccccatggtgaccctaccacgggctccccacacacgcgcgcacccgacgcaagtgtaacctcacagcgtccgcgaacaacaccccgcacagccacaagatgccccccctgctcaccgagccccagcgccggcacaacgcgacagcacaacggcagcccaccacacagcaccccccagcactggccaacatcaccacgcgcacccgcccggcaagcacacctccgccacctccccccaaccgacacccccaccccaccacccccccgctcaccacctgcgcacccacgccaacacgccccacccgccccccacgccacccccagaccccccgccccccccgaacaccccacacccgccacgccgaaccctccgacacccccccacccacacaccagcgcggcaccctccgcccccaaccaaccaccgcacacctcgaccccccacaccaccccgcacccaccaccctcccaccctccccccaacacccttcactcaagcacaccacaaccgtacccactcatcacacccccaacggcacccacctctacaccacacactccctctccacacacacacacaccccacatcacacccacatcacacatccacaaccttcaacccaccacccaccacaccctaccacaccctcccccacccctcaccctcgctaccccccccaaaaaccaccaaccacacaccaccaaacgctctccattcccccaccacaccctcccacacccacaacctcacctcacactccccacactctcccacccaacccccccaccacaaacccgcaccaccctcgctttccacacctatcagcctcacatcccacacatactcccttccccgatcctcaaatctcacaacaccacctaccccccaccacctcgactaccctaatcccaccctactctgaccacgccttcacttcttcacaacccataccatccatctacaacatcctacataccattcccacacacccatctccccaccacgtttctacactactccacactcccgatctaccatctacat

SEQ ID NO: 718181 - DNA, 692 bp, Homo sapiens
cgtggtggcagacgcctgtagtcccagctactcaggaggctgaggcaggagaatggcgtgaacccgggaggtggagcttgcagtgagccgagatagcgccactgcacttcagcctgggcgaaagagcgagactctgtctcaaaaaaagaaacactaaactgaaataccataaaagttctggctggatacaggggctcatgcctgtaattccagttgctctgggaggctgaggcagggggaatcacttgagatctggggttcaagaccatcctgggcaagcatagcaagatcctcatctctaccagaacaattccaaaacattggccgggctatggtggctcatgcctgtaattccagcaactttgggaggccgaggtgggtggatcacctgaggtcaggagtctgagaccagcctggccaaaacggcaaaacctcatctcagccgggtgcggtgagccatgcctgcaatcacagcatcccgggaggccgaggtggcgtggatcacgaggggtcaggcagatccgagtccggtcctggcctaacacagttaaaaaccccagggtcgtcccacctacgaaccataccaaaaagaggccaaactaacgcggcggccctgccgggaggggccgaccggcaacccccaggctacccgggcagggctggcgcgccgggcacactggcggtgaactccc

SEQ ID NO: 718182 - DNA, 579 bp, Homo sapiens
cggggtagccgcgtggtacaaactcgtgggccccaacacaagcaaaagttggacacactttaaagggcagagtcccagcccactgcggggcaaaaggattattcgccccgtcccgcggaaaagggagccccccccgtggttcgcgcccaagcaatgcagcacgagctgttgtgcctacgagacagcacaagacccacgctcgtgcataccagagaccgcacggcacagaccagacgtcggctagttccaccccacccgggacaatgcccaaagttgtgtagatcctagcagcgcaccctattcgtggcgcctctgggagccccctttggcgacgacccccccttgagcggcaaaattgtcccccacacacatcgtggtgcgaaatgttctagttagagtttggatgataacgcacctcctttgcgtataatttggtctaatgccatagtactgcagttctttcaagaatcaatcaagggtcaagcaaggaggactcccaaaaattaggtgacaattccgtcttttttcaaacatgttttgggggacaatcccccccgaactttttctgcccgacatgac

SEQ ID NO: 718183 - DNA, 293 bp, Homo sapiens
gggtacctcctcagtagacgcagctccagtctaatatgaacgggttcaagctttttttcatcttcctcccgttccacagtcaaagagccttttcaaaccttttctcgtgtaatcgctccaccatggaacttgtgtttctttttttttttttttttttttttgtcttttggccatttctagggccgctcccgtggcatacggaggttcccaggctaggggtctaatcggagctgtagacaccggcctacgccagagccacagcaacgcaggatctgagctgcgtctgctgagag

SEQ ID NO: 718184 - DNA, 299 bp, Homo sapiens
agccagcaggcgctcgaggccttggctggccccacatcgccttttcctccccggatcacctgctgtggacttggtgttccagggagcgaggagctcctcgggccctgtgtggactctgggtcctttatcctgtctccgccactccctctggcggcgctggccgtggctctgtctctctgaggtgggtcgggcgccctctgcccgccccctcccacaccagccaggctggtctcctctagcctgtttgttgtggggtgggggtatattttgtaaccactgggcccccagcccctcttttg

SEQ ID NO: 718185 - DNA, 236 bp, Homo sapiens
ccccgcttatggaatcatttggaaaataccacgactttaaatgtggccagctatgagacagcggactacgcaggaactggggagtttgggagaagctctcctggtgttgactatagggatgaaggctccatgctgctgccacaaatggagtcaccataagaagaactgtcttctctgataatgatgtcccaccattttcatgctgttcgtcacagttccacaggtccttcttgcag

SEQ ID NO: 718186 - DNA, 414 bp, Homo sapiens
cgggcataagagagaagaaagaaacaaaaaacaaccacagaaccgggagaactaaacatcaaaatcaagtctctcccaaacagcaatcagatttctggtccggattcctcttggccatctatcttggatgcttcaattactgtagccagtaaactatcagcatggactttcagtcatggaagttactacatcttcgggtcacaaattccccggtaagatgagtatccctatatccttttccctgcagtacacacacggatttacacagttagtgtaaaacaaattatcactggcagctgctagaacagggcatgtcaggttctattcagaaaggcaatttatagaatagtacattcaacttggatttttacaacaaattggtcagacactcaaatacagcatttggtcgttgct

SEQ ID NO: 718187 - DNA, 241 bp, Homo sapiens
  misc_feature (197)..(197): n is a, c, g, or t
  misc_feature (223)..(223): n is a, c, g, or t
gccttcagaatcgcttagcctagccatacccccacgggaaacagcagtgattaacctttatcaataaacgagagtttaactaagactatactaaccccagcgtttggtcaatttcgatgccagccatcgctggtcactcgtattaacccatagtcaatcaaaagccgtgcgttgatgagtgttttatgatcaccccnctccccacatacagtctaagactcancctgagttgtattaaaac

SEQ ID NO: 718188 - DNA, 1366 bp, Homo sapiens
aagataacttaatctcactatgaagatttgaatcacactcagcacattcatccatgctgcccacaactccatttgctcgcagcttgtctgtcaatgtctcagtggggcttccatccatcctgcacaaagcacaggcagaccagcggcatttttcccaacagcagccaagcaaagtcaccacactatctcacttactattcctatccatttatactcctctctatatccttaacttctatcatcttactatacatttttcaacacatatattagaagacaaccagatcatgtcatctgcatactcaaagtgtaacacgaactcctcactacaacgaacaacaatccaagagacaacacccctgctgaacaacactacatgcagcaacccacaaaccccgaaaccactgagcgcagacacgcacagacccaaccccatgaatacagcagagacacgagagggcagagagtacaccccacaccaactcggaacgcacgaaacacagggacacaacatgcacaaccacctcacacacaacgatgcaacgtcccccccaaacccaagagcacaacaaccggcctaccagaacaacgcaccacacacagagaacaccacacacccactacacctaacccagccaaccactcattattgagtacacaacttctactgcaacaacacgtcgcaactactctccccatactgaacaatacaacaccactcaacttaatactaaatcactaacccaaccaaaaccatccacaaccacactcccaccttcaaataccacccaaccctcatcaccaactccagcattacccacctcactccctatcaccccatcctctcacctaaatactatcacacataccccttcctcccacctgcttacacactactccatctccacactacaccacactacaccacatttacaccacctcctacctccacagcacacaaccctccaccaaatcacctaaactatcccgccaacacaccccacacaaccccatcaatacaaccaccacacaccctacgtcaccacacactccctacccacacacacccctcactcacacactccctcaaatccatcacacaacaccacatcacataccatacaccccttatatatctcacaatcatatatcacaccacccaaccaccatctaaccaccatcatacactcaacacaatacataactaccacaccctcacaccaccccacaaccacccccatcccaacaactcacaccacatcaccctccaactcccaaatatatactcctactgcaccacttcatcatccatacatacctatcctatactccaacagacaataccacatacaagatacatcacatc

SEQ ID NO: 718189 - DNA, 364 bp, Homo sapiens
gtacgcggtgacatccagtatactgattcctctggtatctgtcccctagcacgcgctcctggtccttctactctcagctgttgctggcacctaagtctcggatgtactgatgtttccctcttgtattatatttcctttctataaaataatatcgatcacttaggaaacaaacgaaagaaaacacgttgggagttacattactatgtcccaagacttctctgggcttggcattagcagggaggaagagcaccaagggagccacttcctatggtgattgcagcatgctctcgtgtatttgcacagagagtcctaacttttcctttcagagctgagcatctgttgaatcctaatcagtttgtgtcac

SEQ ID NO: 718190 - DNA, 312 bp, Homo sapiens
  misc_feature (15)..(15): n is a, c, g, or t
  misc_feature (22)..(22): n is a, c, g, or t
  misc_feature (55)..(55): n is a, c, g, or t
  misc_feature (91)..(91): n is a, c, g, or t
  misc_feature (147)..(147): n is a, c, g, or t
  misc_feature (279)..(279): n is a, c, g, or t
gagacagagtttttngctcgtngcccaggctggagtacaaaggtgcaatctcggntcaccacaacctccgccccttgggttcaagcaattntcctgcctcagcctcctgagcagctgggattacaggcatgtgccaccacgcctggntaacttttctgtattttcagtagagactgggtttctccatgttggtcaggctggtctcaaactcccgacctcaggtgatccgcccacctcggcctcccaaagtgctgggattacaggcgtgagcaaccacgnccggccaggaagccatttttcatgggagggata

SEQ ID NO: 718191 - DNA, 95 bp, Homo sapiens
  misc_feature (59)..(59): n is a, c, g, or t
tgacagaccccagcgccgactgagcctctaaagcgacttcagatctgtcccaccaacancaccgcgcgcccgggaacagacgctccgggaagaaa

SEQ ID NO: 718192 - DNA, 918 bp, Homo sapiens
  misc_feature (3)..(3): n is a, c, g, or t
  misc_feature (36)..(36): n is a, c, g, or t
  misc_feature (81)..(81): n is a, c, g, or t
  misc_feature (85)..(85): n is a, c, g, or t
  misc_feature (125)..(125): n is a, c, g, or t
  misc_feature (132)..(132): n is a, c, g, or t
  misc_feature (165)..(165): n is a, c, g, or t
  misc_feature (179)..(179): n is a, c, g, or t
  misc_feature (208)..(208): n is a, c, g, or t
  misc_feature (212)..(212): n is a, c, g, or t
  misc_feature (215)..(215): n is a, c, g, or t
  misc_feature (250)..(250): n is a, c, g, or t
  misc_feature (271)..(271): n is a, c, g, or t
  misc_feature (275)..(275): n is a, c, g, or t
  misc_feature (285)..(285): n is a, c, g, or t
  misc_feature (310)..(310): n is a, c, g, or t
  misc_feature (313)..(316): n is a, c, g, or t
  misc_feature (326)..(326): n is a, c, g, or t
  misc_feature (353)..(353): n is a, c, g, or t
  misc_feature (366)..(367): n is a, c, g, or t
  misc_feature (730)..(730): n is a, c, g, or t
  misc_feature (773)..(773): n is a, c, g, or t
  misc_feature (850)..(850): n is a, c, g, or t
  misc_feature (857)..(857): n is a, c, g, or t
  misc_feature (915)..(915): n is a, c, g, or t
acngcgggcgctgctgctgtggggccgccgcctgcngcctttgctgcgggcgccggcgctggcggccgtgccgggaggccnaccnattctgtgtcctcggcggcccaccgcccagttgggccccnggcgacnccccgcctggcgcttgccggccggccgcctgtnccgcccgccgcccnccgcggccaaggcggcacccctgccctcncttntcngccgccccgagagcgtgccgggttccccttccccncctgcgttcccggccgcgccncagnagcttttggncattgttgcccggtccctgtcctcngannnngaggtgtttnttcgggagctgatctcccatgccagcnctgccttggaaannctgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagtnagaaccgggacaaaaatcatcatccacctgaaatccgactgcnaggagttttccagcgaggcccgggtgcgagatgtggtaacgaagtacagcaacttcgtcagcttccccttgtacttnaatgganggcggatgaacaccttgcaggccatctggatgatggaccccaaggatgttcgtgagtngca

SEQ ID NO: 718193 - DNA, 129 bp, Homo sapiens
agactacgaactcgagctggtaccaattcggccggggcataaagggtgggattcggaaacagccatgaacttgtgtgaactgtggcagcctgcgtctacaaaagtcgctctgctgctattttaaggaag

SEQ ID NO: 718194 - DNA, 167 bp, Homo sapiens
gatcgagactctgtctcaaaaaaaaaaaattaaggaaggaaaggaaaagaaagaacccccatctttactaaaaatatttttaaaagtagctaggtgtgggggcagtggcctgtaatcccagttcatggggaggttgaagcagggggcatggtttgaaccagggaggt

SEQ ID NO: 718195 - DNA, 552 bp, Homo sapiens
tgctggtctgctccttgaggatcccctactgacgttgcctctactatgggaaggtctttattgtggcttaggatggacctggtttctatctatcgcaggtgtcttgcgcccatcatgtctgtgatgtcttccgaattctccatgaagcgagttgacccgattaatgctgggttccctgtgcactagctttggctttcctgtgggtgccggctcactgataaatgaagttcgtccgtatgtaccgagaatcaatgcttcgcataagatctgggcaaagtctttgagggagactgttctgagaagcgaacatcgcagaattgctgacacgagcattgtgtccacgggctatcactagtctctgtcttgtggaacctggtgggcatctatcaggagggtgtgaagaggaaggatttgaattctgacatggatagtattttagcgagtctgaagctgcctcctaagtctgaggtctcatcagacgaagacatccagttccgcctggtgacaagatttgtgaatgaggcagtcatgtgcctgcaagaggggatcttg

SEQ ID NO: 718196 - DNA, 699 bp, Homo sapiens
  misc_feature (683)..(683): n is a, c, g, or t
cgccgactctttcagtttctagttcatgtccctccttctcttgcactctgcatggctcctaattcttctcgaacgttcttctttataccacgtgcccagtttccgtgctatcctctcgactctcctgcagtgctccaatgtcatccctcaagtccaggccctgcgtattctgggctctagtatagatgagcaagtcgtgccctccccagggcaccacgctccggcactcttggcggcctctccgtggtgcacaaagttcctcgatgtcatgcactctccaggcccagctcctcctgcctcccagtggacttcattcagccaccagcccagctcatggctctcagcggccttacccaggtcccgctcttgacttttggcggcctctgtcaggcccagaacttgacctccagtcggaccattcggcaggcccggcctcctgcttactcaaaggcctgcacagggcgccggcctcggcctcggcctcacagcggactctccacgcccagctagctctcgcctcactgtggcctccaccagtcacaaagctcctgccttatgcggccacttcagcaggtccagctcctgcctgccagcggcactcgttaggcccagctcattcctcaccaacggccttcccaggccccgtttttcccttccggcagatacttcgcagggggtggacntttgtagttttagtcc

SEQ ID NO: 718197 - DNA, 200 bp, Homo sapiens
catgctgaaaaatgtttttattagtataatgctaattatactgactccctatatatttaggcatatagattcaaggattattaggcacattagggtggatacctcaatagcccattcctcatctggtttcattaggaatgtaaaattaatctaaatttaccatgaagggtcagaatagctattgaatgctactttgaacc

SEQ ID NO: 718198 - DNA, 1165 bp, Homo sapiens
ctggcgcggtgtggtctcccggcccatggcgcaactcctctcacgcccgtttttcttgcgcatctccgggggttcctctccgttctccccggagggtatatttatattccccgccgacattttacacacgaggttgctttttctcgttctgctgggagcccgcggcgcccccactatgtgataccttattggggagcgcccacacgggggggaattttgggccccagcttggtttcgggaagttgaagcttctcgccccagaggtccgcaaagggttaaagtaacaccctgggaggtttaaaaggagccctccatttcccggagtttccctccaacaaaatgtttaatgaaagtgaaaaatccttggggccttagtggaatcccaagactccagaaaggtcgcccgctcccgctgtattcttctacttcaaccgaccagggcttgccttttaaatttgcaccggtgcgcgtgaaatattcccaaccaatggttataccccgccttttgcccaaaaaccccccttcactaagaaaagttaacccccacacgcgtattccccccacgagacgccccccgaggaatttaagttgaggaaaaactcttgagaaaagtgccacccacaaggcctcatttgtgggctcgcccactccacactgggagttcctcgccctcgggaaggagaggagactctgagaggttcgccactctttcaatggccccaataccacgaatagcccacccataagacaccaggaaaacaccagtaattaggtacccccctggaagattttgtcctgggggcccttacccgaggagccgcggaggccaccacccaagagcctgtcccccaaatgtgtgtggtgtgccctgcctgcctttggaccaatgatgcctgacctggtagaagccaattctgcgtgccagaccggcgccacaagaaaaatgggacctggttgaccccacactggtggaaccccctgggacccacggacttaaacctcccagaggaaccggcaccatagaatacctagaagaagttgccaattacttttgcccaaggactagctgataagaagatctctccccaagagagaccagggattggtgggaaaattgaccgcgtatgccctgactattccctttgtccggccaccggtttaccca

SEQ ID NO: 718199 - DNA, 105 bp, Homo sapiens
acttaaattgtaaatatgcactgtactaaaggattcttaaaatgtatttttttgttatttctactccagatgctatcccatggctaataaaattctagtaatttg

SEQ ID NO: 718200 - DNA, 936 bp, Homo sapiens
ctccctccgcgcggctacaatcgactgaccgcacagcgcaacgaaaaagccacggccgggtctcggcgttaactgcaacgtcgaattgcgcccccagtaccacttgcgggccgtcaacgcgcgcgcgcggagtgtgtgtgcgccagcacactgggcgcgcgagcttcacgcgctgcccgcatgttaaatcaccgccaaatgggctcgggactgcacctttcatagacagggggaacccacccaacaccaggggggggaaccggacacaccctggtggcgggacgcgaggcccaccccttcaccagcatatcggcctttcaaggcccttataaagcatttctccgggcccttctcatcctcattagggtttttctcctgcgcacccctggcgtgtatgccccctcgtgggcccgcgtagttcgttggagcactctgtgccgccttacgtgtggcgatgccgcatgtcaatgggcccaaaacgtgggcatgcttccccccccttggctagggtatcacttttgcccccgtggacaccatccaccgctcgtggtgtgcccactcacaagcaggccacgccaaaccattttctttccccgaccccgagaaggtgtccgctgtggttctttttgaggaccaactgccgaggctggtcaatcccccgtggccccacacactcctgtctgatagtcttgttgtcccctagtagaccacccacatattctcggactccgcccgctacagtgcagggtgaatacacaagcacacccctctcttcaacaccaggggcaggagagccccccctattttgcccgtcaggaagaatcgaccctagcaggggctgtgggcatgcgtcctgaggcttccattaacgacatcaagtggacccacccctcaactttcgccagtcttagacaaacggccgcggcccacataaca

SEQ ID NO: 718201 - DNA, 295 bp, Homo sapiens
tcattattgcattgtcttgttaccagaaacaaatttgccgagcttttttgccctatatttcccagcataatttgattaggaagtacaaaaaagggccaggcgcggtggcttacgcctgtaatcccagcactttgggaggccagggcgggtggatcacgaggtcaggggatcgagaccatcctggccaacatggtgaaagcccgtctctactacaaatacaaaaaaattcgctgtgcgtgatgatgtgcgcctgtagtcctgccttcccgggttcaatgcaattttcacatgcctc

SEQ ID NO: 718202 - DNA, 696 bp, Homo sapiens
gaagcgctgcggattgtccccgcgaagaccgtgccgccgtctctaaggtcgcccgggtcccaccgccgcaccatgcctcggggaagcgcagcgggcctcccggcagcagcggccgggcttgaagggggcaccaagcgggccctcggagcaggcacaagcgcccggctccttgcgggcaagccggggggcatcagtgcaccaaagatgggagaacccgcggaccgcagggtccaagcaggatgagctcggcatgggcgaacacggtcaatggcacagacgcatggaacgcgaaacactcaggccaagggggtaagcttcggagccacaccaacagcgtgggcatgacaaggcagcgcaccacacccggtaggacacccaagcactgttggtaattattggtgcccttgttcccctatataggacgacatcacgacacagtctaggggaagtgtatcccaaccaatctaccagaggtcgactgcgtcaccagtggagtaggaggggctataagggcggagcccactagaaaagcaagagtagaagcatatacagaagggaggtggcagccccgaggcctgtaagaagctgcggaccagacccgggggggacactgtcggtacaccatcttatacacccagcgaggacagacaagcaacgaaatcacagattgcacccaattcggtagattggaaagtg

SEQ ID NO: 718203 - DNA, 751 bp, Homo sapiens
ccgatttggacccaaaccgaacggtttggagggacattattgtgtcccaaaagattgggccaaatttggcacctgggtggcctatgtattttaccaaagtcaggttactgaccaaaatagtgaatgttgggactccatcagttattcccaatgaaagccagttttggcctatagtggcaaggactatgtggtcatgactaacatgtgacaagtattctcaggacatctgttcgtattgcaaggataagagtcttgtagggcactgcttatcattagaatgatgtataaccttcagaccagtctcttgcagaaatagtggcaactaattattttgcgattctgtaagactcctaattcaaaagtaaagttctcaatcctttggagagcgtataggttcatctctgatactgccagtcctgtctcgtgctcgactgatctgcctcctgagtcccctaggcatatctctgcatgctgcggttgctccgagtaggtctcatatccaacccagtactgtgctcatgtagtcacgccatgttcctcagccttcagtactgtctgctggaggctccatagtgctctctgagcagagctgagcactagtggcctgagccatgagcgactaggcgcgcgtgagcgctctcctcttcgtcagttcggctaagtcgcatctggaggtgcctctactgactagaatcgagtgagtaggatgcgtcgtctgaggccccgatatgttcagcgctgactggtccac

SEQ ID NO: 718204 - DNA, 731 bp, Homo sapiens
gaaaaaaagttggcagaaggtgtggcagtcctcattatactgtggaatctgcaagaagcccacgcagatattaattcccactctagattctgtatctagatcacacatggacgaccatggacagaacgtcgactgcgacgctgtctagacctttccggaactccggtggaccagaagtcctgaaattgcgatcagatattgcagtaccgattccaaaagaccatcaggttctactcaaggtccatgcatgtggtgtcacagcccgtgcgcgaccatacattcgctctggtacttactagtagaaaaaccactcttaccctatactacctggcttcagatgtggctaggggtgatagaacgctgtcgccagatccatgcatctgctttcaagaccggtgacagagtatttcactcagcagccacgatctcctggggcctcctgccagagtatgctcttgccgacagaccacaactggttcacaaacctacctgacacaccctggactttaaaccacggagcctggccacggcattcccatatatctcctgcttactcggagctccttgatccaacaagtgcctgtcgtgacaagctggacgcacaccttatcctgcgtccccatggggccaagttccacgcccttgcgcactcagcaactcccatgcccaccacttggctaacaagacctattggcttcacagacttccggggccactgcatggaacttgag

SEQ ID NO: 718205 - DNA, 139 bp, Homo sapiens
cgtccctgccgatgatcgcatcgtgtccgaagcgctgataggcgccctcaccttccagcgatgatcccgactgcccgtagcttgccatcgttctcctacagtaggtcaaacatattgtgtctggtctcggtgtcgatgc

SEQ ID NO: 718206 - DNA, 797 bp, Homo sapiens
gctttccggcggtgctcgcaagcgaggcagccatgtcttatcccgctgatgatatatgagtctgaggcggcttatgacccctacgactgtatcccagagcgacctatgatatgcagcacaggagatccaaaggcaggagccgtgcttagtgaagcgtcagtatgagacagacaaaccttatcagggtgatccctgaggtgactcgaacaaccttcatccagtattgtccatcaaaactggtctcagatttgattgaccagaaagtgtatgagctacaggccagtcgtgtctccagtgatgtcattgaccacgaaggtgtatgacgatccaggacatctatgacgaacagctggaccaatgctgatctgagacgattcttcaatgaattacagccttggtccgaggctgaagccattgtctccacaggttggcaactgatgctgtcttcctgatttgatacaaagacattatacctacaggcacatatatgccaaggtcagtgggggaccttaccttggagcagaggttggaatcctattacaaacttactggcaatctcttcaaattagattcttaatggccgatggtgcctgctaccccttggatctaccccaagccagtgggtctggggatatgatgcgattgagttacatctgaacagtctatcagtcattgcagtccagcaacggtgtaagactgcgcaagaaagtccgacgcagggattgatttcttcgcgccaatcccaaaattgtgggatgtcctagtggctcaagggcctcattccggtcgggcatcaa

SEQ ID NO: 718207 - DNA, 145 bp, Homo sapiens
ccgttcgcggtgtactcacgagacaactttaccacatcttgttacgcacgttcttccacctctcttgggttccttgacgcccgtgtctctctgcacgacacacacatacactcacgacacaccacacacgaacgacactgtacaa

SEQ ID NO: 718208 - DNA, 214 bp, Homo sapiens
tccagctagctcactgtcatttgagtttcacatttgacgcttgctgggacatttcttgtgacattgaatagagtgagtgtcctgttgccattggacagctgctgcctggcactgacctgactgctctgattgtttacccaccacaggcaggttgcgtcctgagtctcaggatcacattcgaagaccacagcatccttgtcctccacgggttttg

SEQ ID NO: 718209 - DNA, 207 bp, Homo sapiens
gcggtaccagcaggctgggccagattaagatgtcagaatagagtagtgggcctgaggaaataaaagtattttaccccaaaatctattcttgacatattttgaaatggccctgcaaaaccatattttgtggaggaaaattgcatctgtggagaatctccttctgtttccaggtctttttctgatccagaagagatttaactaagagtc

SEQ ID NO: 718210 - DNA, 354 bp, Homo sapiens
  misc_feature (326)..(326): n is a, c, g, or t
cagggtataatgagagggaaaaggatgttctttatcaactcactcctttgatccattcgtcctgtccggggtatatggtggtcccagtgtatcggtggggcataataaggtgagtacagcctggaggaagaaatgaaaagtgggagagcaatctggtggagggaatgggaaaaggagccctaactcattggcctcatcttcttgcaagaagtggcatctacatacaagaggcatgaatggattgactctgggggagttcaggactcctaaataaaggaaagagaaggtgcgacaatggccctgtggtttcctggtgttcgtaagtnaatgtgctccagttagagcaacaggatg

SEQ ID NO: 718211 - DNA, 473 bp, Homo sapiens
cccacccaaaatgtggtagaatcaagacgaactttgcatcggcattactttcttatttatcaataagtctgggtctcacgtctgttgcccaggctgaagtgcagacggggtttcacacgtgtaagccaggatggtctcgatctcctgaccatcatgatccacctgcctcggtcaccccaaagtgctgggattacaggtgtgagccaccgcaccccaggccagtttttaacctcttaagttataggttaatgatccatttaggattaatatcatcatatcgtgtaaggacttggtccagctctcttacttgggactatagatatagagattacccaccaccattggttgaaaagactatcttgaagatagttggatcttatatgtctgggctgatttcctggtcccgtatctgtaacatcagagtaccctgtctgtcccttggcccagtatcatattgtttaaattactatagc

SEQ ID NO: 718212 - DNA, 211 bp, Homo sapiens
gttagggttggaggtctctgggggcggggggttggtgctggctagcttggtggctggggttgggagcgagtctccatctcaaaaaaaaaaaaaaaaaaagttcccccttggtacttgtttaattagggaagcgggttgccaatttaggagattcacaacttcgggtgagtctcccatataatgtgtaagcccctaaggagggcggggacgt

SEQ ID NO: 718213 - DNA, 405 bp, Homo sapiens
gaatttcccaatcctagtaagcctggaggctactgcaggagaccaggggtgtatttcagtcctttatctcaaccgcataaagacagacactcccagcacggccatctatagacctcccccaaggaatgcattccttccccagggttattccttgctgggaaaagaattcagcaatatctctgctactcacacatacatttataagctctctgcagaggaaaagtatggctctattctgccagacccgcagacagtcagaccttatggttatcttcccttgttcctgaaaatcactgttattctgttcttttttaaggtgcactgatttcatattgttcaacacacatgttttacaatcaatttgtgcaatagtgggcctgagggtacggtcattctcaccttatg

SEQ ID NO: 718214 - DNA, 267 bp, Homo sapiens
gctgatccggagcctctcggacatcggactacgcaggctgctcggctcggctcggatcaaatgtatgcacacgcaagcatattgacagccaaccttcacttagttatatgcatgcacacacacataaccggcttgggaagaatggcctcgataaccgtctattccgactatgtatgtccttactgcctcttagcggagcaggtgctgtccaatgtgatcggggatcgggacatccgcatcgcctggcgcgcgttcgagttgcgcccc

SEQ ID NO: 718215 - DNA, 965 bp, Homo sapiens
  misc_feature (965)..(965): n is a, c, g, or t
gatagcagagagatactcagttccaggttgtctcctcttcgtctctattcttatctcttgttattatacgatttcgaaagacaatatacatgaatatgtagagacagtgcggacatatgttaccgttgcgaatcttctcgatgcggcatagctctacatgagagcgcgatgatctcttagcgagtaaagcacgacccgggatcttagctcatctggagaatctatcagaactctattcgatcgctcgtgtgcgttgagagcaaacgcatgagcggatctgtctcatttgcggtaggtcgcacgacagaaacatatctatctctcactcgctctctgagaggaaacgtctctcacttcatacacagctagcgatctctgtctaccaagagaggactggatgaagcccctgtgtggagctattttcagagaggcaactcgtgcgtacaccgaaagacttacgcgacacgacactctcatacgtaccgacgaagctgattgcctcggctggacagtgatctagcgaggagcgcacaggagtgacattcttaacaaatcgccgagtatcccacaatatatttctatgtagggagagctttggagaataagacgttcgcaaacagcatttgcctccacacgtcgcacctttttgtggcttaggtacgcgttcagcacgtacacacgcgctgttggaggcacactccatgagcactacgacgcaacttaaaaccacatctgttgagggtcgcgcccaacctgtgggggggcacccaatgtggaaactcccgcgcgggtggaccaagtcgagcgaaaaacgaagtttacgctgtgagtgtgtccccgaagaatacagctggttgtcgtgatctcccagatcacagtggtacggcgacgcgtgggagtatccaagcccccaaaatcatcgcgtgattgccccacgaggacctttattcctccccgccactgcn

SEQ ID NO: 718216 - DNA, 783 bp, Homo sapiens
aactgctgctccggcggactggaggcgtctgatggcggcctggacagcgccgagttggcaggctgagctgggcatggagcaccagtgcgtgtggtgggcgccgtgaagagccttcatgcgctgtggctagtgtcatcgaggctgaacttctggtccaccaagcactggtgagcttactgcggagtggcgaggagatttgccctggtgagggcagccatgagtgccctgtgtgtttcgaagcattcccccagagtgtgcctgtgcccagagcgagcttatgcgactgcccagtggcaaagtgggcttcagcaagtgccatgtccaacaatgtggattctggtgtgtgacaatgacgttgctgtgctgactgtggccccgtggtgttaccgagtggtggacagacatggatggatgatgtgtgcagctggctgtgctccagctgtgtccgggtgtgggacatgtgctgatgaagctgggggagaaggagaggagcgagctgaggaagagggaagctgtatggcttgaaagttgactcttgaagacactactggtgtgagcaacgtgcagttgccttatgataccacgcatctccgaaggcagagacaaagctgatgccccagagatgatcgtcctggtggctcttggttggaccggcctttcagcctacaacttctttgggcctctgtgtctccccgacagggcaccttcccctgtgtcaggtccggtcccagtccgcaggtctctggagcgtgggtcacgggtgcgattgtactcttggagtcc

SEQ ID NO: 718217 - DNA, 1018 bp, Homo sapiens
  misc_feature (74)..(74): n is a, c, g, or t
  misc_feature (86)..(86): n is a, c, g, or t
  misc_feature (89)..(89): n is a, c, g, or t
  misc_feature (97)..(97): n is a, c, g, or t
  misc_feature (102)..(102): n is a, c, g, or t
  misc_feature (144)..(144): n is a, c, g, or t
  misc_feature (148)..(148): n is a, c, g, or t
  misc_feature (190)..(190): n is a, c, g, or t
  misc_feature (202)..(202): n is a, c, g, or t
  misc_feature (528)..(528): n is a, c, g, or t
  misc_feature (531)..(531): n is a, c, g, or t
  misc_feature (533)..(533): n is a, c, g, or t
  misc_feature (537)..(537): n is a, c, g, or t
  misc_feature (547)..(547): n is a, c, g, or t
  misc_feature (557)..(557): n is a, c, g, or t
  misc_feature (597)..(597): n is a, c, g, or t
  misc_feature (602)..(602): n is a, c, g, or t
  misc_feature (607)..(607): n is a, c, g, or t
  misc_feature (620)..(620): n is a, c, g, or t
  misc_feature (634)..(634): n is a, c, g, or t
  misc_feature (640)..(640): n is a, c, g, or t
  misc_feature (655)..(655): n is a, c, g, or t
  misc_feature (659)..(659): n is a, c, g, or t
  misc_feature (672)..(672): n is a, c, g, or t
  misc_feature (689)..(689): n is a, c, g, or t
  misc_feature (698)..(698): n is a, c, g, or t
  misc_feature (705)..(705): n is a, c, g, or t
  misc_feature (716)..(716): n is a, c, g, or t
  misc_feature (722)..(722): n is a, c, g, or t
  misc_feature (732)..(732): n is a, c, g, or t
  misc_feature (735)..(736): n is a, c, g, or t
  misc_feature (739)..(739): n is a, c, g, or t
  misc_feature (742)..(742): n is a, c, g, or t
  misc_feature (744)..(745): n is a, c, g, or t
  misc_feature (750)..(750): n is a, c, g, or t
  misc_feature (761)..(761): n is a, c, g, or t
  misc_feature (763)..(764): n is a, c, g, or t
  misc_feature (766)..(766): n is a, c, g, or t
  misc_feature (784)..(784): n is a, c, g, or t
  misc_feature (790)..(790): n is a, c, g, or t
  misc_feature (874)..(874): n is a, c, g, or t
  misc_feature (887)..(887): n is a, c, g, or t
  misc_feature (927)..(927): n is a, c, g, or t
  misc_feature (1012)..(1012): n is a, c, g, or t
ttcggcataacgtaatccatttcactgtagcctaaactccagtccgaggttggatattgttcaaatgagcaggnccgagctggaancanaggagccngcccngtgccgctcctcccttgccctcaggcaggtccctgctggaanggcntgcatcttcctgtcagccctggtttccatggtgactggcgtnacgcagccaccngagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggcctggatggggtattttggtgtcacctgaagtccctctgacatcaccttgtttcatcattttttatgacagaattagaaacccatccttcaagcacaataatnatnanaganttgagtttgnttaataaagnaaaggataagggtttgtttggaaaatttttttgatttatnaaatnaattnatttttatatttncccaatatatatanaaactnaaaaaaaaccaaacnaacnaacccaaaaaatntttaataaattaataanacattactnataagcntttataaaatnaaacanatttaaaaanaannttnacntnnctttnaatcaatcacntnnanttgttttttagcatgganactgcnagcaggacagacagggatggagtaaaccgaagtcaatttcagggctcttggcgtgttggacacagaagaaatcctagtgcagcntttggtagctaanagtcactgattttataattggagaatgcgtaaagattcanttttcaaggagaagagcctgcaaatggccaatgaaggaggtaaataaactaagatattccgagggaagggacccaggccacatanattaag

SEQ ID NO: 718218 - DNA, 179 bp, Homo sapiens
  misc_feature (1)..(1): n is a, c, g, or t
naccccctagcagcttccttacaaaaccatcagatctcgtgataactcaccactatcagaacagcatgggggaaccacccccatgatcctatcacctcccaccaggtccctcccccaacacatgggggattataattctgattacaattctagaataagatttcgggtggggacacatg

SEQ ID NO: 718219 - DNA, 303 bp, Homo sapiens
gacactaccagtcacctttgatacgcgacttttaatttatgattatacttagcctcctcctcctttttttttaccccaagtttgacttgacttggctttttcccccccaagtaaaacaaatgctagctcccagctggaaggtaaaactccagtgtggagtgaatttggtgtctatttataaccctgtacaccaaaactcagacttctggtcactgttcttggctttgagatggtcccctgtaaacccccctttaaaagctattatggcttttagtcacagcagctctttttggaaatgttagg

SEQ ID NO: 718220 - DNA, 527 bp, Homo sapiens
tcagctacaggaactttgctcttatgtggtctagtctcgtctttccacattcaggagaccacgtttacacggctgcattggaactggctatactagagaatcctcagcttggttctcagctgttggtccccaggcgacaaggaggaagaagagttccgcaggagctttgtgagaaatgtattatcacatatcttctactccatttaattaataatcttctggctctaagattatatttgaaatgataatggtattaaaatggataacaaaattgtcacattgttattttttttttatttttatcagtttactaagtgttgttatatgtctctcatttctttcattaagaaacagccctgcaccttatgttgtatcagttaagaaactgtagtttgcaagtaaaacaaaattcaacttaaactagtagtggcagggaaaatgttggttcatcaaagtgaaaagcctaatttctttcaagtgtggcttaatccggagattcagatgacaacacttagtaaactgataaa

SEQ ID NO: 718221 - DNA, 285 bp, Homo sapiens
catttgtggtaaagatttgcattccctaatgactgatgatgaaatctttcatgtgcttattggccactggtatgttgtcttatggagaaatccgttagcccatttttacagtgggttatttgtctttttatcattgagttgtaagaattctttctgtggctggacgcggtggctcacacctgtaatcccagcaccctgggaggccgaggtgggtggatagcttgagtccaggagttcaatgaccagcctggacaacatggtgaaaacctgtctctacaaaaaaaa

SEQ ID NO: 718222 - DNA, 382 bp, Homo sapiens
acaggttgccaggaggttctgtttggcagactattattataggtttgttagtatgcaagggcaatggccagactgatgggtacttgtttttggtgattcagtttgtctaatatgagtatgtgagttattgaattgagtccgtaatatagtggagttactagtggtggtgattttggagaaggctgggttatatggtggtgttttttggaagtgtgggcaaagagtaatatatatatatattactcttatatatagatcacttatcaacaatctatctatataatctgagaatagccacctgaggtgtatactacttggggatccgtgcacgttaacgatgactaggactatgcagaaaccagagagtttaagaaaccggttt

SEQ ID NO: 718223 - DNA, 777 bp, Homo sapiens
gcgcggttcggtcctcgcaccggcaggccgcactggtgcttggagctgctaggaagcccctatcgccgaggctcgttggagcttgaacccattggtcacccctccgaatcaacggcccaaaaaaaaaaaaaaatgtttgaacaaatgccaaggaaggctctacatgggggggctaaatacggaaactaatgaaaaagctcttgaacatatttggaaatatggccacttggggaatactcttgatgaaaaccgtgaaaccacaaatcagaggattggattttggtcaccttttgaaagcccagcagacggctaaggattgccgccagaaacctgcaatggaacagtctttagatgcgaaaaccaccatccaggggggaacacgccaccaaaccctcattccgaacacgtggtagaagtgtggaccggcctccaacgctccaagaagtagaggccctccagaggtcttagaggtggaacaagcaaggacgtgaacggaacacagagaaacctccttaacggagaaggacaaattcacattacaggggacatttccaaacacaatgttaaacacgtgaagtacttcccagggaaccaatccacgatataacgatgacacaccaccaaaacaagttgggttcccaatcctaaaaaaaatttgccgcttcggcgaacacagtgaacaaaacagcgtaaactgcaagagaagagtctccctgtcccaaggtgcgaacgaaaaactaataatgcagtcccacctacagcgaaacgagttgacct

SEQ ID NO: 718224 - DNA, 144 bp, Homo sapiens
gtactgatgagattctctggcgaagttacacccttaagaattgagatctcttaaggatggcagaagcaggaagacacagtggcatcttcttctggagaggcctcagggagctctttactcatgacagaaggcagaagcaggaag

SEQ ID NO: 718225 - DNA, 263 bp, Homo sapiens
ccctcgggcttctaaggattcggatataccatctttcagcaagagtatctggctcgcatttacagctagcatagacattggtatgcacttctttccccagataggaagtcaaggaggatttcgttgcatgaaaaccggatgttaaacattgattacataggagtacagatgaatgagctgcaatacttcagtcggacgctaaacaataagatcagggaaggtaaaaatacctactgtggacactattttgaatcgtaagcttt

SEQ ID NO: 718226 - DNA, 168 bp, Homo sapiens
gagaggactggagataggggaaaagagaaaaggagggtaggagagggctggagagagaagggaagttaagaagggaaggagagagacagacattagggaagaaggtaaggagaaaggaaaaattacaaaaagggcagagagaaagaccagcccggccattgtcccttg

SEQ ID NO: 718227 - DNA, 186 bp, Homo sapiens
atagcgtttatttacttgttaggatttagtgacttcatttgctatttctcttatagtgcagagttcatttttgcccctgaaatgctattgctgactttgctgaagatattgtatttcaacctcatccatgaaaatacaaacaccttctgttgtggatggtgagcctctgatgccgcttatttgccg

SEQ ID NO: 718228 - DNA, 249 bp, Homo sapiens
tacctacagctggggacttcacggggcaatacgcttctgatgggtgtacagtccctgcacttgtccatagaatgttggttgttatcattctgtaatgtgttgtctcgatatttctattatgctgtgttcaattataaagttgaacagaacgcggttcccagtcatatcaagttcagcatctaccctcccattccaggagaggagagctctctgaggtgggcaggaaagacatctgaggagatcccaatg

SEQ ID NO: 718229 - DNA, 104 bp, Homo sapiens
ggcaggcctgcccgggaggcccgcccagaagtcggcgtgaacaccccggggtgggcagcacagggggtgagcgggcccaccctgcccagctcagggattggcgg

SEQ ID NO: 718230 - DNA, 589 bp, Homo sapiens
  misc_feature (233)..(233): n is a, c, g, or t
  misc_feature (278)..(278): n is a, c, g, or t
  misc_feature (281)..(281): n is a, c, g, or t
  misc_feature (297)..(297): n is a, c, g, or t
  misc_feature (304)..(304): n is a, c, g, or t
  misc_feature (310)..(310): n is a, c, g, or t
  misc_feature (322)..(322): n is a, c, g, or t
  misc_feature (364)..(364): n is a, c, g, or t
  misc_feature (577)..(577): n is a, c, g, or t
gaatgagaggccctggtagcaaaccagtggaagaagttttactaggagcagttgtatcattcgtgtactttttttgtgtcatacaagtgagagtaaaatggtccatgtctgtgttttgaggaattttttgcctttcttttcagaaactaattctgaagcaagcccttatagttgtgctgcagtggtgtttcaatcacaattttagtgttcgactgtatgctttagtgtgctcntaaagaaactctggactgtgtggaaaagtgttaaagtggttgaangantttgatgccctgactncctgtgnatttgnaatccaggcctnccatcaagttggaaaagcatgcacgggagccagggggaatgnccaaagaaagaattgggcaaacgcatttcagggagccattttctttttttgcaacatttcaccccactccaagggatttattggtctagagaccatattttacatccttccacgcctttcaggccttattgaagatgaatggatcaccattggataaatttaccagattcactggatgttcctttagctgcgggatttcagtggtaccttctnaaactccagctt

SEQ ID NO: 718231 - DNA, 1267 bp, Homo sapiens
gccactgaaccaccgccacccacgtctcagttttgatctgcaaaatgggataatcctagtacattcctcggagggtggctgggacccggtaaaaatggggtctggggtctgggttccctattgaaacaatctattcccagcctctcccactggagattaagtcagtggaggtggggcgggactggagacgctgatccctggtgacatgtatgatcaggcaaatttaggatacactgatgggtggggaccttgcctctattcttgttaactgccatccccatcagaagacagcgtggaagtcagaggatattggatatacctcaagccagcccagatgaacataaaatctcagtgggaaaggtgtgtctcttatgcaaggggaaaaaaaccccaagacgcatgcacgccttggccctctcccctccaacgaccttccctcggaaccccacttgggatagatttagaattgattccgggagtcccaggtcttgaaggacccgagtttaaatgtaatttccttaggagaaattttcagagcaggttcaaggcctagggctcagaatttgttccagaacttcatggtaatcttgcagccaagttcaagcttcatcctggtctggagggttctgattgctgatggcttgttactgtgggtgggaaggttgaaatctgggtattccctggggtggtgttactttttaatttaggaaatgacatttctttgtttgctgaagtcaggcattgagttaaaggcagctctctctccttcccatctagataagggctttcttttcagtgagtgttacccgtagaattctttttaaaagggcccctactgtttgtgtagatcctatgtgaatctttttatagcttccgtttgatttccattgcctccttacagttcaatctgaaagcaatctgtagctagcctgcctttttaacagaaatctgtttccagttctggggttttcctaaagattgacaacttcgttttgagggtgtgggcagggttgttgagagctgccaagttactgtacaaaaaaggccagagttttaacttattttcaaatggaataaagcccattgtaaaggaaatacaatgggcaacagttgaaatcttcagagcaatggttagacttcacttattcattcagcaaatatttgttgaacgtctactatgtgccaggcaccctctaggccagccccgaccaacagaagtctaatgtgagccacgtatgtaatttaaaatgttcaagtagccacatta

SEQ ID NO: 718232 - DNA, 299 bp, Homo sapiens
agtagctgacacttatggagatgaagaaagcaggtgtgagctacgggttcatcacaagtgtgaggcagagtctgcactcctgaagcaaaggggaactcttccttaacagggagaatattgtatcacaaggatgtctggaggtagacacatccttctcctgtcacattcatgtattccccaggcagctctggcaatgagacctgctgcagtcacaggcggttgttgttgtccactaggactttgctggaaaatgtccctcacgactggcatagtcacctgtgccgccttcagataaaatg

SEQ ID NO: 718233 - DNA, 502 bp, Homo sapiens
  misc_feature (6)..(6): n is a, c, g, or t
  misc_feature (11)..(11): n is a, c, g, or t
  misc_feature (114)..(114): n is a, c, g, or t
ctgctncgaantgacccagagataccccggccctttgcagcatgagaaagccccccaaagctctggaatttacctccacatccaataataagtgaatgttttcagggttacatngtgttgtgtcatttgaattcaatttgactacgcttgggctttggagagggactgttgagtagacgcaggtactttctgagcttgatagctgacaattctaaagcgcatgtgttacacaagttttaaccagtcaggagatttttacatagccagtgatagatactttatgttttgtataaattttgtttaggctgcaatgtttagcttttaactaactcttgctgtcttaagttcataactatgtttaatggcacacttacaagatatttagcatgtaaaaagcaagacttttgtttttttgtttttaacggcttcatattgaagctgagactttaccacaaacaagttgagtggcaggcctggtatgctgtatcttgttacataaagc

SEQ ID NO: 718234 - DNA, 590 bp, Homo sapiens
aaattaatttttttttaaataaaatactttaaattaaattttttcaattaaccccgtaaaaaaagaacaaatacctgcaaacaaaaaaaaaggccagcttcccgaaaaaaaaaaaaaaaattcgcccaaaccccggggtttgaaaaaaaaaagcccaaatctgccacaaaaaaaaaaaagcccgcccacaaaaaccgctacaggctcttcaaaatttggcccctcgtttccaaccaaaaaaccccagtaaaatcccaaagggagacaaccgttaaaaccaccaccggcgaatctgttgaataaaactcaacccctatttctggataaccccaccaccctcgcaaggacaagctagcgccaacatgattccctctaaaccaccccaaaaaaccccgccttaataaaaaaataacgccgtccacgttggaaaaataaatcccctcaaataaccacaaaaaaacaagcgggaacaaaaaaaggaaagacccgggggcaaaataaggcgccaacacaaataaattgcgggggaaaaacgacccactaccagagcaaaaacacggcccacaccgcaaaaaaaacacacccaaccg

SEQ ID NO: 718235 - DNA, 114 bp, Homo sapiens
gcagaggctcatgcagccttgacctccaggtcccactcagcctcccaagtagtgggaccacaggcacgtgccccatgcccagctaatttttattttggtagagcaaggtttccc

SEQ ID NO: 718236 - DNA, 396 bp, Homo sapiens
  misc_feature (32)..(32): n is a, c, g, or t
  misc_feature (182)..(182): n is a, c, g, or t
gccttactctccaaaatgatctcttctgtgtnactaatggattgactgaaggctgccagcccctaggtagcttcaagatgggggctggtcatcagagagacataggcaggattagagggttggactttcatcccaccatcccacgtactgggagggaagggggctaaaggttaagctgttcnccaatggccagtgatttattcaatcatgcctacgtaatgaagcctacacaaaaacccaagaagaccgggttcagagaacttctggtagctgggcacatggaggttcctggagggtgccaagccctggaagctctgtgctccctcccacatgccttgccctatgcatctcttcatttgtatcctttgtaatatcctttctaataaactggtaaat

SEQ ID NO: 718237 - DNA, 231 bp, Homo sapiens
taatttttgcttatctatccgactatcatggcacttgagttgtttctgtattttagctattgtgaataatgctgctataaacatgggggtacaaaaaaaaagcttgtttttgtttgtttgtttgtttttttgttttgcttttttttttgagacggattctcgcactgtcgcccaggttggagtgcagtggcgtcatctgggctcactgtaagctccacctccggggttcag

SEQ ID NO: 718238 - DNA, 710 bp, Homo sapiens
tctgaattatataatcagctgaaatttccagtaaagccgggagatttgaaaaagagaatgaatctctgatagacagagactatatggagagagacaagagacaatccgaatcagtaccactacgtgcgctgacgcatctgtcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttattccctccagtttttcctctagttcttttgagcgcactttaaccatcgttctcggtaacctctgtgcaaccataacttgtgaccgatgggacaacgaagatgttactaaaagcagaagttcctttaaaaggtctgtcctatgtgtcccaacacgctgcaagttctggctctgtcactcgcttgtgtgatcattgagtgcacaaatgaacgaagaccctagatgctgcattctttagctctgaagattccttaggtatccctgaagacagctcgctcagatgatcagcataaagagtggaacacgagggcccttcatggggtgaaccattagaaaggagccagggttcaaaggctggcgaactgggtgacgccacctaagacactggggccctca

SEQ ID NO: 718239 - DNA, 192 bp, Homo sapiens
cgcccagttaacatcagatcacgccaatctcagcatatagctaagactaacaaccaactgaggcaccagaaacatgaatgaagcatcttggacatcccagtcaaagccaaacccactcctgagtggatctgcatgatgaacccagcaatccgcaccatggagcaaaggatccatccagtcaaaccaaagaat

SEQ ID NO: 718240 - DNA, 309 bp, Homo sapiens
caatacgcatcaggcgataatagagctggcaactagcaaagcagtgcgctaccacccataaatataggtggggagacaattaacatccactaagtttctctacataaactattcttttaatgtcatttttttaagacacagttgcaaatagactacataatatacgtgggcacaacaggccatcacgtgactctctcgaaacactaactgtctacataaacagcatattatcaacatttacatgattcacatcaaactgcagacatcctcaagagtattcctttgcaaggatagcatttataaataaca

SEQ ID NO: 718241 - DNA, 278 bp, Homo sapiens
  misc_feature (9)..(9): n is a, c, g, or t
cccccaggnacaaaacactgtgtcccccccagtgcaggaaccgtgataagtctttctggcgtcggagcacgtaaatacgtccctctacagagtagtggggatattttgttatagtttgcactttgtatatatggttgaaactgttatcacttatatatatatatacacacatatatataaaatctatatatttttgcaaaccctggttgctggatttgttcagtgactattctcggggccctgtgtagggggttatagcctctgaaatgccaggtacg

SEQ ID NO: 718242 - DNA, 409 bp, Homo sapiens
  misc_feature (399)..(399): n is a, c, g, or t
tacccccttatatatatatgaaaactaaaggtgtgtttaaagagcaatcacttcacgtttagttcaaataactcataagtcaatcccatctatactttgacttacccattgcttcaagatccctacttgaggccgggcgcgtgtgcacgcctgtaatcccagcactttgggaggccgagacgggcggatcacgaggtcaggagatcgagaccatcctggctaacacggtgaaaccccgtctctactaaaaatacaaaaatcagccgggcatggtgccgcgtgcctgtagtcccagctacacgggaggctgaggcaggagaatggcgtgaacccgggagggggagcttgcagtgagtcgagatcgcgccactgcactccagcctgggcgacagagcgaantccgtctcaa

SEQ ID NO: 718243 - DNA, 1326 bp, Homo sapiens
gcacagaatcagctcaaaatggctcgtagtcaccattgtgtgatgggaagatggggacaaggagtcagcttcaaagacgtggcaggaacatgcacgaagccaaactaggaagtccgcgagtttgtggattatctgaagagcaccagaacgcttccatccagcttgtgatgccaaggatcccaacagggctgcacatgtctgctcgtgcccaccctgagatgtgagtgaaagacagctgctgtgccaatggcggtagtgccactggatggctcagtgtgcccttcctggcgatggccgagccagagttcgtggaggtcattggaggcctcggcagctgaccgtgtagcggagacctctattaaggaagcccgagcccgggccccctgcatcgtctacatcgatgagatcgacgcggtggtgcaagaagcgctccaccaacatgtccggcttctccaacacggaggaggagcagacgctcaaccagcttactggtagcacatggatggaatgggtaccagggaccatgttcatcgtcctggctgtccacgaaccgaagctgacattttggacggtgctctgatgaggcccggccgactgcacaggcacgtctacattgatctcccaacgctgagagaaaagggtagagcgcagccaacacatgctggatagcaggcctggaaaacactcacggcggctccacatccgggacacagcacagcagagacaccgacgcgaggccaccaaacggtaaaaaaaaaagacgcggtcccacgtacacaagagggcactacgaaaaacaacaacaagaacgggaaacaaccgaagagatcccaccgagtcactgaaccaaattgggacaaaaaccagcgggaaatcttggttctctggtgtgttgttcgtctaacaaaaaaacaacaaaaaaacaacaacaaacactaacaaataaaaacaaaccaaacaccaaagacaaaaaaaaaaataacataaaaaacacacaaaaaaaaaacaaaaaacaaacaaaaacaacaacaaacaaactaaacacgccacacacccaataacaaaacaataaacagacaaatacttatcaaacaaaaaaatctgaccactacaatagataacccacatacaaaacaccaaaccacacaaatatcagaaaccatacacacacaaaaaaaaccaacaaagcctcactccaacaacaccaaaaaacaccaaccaaaatcagacaactcaaaacctacctaaaagaacaccaaaacaaaaacgaaacaacaaagaacaaagcaaaaaaacaaatcaaacaatataaaacaaataaaaaat

SEQ ID NO: 718244 - DNA, 365 bp, Homo sapiens
tagtctgatactgcctttactctacagcgacctatgccatagcctggtctaggtggtcactctcactgaaggacgcaatgtgtcgtgagaacacacgcacacctgtccaaacccaacgacatggacctgcaggcacaacgaacaacgaaagtgcgccttttaatactagtctatgcaagatcgggtgtctaggtgaagcaggaacatccaggcagtcacaacaggtaattcctctcctagcacataagtcctacccccagttacctacactaatcaagtactatggcgtaaccaatcttcccggaccgtcacctaagttacatacatcccacttggaaagatcgagctacaggtaccgagctacg

SEQ ID NO: 718245 - DNA, 553 bp, Homo sapiens
ttagacgaacagaaacagacaaaaccaaaagataattttttgaaaagctcaacaagattgacaaatcttgggctagatggactaagaaaaaaagacaagacccaaattaccaaaatcagaatgaaagtgggaacattactccaggttacatagaaataaaaaggatataagagagtaccatgaacaactgaatgccaacacaatggataaactcctagaaacatgcaacctaccaggactgaatcataaagaaacagaatctgaatagaccaatgactagcaaggagattgaatcagtaatcaaaaacctcccaagaaaggatggtttcactggttaaattctgccaaacatttggagacgaattaatatcaatccttctcaaactcttccagaaaaactgaaaaggaaggaagtacttcctaactcattccatgaggccagcattatcctaataaagccagacaaagacactacaagaaaatgcaggccaatatcccctgtaattctgatgcacaaatcttaataagtactagcatccaaatcagcagcatt

SEQ ID NO: 718246 - DNA, 342 bp, Homo sapiens
gagtctagaggcatccccgtaagtaagtcaaatgcagatgcactaaaatcaagaaatggtaaatgactagtatagcatttaataaaaaaaactcttaagaacaggtactaaatctgaatcatagtttaggagcttgtttgcagtacttataaaaccttatccacaactggatttgacgtagagaaagtatcagccatatagcatttcacgttggggtatctagacgcctgtactctaagctgctggctcaaatctcttccccagctacttcttataccactatactttaaatgtttgcctactcatacgcacctcaacacttgaatacatactctaaaaatc

SEQ ID NO: 718247 - DNA, 508 bp, Homo sapiens
ttatgtttacgaagctggttttgtgccgtcgcgtgcgacggggcctcggcgctaagcggcccagctggctcagggagcatggctgtggtctgggcgcagaaggccttcccgcgcccaatcctgcttccccacgaaggagaacccgtgggcagtgtgattcgggtgccggaaacccccagcaaagcagcagggcccacgtaagacataaccgcgggcgtgagcgatgtcttacgcaggatccgagtcccgtctgtgatctgcacgacagctcatggcaacactggatccttaacccagtgagtgaggtcaggattgaacctgcaacttcatggttcctagtcagattcgtttccgctgcaccacaatgggaactccgtaagacataaccgcggccgcggttatgtcttacggagcaatgaagggaaacagtggctctcagtttacatctacttatgttgtatatccactaagaaactttagttacaaggagtctcatcgtggctcagcg

SEQ ID NO: 718248 - DNA, 313 bp, Homo sapiens
  misc_feature (148)..(148): n is a, c, g, or t
aaggccctgtgtaagaactttgagatgctatcacatgtggatcgtaatggcaagaccagcttgctctgttccctgtgcttgaccacttcttacaaagtgaagcagggagggctcaactgcccttcacggaccctgcagcttttgccgncgcaagctctctgaaccctgttactacaacaagggtgaccgcacaggctaccagttttgcaggcccagctgctgaaacagttccaacgacaagccctgaggggggcatcaactgagctggcactaatgtacaaccttttcagtggcaacctgaagcttggactgg

SEQ ID NO: 718249 - DNA, 295 bp, Homo sapiens
gtaccctacgataatctggattctttatcagcgtactcgtctgcgcttaatcccagtgtttactatactggatgatctcgctttcgatgaatttcgtttataataacccggtgacaaactatccaggctatatattcgcaatcataatatcgattttgttattatcaattagaacgccggagacgggttccgtgagtcgctcaagaaagaatgtaggttatgtgcaatcgctacattgacacggtattatttaaaattgcgaggtaattaatgatttatgtcaatgcgcgattct

SEQ ID NO: 718250 - DNA, 273 bp, Homo sapiens
gactcctttttaaggagcggagtcatggtggccacggaaggatgtccacatgtcctatgcacccgcgagctggcatgacagagaatgtgcccaaccttcatgtcatgaagggccactgcagatctctcaagatcccgaagtgctatcgtgaagcgaacaagtttgcctgcgcagtcacatttctacaggatacctataccaactgaggagtatccagctatctcctgtaattacgcttcatctgcccccgggagattgtgcctgtcaacacta

SEQ ID NO: 718251 - DNA, 440 bp, Homo sapiens
ggagctctatcgctgacacagccgtgcttctggaacattgggatactcgcgtagaagtcattagggccatcaagtttcaccatcaggtctgagggtgcctccccaaaaagagtgttatgggagaaggtacaggcccaaagttggctgacccagagtcggtcattcagttcaactcccatcagggggtagaagtgtgtcacaagcgatgccccagtctgatagccagacagaaacaggctgaggtaatgctttgcttcatgtggcggcagagtctgttgataccagagggatcgagcaaagttgagacacaattgctggtgtatcagcattactgcctgcattgaattctgggagaggagagctgggtttgtgcctgcttcctcttcttgcccatctgaagttcctttgttctcctccaacattgggtgccccataatatc

SEQ ID NO: 718252 - DNA, 118 bp, Homo sapiens
atacgacaattagagtgtcaagcggccgagcgctgatacgcagtagatatgcataggacgcgttctatttgtggtttcggaactgggcatgattaagaggacggcggggcttcgtatt

SEQ ID NO: 718253 - DNA, 789 bp, Homo sapiens
  misc_feature (590)..(590): n is a, c, g, or t
cctcaaaatcacccatttctgtcaagcatatattggcctcgtcccatgtctcagtgttgcctgggaattgctcccaggacttgggggtaggggtgaaaagcgtacaacaagatacttaaaagggctccgtggggtgacacaagcccagtcagggtcctgagtgacaggccgggggcccatccaaatgctcagtggtatatagcaagactcatctactacccgtaagttctccgaaagtgtcacgtgtctagcctatcctcaaggttctgatatctaggacaggtcttgacatataccagaggaacattaaactattgcttagtatataaattaaacatgtatagataataaaaaagacaaataccacgtggtcgtgtccgacgtcaatacagtttattccacctgctggagcgtggtcctcgaaggctttaactgcaggtgaacgccgacacatgtattcatgtgtttacgaaaagttgggggtcactataagtcagccttgaagtttccgttaattcaataaccgcaataaggtcccctgaggccggatcgtttgtcacaaacgttctgtgactgggagaactagtggntacagatggggaatacctgtgctgagaggtaacttttatcttactggggttgtgacatacctggtgaacaaactgtaaccttacagagactagacaagttattaaaggtcaactatggaactgttacggtgtcttctggggttaaactacgctgaataatgatttgctgttgagaagtgggctaacggagtataatata

SEQ ID NO: 718254 - DNA, 223 bp, Homo sapiens
aaagcaagatacgaatcgagccggtacctaaatctctatgaatcggggtggtaagcaagctcagagtacgctcggtagtccatctacagtcggtacagcgtcgctcgattccaagggtcgtgggtcatggggagcactggatgcttcttctctggctccatgtctctccctgtctctgtgtgtgtcttggcctctcttcctttttctgtcgggctagtcgggg

SEQ ID NO: 718255 - DNA, 478 bp, Homo sapiens
cagacgtagtacgtgacatggtcggtatgagagtatagctaaacatgtttcacctgtttctggcgtgcgcgcgtttcagctccatgtttggtcgctccctcggaagcgtgtacggatcatcactccactcctgggagtaataagtggccgcatcctcagtctccagttcgattgatagtgagcgcatacgacggtcccagacgcccctgccactgacgcgaaaagggacctccaggacgccacgtaggatgtgtcatcaatcacggacgtctgggggcggctcccggcttctgtaggtaccaatactctgtaccgtatacttgagctgttagtgcaggtcatggtgaccctctcccctggaggactgcagaccatgagggctggacactgggtgagctcactgtcagctccgccaccgacagagccatctccgcctgaagcgtctccacatgaggagacggtgagcgtggtcccttgg

SEQ ID NO: 718256 - DNA, 297 bp, Homo sapiens
caggacccggcatatccagatgcagactcaggctcggccttgggccctagggacctgagatgctatcggatatccagcgatcgtaacgagtgctcctggcaccatgagggtcccacagttggggtcagccacttcctgaggtgttgccttaactccaggcgctggtggtacttccccgccggctcaaccaccacgctgaagaatctcccaccaggctggggtgtctgtgctgtacactgtcacactttgggtggaatactgcgccaagaaccagacagagaagtctcctgaggggac

SEQ ID NO: 718257 - DNA, 180 bp, Homo sapiens
ctaaaatcggaggccctagctagaataacaaagaaaaaaagacatgagactcaaataaataaaaccagagatgaaaatggagacattacaacagatacctcagaaataaaaaggatataagggagtattatgaacagttataatcaacaaattggatacctagaggagacaataattctg

SEQ ID NO: 718258 - DNA, 210 bp, Homo sapiens
catccgttagataggaatttgggcagataaaaaatcagagttcgtcctcacacttaacctctgaagttctcaggtgcattcgacgagcgccaaccttggtggtccacacctctctctgagccccaggtcttgtctttctcaacaaggcaggatgacccctaagaaatctccaccaatggagcacagagctgcctggtgagaggcgtcacc

SEQ ID NO: 718259 - DNA, 515 bp, Homo sapiens
  misc_feature (317)..(317): n is a, c, g, or t
cggcatggtgtctgtagatagggaagagtgtgcttctggggcataaccagcaggagcccaagcacaaacgtgcacacctgcatggcatggagaggcgcagagaaaccaacgctggggccttccggagaggcaggggccagccaaagagagccacccaactgggcttctactgcaacatggctttgccacatctacttgctgggtgactttagggccataactttacctctctgaaactcttttgtcaaccgtagctcctttaagaattcttaggaggctgggctcagtggctcatgcctgtaattctagcactttgngaggctgaggcaggtggatcacctgagatcaagagtttgagactagcctggccaatatggtgaaaccccgtctctaccaaaaatacaaaaattagccaggtgtggcggcatgggtctgagcttagaagtcagtgactaatgtttgagatgtccctagcggtgtgctactgctcaatagacatttctgagaaagctttg

SEQ ID NO: 718260 - DNA, 462 bp, Homo sapiens
ggttgaaaatttacaaagtgtgtcgtcgaacgatgctacgagtcaaaaagtgcactcccgatttcttcatagtctgattctgaagtagtctcatcgcatggagtttgtctggcaattgaatgaacttggtctaatatttcttcaagtaagtaattaaggaagtcctgcttccttgcatttcttaagaaaaggaactttcacaggtgcatctgtgtgtctgccatgctcttctttcacttgtcgttatgaatgtattacatttcattgtttcgggtggctgtacatgattgcctgagaggggtttcttccttcctctttttcttttcactcctgaaaatttagctaaaaatataaaccatttaaaaattggaatccataaaggaaaagattactgtttgactacatgaaatatacaactcatatgccaaaagtttttacaaagtcaaaagatatggcaaactt

SEQ ID NO: 718261 - DNA, 171 bp, Homo sapiens
cgtttcagagcaggaactgaagcatctcatccttgcaagcagctgatggatttctgtaatgtggtggctgctgagacaggccgagtgatttatgtgtctgactccgtcacccctgttctgaaccagccccagtcagagtggtatgggagcacactgtatgcacaggtgcat

SEQ ID NO: 718262 - DNA, 1187 bp, Homo sapiens
  misc_feature (808)..(808): n is a, c, g, or t
ctttttttttttagtaagaaaaaagaaaagaaaaaatatttgtgtcatacccttttttagttatattattattattttttttatattgttactattttgttatttgtttggaattatttttttatatgtttttgtttttatttttatttcttatgtttatttgtttgagtggggttttgtttcgttttttggcttcttattttttttctttctttgtttttggtccattgcctttttgtgtttttattgctcttgtgtttgtgtccttgtatggttttgtttttttgcttcttgcgtaggtcctttcttgttttctctgtgttgtttttctgcttctgtctcttttcatgtttttttgctttttatctattgtttctggttctttttatctctcttttttcgtggttttggttatttcctctttgtgtggtttctattgttcttttctggtctcttccggggattatttgtgtgttctatctggtgttttggcttttagaaatgtggttggacttagtatgtctgttctcttatgactcaattttggggtatgaagctcatatatgttgaacccttttttaatgttcctgtaatcatcgcaattctctatattctgtcatggtttccacagtcatgccgtgttaatcgtgtctttcataaatgtgggcttaattttgttagtttaagttcttttgatggtatatgtatttaatgttaaatgttttacggtgggcttaatttgtgtgatgtccatgaattgtgtgatggttcattttatagcgtctgttacctattaggtatcatagtnactatttatgtcttacgtggaattattgttgtcctactttggtaatatctgtgagactgggttgtttgctattaataaccacacataccaatacatatatatcttatacactctgcggtactttcatcttcaagtctggtctttttttcccctagtgttaaggcaatcctgcctacttaacgaacaccttacttactgtaacactccattctgtgaagctgtatcgcagtgaagggggctaggcagggcatttgtgccatactaagtatcaccaggtgaccctaccatatagtgacctatcgcagttttgaagtcgtttctccccaatctccctactcctgaaggttgctgccttgcatatttactcttcattagtggg

SEQ ID NO: 718263 - DNA, 183 bp, Homo sapiens
atacttttccccgcactaaaaaccctgttaaataggggatatgaatcacaaatggcttaatcacaaatgggtgtcccaaatatccaatggtttggaacacagacacacccacaatgacctccctttgcgaaagttggcaaaccataatttttgctttcttgcgcttccaaacaacctttatcc

SEQ ID NO: 718264 - DNA, 377 bp, Homo sapiens
  misc_feature (153)..(153): n is a, c, g, or t
ctaagtcctgcattcctgttaaacccccttgggtcataagaagggagtaaaaaatgaagtctgactagaattttattgcagaggccaagtacatttagtagggcattgagttgtgaaaaagttttactttgatgggcattttgaatttcagcnccccccagatagacggtaaattataattaaaaatgctgtaccccacttatttaataaaattggccccccccccctattttgttgactatgaaaaagttaaaagtttatgttaatttttagggtctgaaaaaaaatttcatgtgtattccaggggtattcaaatgctatgtctttaaactttattttcaaaagcttaaggcccaaaaccaaacttttttggaata

SEQ ID NO: 718265 - DNA, 554 bp, Homo sapiens
atatagtattctttggctgtaaatccagtcttctagtgtctgcatactcgaatgagggcatggaaaggtaaggccagaaagaacaggtcagtcggcgttctgtaagtactgtaaggatactgctcaccttgtagcgaggaatgctatccttgtgcagctcctcttccccatattcaagaacctggggagagcaggatgagaggtgagtgataatctcattgattggtataaagaccctacctcgtgccctatgtaggtctcagtcttggatccggcgattattgaagtagatcctagacactaaggacctgctgaagcttatgatacggtgtttgctggattcctaaaagtggtatagcctggtcaaaaaccttcagtaggtctaataatccaaggtcaccctgcttgtacagtggcagagtagagcaatcccatctaaacttgtagccactaaactgtactgctatacatccagggtgtgtgcggaagttgtgttgcattgagttaggtcgacacacgatcatgatccaccagtctaggtggctcccaggacg

SEQ ID NO: 718266 - DNA, 166 bp, Homo sapiens
tttcttaggctcgagtgcatgctgagatcgtgttaagcaggagcgtggtaatttttaaaattttttgtagagatggaatctcgctatgtttgcccaggctggtcttgaactcctggcctcagatgatccgtcctaccttggtctcccacgagtgccagcaattaca

SEQ ID NO: 718267 - DNA, 139 bp, Homo sapiens
acccgtgtagtagtacaatgatggtaaaagtgtagcttactggttgtctccgattcaggttagaatgaggaggtcttgcggctaggagtaaataaagtgatatggtatagttggggctgaaatattatagctttgttgt

SEQ ID NO: 718268 - DNA, 911 bp, Homo sapiens
taagcgccatctgctcggggagccgcctctggtctcctcccgagtgtgtgccgatgccgccctgaattcatggccgtgggacagttcacggccgcctgtggctccccatacatagtctcgccggttaaagaaaccagggctatagaagaccgtgtcttcacagtcgttatcgagaagggaatgcaacactcgtgggtctagggtccaaatctattctcgtgcgtgtgaaggaggacacctcatacagggagatctacatgtgattaccatgttctgtgggccttgcaggggagaaatattgggagttcattacaacatgtggcagactttgacaagacaagaacagtcgtgaattggatcaagattgggcatgagtgtgtgaaaaagtagaagaagaggaacagtggtgtacatgagaaaaacaaaaatccaacagtcgaacgtcaggctacaccatgttcaagactagatgacaaacactccatcgagaattcctattgccagcacctttacgaaaaaaagaccttgaacatggccgtgggtacgacacacacccaacgaggggattacattggaaaacgcacgtcgcctaaggagataaatacaaaaagacagaagttgacagggcactctaaagaaagacagctggtaatgttaataatggtggtggcaacactgatatagtgaaagggcaaaaacaagtttcttattggaaagggaaaaggtaatacaaggagagttcttgtgaagaagagggaaatgttatagctttggttacattctaataaagaacctctttattggtgggaatagagcggaattggagaaaataattcagaatgcaaattttaattgaaaccataaagagggaaaaaatgacagtgtagaagtgggaaacacacagggatgaa

SEQ ID NO: 718269 - DNA, 207 bp, Homo sapiens
agctgttctagaggagtccctgaacacagtgcatgtatgaacaacagtgcaggttaacaacagtgcaggtataacaacagtgcaggtataacaacagtgcaggtataacaacagtgcaggtataacaacagtgcaggtatgaacaacagtgcaagtatgaacaacagtgcaggtatgaaccacagtgcaagtatgaacaacagtgca

SEQ ID NO: 718270 - DNA, 586 bp, Homo sapiens
gcacttgtgatagagtgtggcacatcaaatatgtttggctggaataactgaacatctcccagaaggaatatctgaagtgccatagggttacagatagcctgttcctcagcttaaagtcgtaaaacttaggtatgaatttcttatttatacataaatttttaggtccatgaggagtttgatgtgaaatatgtgaagtagctttcttccctttctaatcaggaagccagttgtctccattccttctaaactcttccccactggatttgaaatgttagcttttacataaactatattcccacaagtgtatgtgtcttcgattaattttttaggtgggagaacaaattcctgcttatcaatgactgcagcttgggtggtcaatactctttgaaaagttgtacggggtgggggagacattttgggtgggaaagtgctggtgttccctgttgtctagcatgtggaggggaggtgaaagtgtgtacatactgcctgttttgagggaggaagagtagagtatgtgccacatagaggagcaggcgaatgcctagaagctcagggaggagcacagctacgtccagctgagagcact

SEQ ID NO: 718271 - DNA, 326 bp, Homo sapiens
ttctgtatggctttgccaggtggcccttttttgggccccggctttgatccttttctttcccttctctgcagggctggtccaccggccgaattgcccacattccggtgtactttgtcaatgcccagtttccacgtttttgccccgtgcttgggcgggccccggaaccccctggtgggggtgggggcttttttcatggcctgcccctctttaatgggacatccccaacctttgccccttggggcccttttccagggcccccacctggtctgccccactccccacctttccccctttaaggataaataagttttccttttgttttccca

SEQ ID NO: 718272 - DNA, 120 bp, Homo sapiens
  misc_feature (61)..(61): n is a, c, g, or t
  misc_feature (65)..(65): n is a, c, g, or t
  misc_feature (84)..(84): n is a, c, g, or t
cacgagggcgcgtggttcccagcgacctgtatcccctcgcgctcgggttcctgcgcgatancctngtctaaaatgtggacatcntgttcgtcaaagggagaggagctacacagtaggatg

SEQ ID NO: 718273 - DNA, 386 bp, Homo sapiens
gcggccgctactactactactactactaaattcgcggccgctcgacgaaaataagaatttttaaaatcagtggtttaagctaccagtttaagaagctaggaaagggccaggtgtggtgtctcccacctgtggtctcagcactttgggaggtcaaggcgggcggattacctgaggtcgggagttcgagaccagcctggccggcatggtgaaacccatctctacaaaaatgcaagaattggccgggtatgatggcgggtgcctgtagtcccagctactcgggaggctgaggcgggagaaacgcttgaacccgggatgcggaggttgcagtgagccgagatcgcaccattgaactccagcgtgggcgacagaacaagactccgtctcac

SEQ ID NO: 718274 - DNA, 235 bp, Homo sapiens
ggagctcggtaccatgcaagcttggtcttgattggcagtacgaatcactagacgtgaaagcggggcctcgcgagccttctgaccttatgggtaatacgcaggaggtgtcacgaaaagtcaccacacggtgatagaccggctgtgtgcggccaagcgtgcagtagcgacgtctgcttatagatccttcggtgtcgggtcttcctatcattgtgaagcagaattcaccaagcttgca

SEQ ID NO: 718275 - DNA, 540 bp, Homo sapiens
  misc_feature (79)..(79): n is a, c, g, or t
agataatgcaatgtaagtgtttgctactaaaaattattattcaagcacacaggataatgaaaattgcttgtacttgaanagtcgagtcaggaagaaaactgtgtaggcagttcttcaagggagaaagaaagggacaagataaaatgataactaaaaattggacataagagagacagtgtccaggaaagtacatttgcattaaaaagtgcaacggacagaaagattagcaacacattcatgaagtggacataaaacaaggcaagtggcaggcatcctaccaaggaacaaacagagaactaaagcagttcagcacagtatgctggaaagaagaaataccgaaagggactgagcagtgaatggcgaacagaaggaggtgcctgacagcaagatcttagtgaatacacaggagtgacacacagtgtatgggtggttaacaatgtgctcttccaaggcagaaaaagaaaaacaacagaataaagggaaaaggcatttaaaatttaccttaggatgggaaaagtcatgcgaggaaaaaaacctaaa

SEQ ID NO: 718276 - DNA, 211 bp, Homo sapiens
cgaagagatgcctgcgacttggaccgcgcgcctcccggacgggcccagccaccctgcgcccgcagtcccgctctcacctgccacggagtcggcgttgtccatcctgccgtcccgccgcgaactcacgcgccggctggcgcacgcggcggacagccggagggatgcgcggcaggcaggggcggttcagcctctgcccctccgaggccgcacc

SEQ ID NO: 718277 - DNA, 342 bp, Homo sapiens
gaccacactgaaggtatttgttaatgagggatccagaagcgttaaaagtagcaccaccaaaagccgggtgtggtggctcacgcctgtaatcccggcattttgggaggccgaggtgggcagatcacgaggtcaggagatcgagaccatcctggctaacacggtgaagccccgtctctactagaaatacaaaaaattggccgggtgcggtggtgggcaccagtggtcccagctactgggaggctgaggcgggagaatggcgtgacgcgggaggcgaacgttgcagtgagctgatatcatgccactgcactccagcctgggcaacagtgtgagactccatctcag

SEQ ID NO: 718278 - DNA, 104 bp, Homo sapiens
gctgcggcgtgtactcaatgtagggcgagacagcgacgggacaggggcggctgggatcaccacgctggcctgcacgatggctggtgggtagatgtagtgcgggg

SEQ ID NO: 718279 - DNA, 308 bp, Homo sapiens
gggggggggggggcccccctttttttaaacccccccccccccccccccggggagtttttttttaaggggggccgggggttttctccccccccttgggggggggaaaaccccccccaaggcccccctctttttaaagggcgcccggtgcgggggggggtttttttttaaaatctttccgttttaaaggggggggtggggtgggacaaaccaataaagctccaaactccccaccaagacaaaaaataggctttataaaaaaaaaagatcccgttaaaaagccagaaaaaaaaaagatatcaaaacaaaaa

SEQ ID NO: 718280 - DNA, 1533 bp, Homo sapiens
tccgattaacaaaaacaggtcccctctaaaagggatatatagaagcaccgccaggcccttggagtttaaagctgggggctcgtaagtggtgcctgggcgagcagtttgtggtgtggtattaacactggtgggagtgttaagggctaaaggctataaggggggttatctaatatccccgagttggggtgtcttaagctatagggtggtgtgtccaatattatgtgttaaaacgcccatctttctcggtgatgtctatattttgggtgcgtcaactgggagagtgttttatatcacaaaccctccagggtggatgtttataccctcttatatggggggagaaggggggtggactcttaaaaacacacctctttataccgccggggggtccctatttgagaacatggggggtgtaaacactcgtgtgtgtgaagaccgcgcgggtggggcgtgagcgcccacggaaaatatgtggcacccaaaaccctcgggggggtggttctaatgtatataaagccgtataaggttaaaacacttttcgcgcgtgttaatgtggcgtaaaagaggggtgtaactcacacgcgggcgtgggttcccccgcggggggggggtgtgggcacaagaggaataaaggcgcggttgtgagagagccgtgacattgtgggcgtgagcgagtgccctgtgaaagtgcgcgtgggggtcccccttgtgagaaaccgggggggagaacataaaaagagggggggggacaccctcaccggtgggcagaccgggggggaaaatgtggcgtggcgccaattgggcgtgataacaactcttaaaccaactaaagggcgaccactccaaaaggtgcccggagggggcgcggaggaaacaacacaaggagggcggaaaccgtgaacacggggggggcccaagtggggggtcaaaaaacgcgcggggtgtcccctgggaacccccaaggctttttttcttgtgttcaccccacaagggctgcggaaacacttcgggcggcggggtcctcccccttaataaggggaggccggaataaaaaattggcgaaataaagcccgggttaaaccctgctagatatctgtcgctgatgtcaagcaaaaaaacggaagtaaaccacccgaccgacaccacaacagcagaacccataaaacaacaagagcaacacacaacacaaagacgacaacaaacaacacaaaaccagacagacaaacgcaaagacaaaagaagacacaaccaaacaaaaaaaacacacacggacgagacacacaccaccatttcgagaaaacaaaacacgcggtgacgagacaacaccagatctaacagagggtgcacaagaaaacaatcctagtaagccacaacacaaagcgacaaaagagacaacaacaacaaaccaagggccagacgacgccaaaaacaggagagaaagaccaacaagcaaagcaaggcaacaaaacacggagcaaggaacaaagcacgaccaaaaaagaagaacacgcaaaacgaacaaaaagaaaagcagga

SEQ ID NO: 718281 - DNA, 480 bp, Homo sapiens
  misc_feature (6)..(6): n is a, c, g, or t
  misc_feature (13)..(13): n is a, c, g, or t
  misc_feature (29)..(29): n is a, c, g, or t
caatcngataggnccgcgcgccattgtgntgataccccggaattcgttcattatggccggcgatcaacacctgactgaagctacgccagccagaacctcttctctgagaactggaaatttgcaaagggaggcgttgcttgagcccaaggtaaccctctcgccactttaacacacgaacccaggagccttccataggcctacgtgccctaccggcgctcagcgccccagcctacgccgactgccaacgcgcacgaacgacgcacagcaccaccctgcagccccgcgacccagccggtcacagacgcccactgcctgcacccccagcaccccgccacgccaacgcctcccgcaccccccggagaaccacgccccccccctcccgccctctcaacaccctcgactctccactctcccctctcccctcacaccccgctatccgcccgcccccgcccacccgcccgacccccgcgcccccccccg

SEQ ID NO: 718282 - DNA, 829 bp, Homo sapiens
aaaatttcccggcaaattgggccgcttgaaaaagcacggaaccaccggggtcgaaaaccgggcatgagaaacagttgtgcgccaagaaaagcgtggccgaaccagaaaccgcaactgtccgcgaaatcagccccccaaaacgggcaaatatgtggtggttccacagaccaacaagacaaccaggggcgccgagtgtgtggccccacccccccgtgccggcccactctggggagacgcccgtctctcgcgagaaccataaaagtgctggatgctaagagttgtgttgcggacaccccgggcaaatctgtgaataagaaaacgcagcacgccggagggggaatagaaaccacccgactgcaggaaggcaacacgtgctcaacaaagcccggcaccccggggacgaaaagcagccgtttggcgcaatcgagagggggcatcgatcctgaaagattaaggggcaggcaagggccggggaccttctcgcaacaaagatggggaggatcagagagcacgatccccgggggtggctcggagcccacgtgaccccgcggaatgaaggttcgagatagccatagtcagtgagacaatgcagccaccagcacagcgcaagcgcgaaactaggcgggaaagagtacggagagtgagtccccaagggggcacacaaagatacaacagattttacagagcggagcaccccgatataagtgtgcttctcgcaaaggcaagtacttggcaggagaccacaccccgtaacacacaaaggtgcgcggcaaaaggaaagaaaaccatctggggtatgaaaaaaagcaaagaaggcgggcaacataac

SEQ ID NO: 718283 - DNA, 251 bp, Homo sapiens
gagctcggcaccccgtaagtaaattgttcccggttgttcaatcatttgataaccagagtcattctttgataaatgatcactatgagtcagactcaatagaatttgatcaatccttttttctgccgttaaggtggagaactgaaccaagaattctctttctttatcatcaatcgaatcactgttcgcgacccaggattctattttatcatcaatccaatcaccgctcacgttttttctttttcttatcaatg

SEQ ID NO: 718284 - DNA, 131 bp, Homo sapiens
  misc_feature (17)..(17): n is a, c, g, or t
  misc_feature (19)..(19): n is a, c, g, or t
  misc_feature (33)..(33): n is a, c, g, or t
  misc_feature (64)..(64): n is a, c, g, or t
  misc_feature (81)..(81): n is a, c, g, or t
  misc_feature (89)..(89): n is a, c, g, or t
  misc_feature (112)..(112): n is a, c, g, or t
  misc_feature (117)..(117): n is a, c, g, or t
  misc_feature (123)..(123): n is a, c, g, or t
ccagttttgggtttcantntactgacaaacctnagctggcatcatggaccatgaagaagcaagncgaaaatcatcacaggngggaaaancctgggattctttttctagggangtaanacatanatttacaa

SEQ ID NO: 718285 - DNA, 261 bp, Homo sapiens
tccgtaatatgtaaccatgatttataattatttaagttacttatgtacaataagacacacgaagtgctgtagggttttctggcatgagcccttggatgctgtgttttagcattcatgatcattctctgggccactttattcttacacagaccttttttttttttttttttttctagatgtttcaagtcctggggtgcctgtggacaacgcgcgggtcggtgacatatgtgacatctgagggggggtcgccgagctcgaatt

SEQ ID NO: 718286 - DNA, 204 bp, Homo sapiens
ccaaaaaaagggcccccccctttttggggggccccccccccggggggggggggggtttttttcccccccccccttttttggggaaaaaaaaaaaaacttttggggtttttgggggggggggggggtttaaaccccccgggttttttggggggggggtttttttggggggtttttaaaaaaaaatttttttccccccttttttta

SEQ ID NO: 718287 - DNA, 801 bp, Homo sapiens
ggtgcgtgccgcgttgctgttggctgcgaaccacatgtgtcctcggctgtttgggccctttttgtgccgccccctgttttattaacgtgtgcgccagtcccctgggttgtccccgcaagcggtgttctgtgccgcggatcgaccatctgggcccgattgggccatcatgacgcgccgggtgtgcccagcttaagtactggttaaaggctgcttttttcccgcattctctccgtgcttcgtgcgtggccttactcggaagcctgtgtggcatctgtcttgtctgcgtgtgcccccacacccttccgtgccccacgtgcacggttttgccaatcccttacccttggccgtctcccccacgtgaatgtcccataaccccgtcacaatcaacccagtatagcgtcccccagcacatcacacgctttcctcctatcttgcgcaacttacaccctaaatagccgtacactcaccatttgtccaagttcctcccgctccccctcaatcctctttttgcacctgtttagccacacatcgatattgggaacatcattcctcctctgctccctcacagatatgccccatttactctcctaagctttcatcgtgggaccgctttctgctatcccgtttacggtgacaacccaccggaaaagaatattcattcaacatagttcatagaacccctagattaaaagaaataaccaccattacaacaggaacaccactacaaaaaggataatacacaacaacaaaaaacaaacagacctaacaaaacaaaataagaaaatatagtatacataaaca

SEQ ID NO: 718288 - DNA, 505 bp, Homo sapiens
  misc_feature (347)..(347): n is a, c, g, or t
  misc_feature (389)..(389): n is a, c, g, or t
  misc_feature (453)..(453): n is a, c, g, or t
gcgtgctttttatgacacctacaaggtttgaagactttgatttcatattaaaaatctgggtttcaggctgggtgtggtgttgcacttctgtaatcccagcactttgggaggctaaggtgggtggatcacctgaggtcaggagttcgagaccagcctggccaacatggagaaaccccatctctactaaaaatacaaaattagctgggagtggtggcacatgtctgtaatcccagccactcgggaggctgaggcaggagaatcgctcgaacctgggaagcagcggttgcggtgagctgatattgccccactgcactccagcctggacaacaagggagaaactgtctcanaaaaataaataaataaataaaataatgtagatcttgaaaggnggtcggtttatgctggtgtatgtactttccaaagttagtaaacttacacttaaggttatatatnttggccaggcgcgggtggtcacgcctgtaatcccagcactgggaggcccgag

SEQ ID NO: 718289 - DNA, 359 bp, Homo sapiens
  misc_feature (259)..(259): n is a, c, g, or t
gtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccaganatttgagaccagcctggggcaacatagtcaaaaccctgtctctacaataaatactttccgtacattagtgggttgcctaaggcttggattggggggtgat

SEQ ID NO: 718290 - DNA, 364 bp, Homo sapiens
atattgttctaaaattaacggctgggttctttctccccttagcagagtcttctgaagagagagtctgatgataaaatagcagatcagagattctgaagtgggtgatttgtatccctgatatataacatcgagcctttatatcctacatactactgtaagaatgagaccttcatgaatgctttccttgttggtattcggcctaggataattggcgatcgaacatcacgacgagagtgaaagtgaaaaagatgaggacgttgaagaggacagatgaggactgccgaaggaaaagatgacagaaaatggcgacggacagagatacagcaagtgacaaagacattaaatggaaattcagcctttgcaa

SEQ ID NO: 718291 - DNA, 449 bp, Homo sapiens
  misc_feature (274)..(274): n is a, c, g, or t
  misc_feature (349)..(349): n is a, c, g, or t
  misc_feature (357)..(357): n is a, c, g, or t
  misc_feature (369)..(369): n is a, c, g, or t
  misc_feature (428)..(428): n is a, c, g, or t
  misc_feature (443)..(443): n is a, c, g, or t
gaagaaagatacacaatgcaaacagtaattgtaagaaatctggaggggctatatttaatatcagacaaaattgacgttaaaacaccaaaaagttactagagataaagagcaaaattttataatgataaaaggatcaatccataaggaggatatagaaattataaacacatatgcaccttaaccacagaccactaaaatacatgaagcaaaaaatggagaaacttgacagagaaatatacaattcaacattaatagttgggagacttccctactntctttaaatatggggtaggacattagggcggtgtactaatggtggtataggagacttggaaccaaagttttaccntttggacntattggaccttnttattcactccctttttattaccgccggttacacttttttttccaggctttttgggggncttttccccgggttncaccct

SEQ ID NO: 718292 - DNA, 148 bp, Homo sapiens
agtattttattgatggaggttcatcctgcagccacaggagaaaagagcctaagagtcaaagcccgagagccagctaggtcagggatggagcccagcaaaggcggggcagatgtgtgcatagggcactatggaggtcttggtaaagaca

SEQ ID NO: 718293 - DNA, 1046 bp, Homo sapiens
tggtgccttctattaatacatcattccagctcttgctggtacattttgtcacagtatagtgtatgcacattgctgtgctgcaaagcccaaacagctggcaaaatgttgacaacaatcatcgaaatgtatacacacaattgcagtatctttaacaatcagtacaacatggcactagcactattactttacctatggttcttcagcttaaccaactttgtgttctcctgctgggcagggagcggagtccttgtgctgctcacgcgcgcgcgcagcagggcaaggcaggcaagtccagtaacatcttgcagtaagccctcaaagattgcactttatctctctagcctgcaatgtgcgacgtcgcaacacatatcactttccagggctctggcaccacagttcagctcacaccttgcacgtacacatctcccagtgcaccattctcacaaaagcagtcagacttctactaactgggccaacgctaagcctgacagtgcaggaatacttggccaatcatacggaccaacagagaacaagctcagctcttaaacagcttgtcctgggcatctacctaatactggcacggcgggcagtgacacacctgtccactatcatctttgggcaccaaatccctttgcaacctggacctggtcaggcgagcccccgcaaacgaggtgctccatggacacttccaacggttcattgagcaccgaacaaattcttttaaacttactatacctctgacactctgtaacaagcaacatcctgctgacggccaaagcgactagagacgccagctggagctatttggactaggatctatcaaagccagttcccaggtaaaaccacccacaggtatgaggcacacggaacacccaacagatcgaaagcctgagaacgcaacagggaaaaacagaaaccgagcgcaacaccgcagcagcgggcgccaccaaggtcaaccaccacagagtgcgcgaactggaagaactcacacccaaacaggaaaccacaccaaactgtcacggcgcacaagccagggccgaccacaa

SEQ ID NO: 718294 - DNA, 369 bp, Homo sapiens
ttctcttaaaaaaaaaggggggggaaggttaacccccagcccccctttccaaaatttttccccgggttttcgcagaaacccccccccaaaaacccctttttaaaaaggggggttttttttttttaaaagtgagccccccccaacccggggccaatttttttttttttttttttttcccccgcccccccttaaagccccccaaaattttttattggggggcccggttttttttttttaagggggggaaactttaatccccccccccgtttttttggtttttttttttttcccccccatttaatttgggaaattttccccctttttatatttttcccccatttttcctttcaattaaagggccctggggga

SEQ ID NO: 718295 - DNA, 435 bp, Homo sapiens
tgacggtgaacaagactttggcacagtattaatcgatttgggtggtggtcagacaacaacgtctatcattcatgatcggaaacttaagtttaatacagttgatttggaaggtggcgacaacgtcaccaaggatatttcgactgttttgggcacatcatatgcaaatgctgaacgtattaagcgcgattatgggtttactgacccaactcaaacgcgtgatgaccaaacattcttgatcgatgtggttggtgaaagtcaaccacaaacattctctgaaaagtatttgtcagaaattattgcagcccgtttagaccaattttcacacgtgcctttgaaccattacaggccgttaacgactgaatatgccaggtggttttgcttaaccggtgtaatgcgactccctgaatggttgactttcgaaaccattcttggtag

SEQ ID NO: 718296 - DNA, 457 bp, Homo sapiens
tctacgaggatctcgacatttccacgagtcactccctagagttagcaaagtatgcaattactagaattattagtcccaatttacataagatcacactgctggcactatactccagttccagactcttttttccactattgaatgccacagaaacataaaaaaaaaaaaaatggaaggatctttaaaaaccatgtagctggattttttttaagatgatgaaaactgaggcccatgaagagagtcacattagctcagggctcctactaaagccaaataatttcgtgcaaaatcatctccctctgattatcattatctacacacacaaatacataatttttcttttggcctttctgaaaatcgggaggtctgaaaagactttaagatttctctcaagttaaaaatacacgttggtacgtgtaaccagagggcaagttttctatggtccacatgttttctt

SEQ ID NO: 718297 - DNA, 761 bp, Homo sapiens
gtggaggtggaggccgtctgtgcgtggcgcgggcgaggtggaggcccaggactctgtaccctgcccctgtccttcagcaaggcccccggcagcgccggccactacgaactgccgtgggttgaaaaatataggccagtaaagctgaatgaaattgtcgggaatgaagacaccgtgaggcaggctagaggtctttgcaagggaaggaaatgtgcccaacatcatcattgcgggccctccaggaaccggcaatgaccacaatgcattctgtgcttgtgtccctgggcccctgctgggcccacgtcactcataagatgccatgttgtgatactcgaatgtcttcaataatgacaggggcattgacagtttgtgacggaataagaattaaaatgtttggctcaaacaaaaagtcactcttcccagagatggccgacatagatcatcattctggtatgaagcatgacagcgatgtaccgacggagcccagcaagccttgaggagtaaccatggtaaatctatctctaataaccactcgcttcgcccttgcttgtaatgcttcggataagatcatcgagcccattcagtcccgcttgtgcagtcctcccggtacacaaagctgaccgagcccagatactcaccaggctgatgaatgttatcgagaaggagagcggtaccctacactgatgacggctagaagccatcatctttcacgggccgggagacatgaggcaggcgctgaaacaacctgagtcaccttctcagga

SEQ ID NO: 718298 - DNA, 584 bp, Homo sapiens
caaaattggaataatttttatcaaatacaaatgaaatgctacatgaattctgatacagtgtttttctccccaattcactgaactaaagcgaggcctttattggagcactactagtagcatagcaaacatgcatgcattattgtactggtgaactagctactgcttgctttcttcctgctgagaagaacaacccaacaactcgcgactcgtgactcgtgacaggcagatacacacaaaacacgtggctctagtcctgtaatccactgagcactgatggacaaggatcacagcatgagcgcccacttctgggtgggagtgggactcccagtggcgggcttcgacacgacgacctggccgctacccgcagacgatggcctgacgacgtccaagaccatcccggtgccggtgttgaagatggtgccgtcgttgcggaacacccagcgctcgcaagccgatccagcccagtcgcagtatttcaccctcacacgcccgctggcatcagcggccaggcactgccactgaaggagcagccacgcgggcgggcggatggagccgtcggggtagaccgaccactgcacgccgtc

SEQ ID NO: 718299 - DNA, 1350 bp, Homo sapiens
  misc_feature (514)..(514): n is a, c, g, or t
  misc_feature (536)..(536): n is a, c, g, or t
  misc_feature (538)..(538): n is a, c, g, or t
  misc_feature (550)..(553): n is a, c, g, or t
taccggttttggtatataaaattcatgtttccaatctctctctccctgatcggtgacagtcactagcttatcttgaacagatatttaatttggctaacactcagctctgccctccccgatcccctggctccccagcacacattcctttgaaataaggtttcaatatacatctacatactatatatatattggcaacttgtatcgtgtgtatattttttcttttattttggacaggtatataggggatcctgataaaatagacttggcatattcggttttaatatagtgtaaaaacaaaaggagaaaaatatagagaattctacatactaaatctctctcctttttaattttaatatggttatcatttatttatggtgctagtgtttatccgtaataattgtggggaaaagatatttaacatcacgtctttgtctctagtgcagtttttcgagatattccgtagtacatatttatttttaaacaacgacaaagaaatacagatatatcttaaaanaaaaaaagctttggtataacanantttaattctgannnnaaacaaaaaaacaaaaaaaaaaaaaacaaaaaaaaaaaaaaaaaacaacaaaaaaacacaaaacacacacacaacacacaagcaagggggcgcggcgccgcgcgacgagagagatagttttatcttatataagggaggagcgcacagcaagcagttcatggtacacaaacaagaagaggagtcttgtgtatatgaggagggggcggccttctttgttgggcggagtccctattatattctaggggagaagaagagggtggtcggctatattcaaacacgagaggggcgaacgaggggaggagaaaagcgggcgattaaagagggaagacaaactacgggcagaaggagcggacaacatcatcaaacgccgcggggaagggagaagacacagcgagagggaagacaacagacaacaggaaccagcaacggacagatacagaaacaaaacgaagagagcgaacgaacacaaaaaagaaaatgaagagagcaagaacgagcaacgagacagggaggtgaacacaacaacagacacaaaaagatagcagcagacgcggagaccaggcgagaactcagagtgctgagagcaagcaacgcgaacagacctacaattctaaccacaggaagagaaccaactataattaaaaacaacacccgcggaagcctactacaccaaacagcacacgcaacccaccaccaaacaacagtaagcaccccacacaaccaccaacgccgcaacaccacaacccacgccaacaccaacccccaccagcacacaccacacccgaccgccgaccagg

SEQ ID NO: 718300 - DNA, 485 bp, Homo sapiens
tgatctagaggaccccgtctgagaagctgggagctgaggtgggaggattgttgagcccaggaggttagggctgcagtgagtagtgatcatgcgactgcactccagcctggggtgaccctgtctcaaaaaaaaaaaaagcaaaagagccagcaggaaagacctggtgtccaaagcccctttgggaaaaagggcagaaaagagacagggggtttatgagacacatgattaaccgtagaagctgtgggtctcctggggttggtggagcccacgggttattggtgcttgggtagaaggcgtgtccctgtagctcttggtgcctggtagattcccggagggtttctctcatgtcccagggcggatgagtggggggtagcctcttggtctggccttttctctttcctctttattttcaaacagtccctttggttacattctcctccagggcacagttctttcaattgcctggggcgtggaccatccctagg

SEQ ID NO: 718301 - DNA, 140 bp, Homo sapiens
gaaaaagtccaatcccaaagttggtttttgagtgcgtgtatgttacgtgtttttgttttggttttttttttattccttcctctatttttacctctgacatttactcctcctctgagcatcttcgacccgcagcttacctg

SEQ ID NO: 718302 - DNA, 379 bp, Homo sapiens
  misc_feature (63)..(63): n is a, c, g, or t
  misc_feature (93)..(93): n is a, c, g, or t
agttggtgactgttgtccctaatttgtgccctcattatctccattgtcagcaccccccccccnccccaaattcacaattatatcccaccaggnaccaatgtgacttccagaatggtttttgtccagcttggctctacttaatgtgttttacacagtctggttggcactaggtcatgttgctttctttaggtggtattttcactatcatccctttgttttatgaaaccccgtctctactaaaaatacaggtgggcgcctataatcccagctactcaggaggctgaggcagagaattgcttgaacccaggaggcggaggttgcagtgagccaagatcgcgccactgcactccagcctaggtgacagcgagactccgtctca

SEQ ID NO: 718303 - DNA, 515 bp, Homo sapiens
acaaggtctacttaatcttacttttttaaagcggtagtcgcagtccacttgcgattctgtagaaattttaatttttgggtgcactttcactttaaaagttattagtttaaaaggtaattacatttttatgacctttagggttggctaatgacaaaagcatgcaatcattatgacctaataagtacatttcttctgtattttctgcttgcttgattttcctttatggctatgcgctacatttgagctatatttcattccataaagagactgcttcatttgatagtcaaataactctgctgtagcctgtaaaaggaaccttaatggaattgttgatttctatggtggtcatagcaaagtaattttcagatttagttgctgttgtctgcgaagatgtatttaagcattattattattattattcattttgtgtcgcaaatgctgcgtaagaatattgatctaagaaaccctgcaccaaaaattcactgtagagattaattagccttttgctgctttta

SEQ ID NO: 718304 - DNA, 173 bp, Homo sapiens
tcccacacaggccaggcagagcgcacagacatcgcgacactgtcaaccagccatcacgactgctgacccggcactacctctgcgtgacaccagccctgcaggcactgcccaggcccggatccaagtggttgtcctaacagcctaagatgccagcccaccgccggacaagattg

SEQ ID NO: 718305 - DNA, 416 bp, Homo sapiens
caggtgctggcacatagatggtggcatggtagatagcgaaaggacaagggccctgggactggccgtgcctgggatctgctgcaggcagctgtgggatctgggacaagtggcttcatgtctctgtagccgcccttcttctggaaagtggaggtaaaactttattcaaaagactgtcacaggaactgaacatgtgaacctgtataaagtgccccgcacagtgcccagcatacaatgttcattaatgaacgtaagagtctctgttctttagagccgggtgtgatggcccacacctgtagtccaggctgctcagatggctggggcaggaggatcccttgaggcctggagttggagaccagcttgggcaacatagagagaccctatctctaaaaaaataaaataaaatattctctgcaaaa

SEQ ID NO: 718306 - DNA, 220 bp, Homo sapiens
ccacgatacaaccgaggaggaggatggacactggcaggcagaaggcaggggggaaaaaggaacgatagagagggacaaaagaaagggcggttagagagaaagaacggaaggggaagtttgtgtcggtgacgtaaaacagactatcaattctactttcagtctctgaatgttgggacatcataaatctatctagacttagtgatcttataaccattggccc

SEQ ID NO: 718307 - DNA, 852 bp, Homo sapiens
tctatcgttccctcccttaggagtatttttttcccccccacacatttttgggggagagaccctctggagtaaaaggggagcgccaccacaatatttttttttgtccccccactattttattctcccccaggggtgtcccacaaagggcacagaaagatattcctctctgagagaagagattataagggcgggttataattgtgtgtcccccccgcggcgctctccctctgtgggtgtcaacactcggccctctcttttggctagacacaccggggctttctctctgagagccccacacccgccccctctggggggcgcacaaacctctgcgcacactggcgcaccacagtatagggtctacacccacacaccacagtttgtgtgctcgagagaatatggcacccctcggtggagagaaccctctgcttgtgtgttggccacagcgcttttttggtgttcgaagtgtctcgtgaacaagggatatatgtgttcctcttagtctcttctcgagcgcaccctgttgtgagcccctctgttccacacgaagaaagggggcacagaagaaaaattaaatgtggcctcttgttccaaaaggtgcaatgccacgtttaaagtgaaagtggcacggaacacgggagacttgaaccacaagccctttggttctgtaagaccgcgtcctgaaatttttcacactaagaagcttcctcactcacggttaacccacagaaagtgggtgcccacatccacccactccacaggtgtgcttggaagttagttttccaaccccttcgaggtgtaccctgtgaaaaatttgggggcactgctttataaataaaatggaaaatattttta

SEQ ID NO: 718308 - DNA, 877 bp, Homo sapiens
ggccacatctgtcagagcctggagtctgcgaaggccgggacccggttccccggccacagtgggggtgtgcaagacccgagagaactgggaagtgccgtccagaagcgataactgactgactgtctaatgtctatctgaccgcagtcgctgcaaaccgtctacgacttagttgaccgtaactgccagagcgctgcccgtgaattcctgtccttactccctctttaagattgcgtaccctacatgcagagatgcgtgaagacggggtagccacgaggttgcaagaattcgtggaagaatcagcatcatgtcggcagctgagtattggaagccaggagcctgccatgaggtgtgagaacagagtgctgttgttacgagctggcagctagcatctcagctccaagagaaggttatattcccatgcaggtatgtctagtcccaaggaccagtagctgccatcagtttggattgctgaaagactaagctggctatcaacactgggtgtagaaacatgcttgccttatgtatcatgaggacatgctcagcagatcccaagagatatatttgggaacttctttctatgacaaggcacattgtggtatcattcattcacatttcttgagtttgattgggtagaagcgctgtgtgtccggagacagtctggctaggtttggcccgtggctgcggttgtgcgcccctcgctccacggtactgggatcgtgatgcacggccggctttgaggtcgctccccctgttattggggctgccggtctcagggctcgtcttaaatgtgtcgggggcggctcttatgtggccaggggtccaggccctggctcgaggcctccccatcaagggcgcattttcttgcttgctgcccggt

SEQ ID NO: 718309 - DNA, 440 bp, Homo sapiens
aggcagtgcaccttgattctgcatgttgatctagagtgatcccattcccatgcatcaactttacaaaaaataattgaatggagtgggagtgaagttggagtgaatgagaaaagagggaataagaagatggtcccctgaccctccagtggtgccaatcccagcctgcctgtgtgcatctactctgaaggtggtcacaaatcagaccaaacttgtgcatctcaccaactatgtgtgtggtgcaagctgttgcagtggaagcttgggagacaccatccaggccaggaaggtgctcctgtgtattccagtttaagcagacagaattcggggtggggtgagagaatcccgatttgtgataaaatgtgatcctaagtccttagttgcagcagtgagttggcttgtgaagtgtagcagggcccacatgcaaactccatagccttcct

SEQ ID NO: 718310 - DNA, 202 bp, Homo sapiens
tatttgtagtacagacagggtttcaccgcgttggccaggatagtctcgatctcttgaccttgtgatccacccgcctcggcctctaaaagtgctgggattacaggtgtgagccactatgcccagcctttttttttttttttttttaaatatcaatgcttcctgttttctcaggaattaaatatggttactttagggtcttgct

SEQ ID NO: 718311 - DNA, 109 bp, Homo sapiens
gctggaccacacgataaactgacctatacaagatgtaaagaattttaaatggagtgtctcgtaaacctgtgcacacattgtctcatcagcgatatgctgggtaccgagc

SEQ ID NO: 718312 - DNA, 101 bp, Homo sapiens
  misc_feature (26)..(26): n is a, c, g, or t
  misc_feature (50)..(50): n is a, c, g, or t
taaaatttgttgaaataatttgattntcttatttgaatcgtgtgaatatngaagaaaatatcatctttgacttaacatattttaactgagtatgtaatagg

SEQ ID NO: 718313 - DNA, 483 bp, Homo sapiens
gaagatcctaacagatctcttggggtcactagctgatggtctgggaatacttcttggggaaggggttctttattttaaatcatcttaaatttggcacaaatacagagcattacccatagccatggagcaaatccctcgctgtggccagtaactcatggctgcttagacgtagataggaccaggcccggggcagaaaccaacccaggcaggagcgctgttgaagagctcacacgataaacacagttgactcttttttttggagacagagtctcactctgtcctccaggggcgcgatctgggctcactgcaacctccgcctccgggttcatgcaattcccccacctcagcctccagaatcgctgagattacaggctggcaccaccacactcggcctttttggtgtttgggtattttaagcagagatggggtttcaccgtttgggccaagctggtctcaagctcctgacctcaaatgatctacccg

SEQ ID NO: 718314 - DNA, 332 bp, Homo sapiens
gccgaggtgtggggtgtgcgttgcccgccgcccttggtgtggtgggcgaggggcagaggagctgtgctacatgcccgtactgctggtggtattaggccgagagaggtccggtaaagagggtctctgcatccggggcagttctgggagtgaggcccggctgctgtctgtatcatcctgaggacgcccgctgacggtatgatactggaggccttggcggaagcagctcgagaactgggaatttgcagggttgggctaaccagctaaggtttctctgaaccaatccctttgggtccccacaggtcggaagttcaagcattccttctttgaaaaga

SEQ ID NO: 718315 - DNA, 891 bp, Homo sapiens
  misc_feature (891)..(891): n is a, c, g, or t
gagcggaggaggcggtggcagggggaggtggaggctgtggagcggcagcggcagcagcgggtcccgggactgaggcagcagcgggggcggcggcagggcggaagctgagagtgacgaaggcatgcggcggcggccggccgtttccctcacggtggcggtagaccaaggcggcggtcggcggacggggagcggcctggtgcccggctccccgtgctcgattggcatgtggcattgtggcgcgtgggggccggcccggtgtcccgcccccccggcgggtcccccttcgcggtcgtccctcgcgtaccgcgggagcacgcgcgcgggggcctggacgccggccgcgccgacgtcaggactggcttgacgtgctactgcccgacgcgccgagggggagtctggagagcgggtggcgcggtcgccatggggacggggctggtccttctggtgggggatgatggatgccggtaacttgtccccgtctgcatggtgcgcgctggcatccggggactgggcgatcttacgtaacgaaacggagcccttgtggtagagtggtattgtcccatggagataacctcttgtcaacgctcatcattcgtctaggcaaagccaacttggcaagaagtgagagatcacagcagtccgcgttaaaggcgggggattggtatcgggtcgctagctgagcatttgcgagattgacctactagattgaagggcacgaactcgcccggaccggggggattcaagggcctggaagggttccaatgtccttcaaggcctacggctgacctgcgggttgtgaacatatattgtcaccgaagcaaagaagtcgtccagaagccagccttgcagggactaccaaggtgtaaagcggactaggtagattcccctccn

SEQ ID NO: 718316 - DNA, 277 bp, Homo sapiens
acgtgtgcccgtgcgctgcttgagagacaatgacatggatgccccggccctgtctcccggcgcctcatcctccagcaccgctggtgccatccactgaccacatatactttggctgcgacttgatatacacctactacgtccagcgacccgccggggtaccactgacctctgcgcccgtgcgggctccagagcggtcctacggcgctcatcatacgtcttggctctggtctctgtggtcttcattcggctccactggatcgctcaccggcaattcaat

SEQ ID NO: 718317 - DNA, 777 bp, Homo sapiens
gttaagtgaaataagccaggcactgaaaggcaagcttcacatgttctcacttatttgtggaactaaaaattaaagcaattgaacccatggaggtagagtagaatgatggttaccagaggctgggaagggtggtggagtggtggtaaggggaagtggagatggttaatggctacaaaaaaatagaaagaatgaataagatttagtatttgatagcacagcagggtgactgtagtcaataataatgtaattgtacatttaaaaataattaaatgaatataattgaattgtttgtaacatagaataaatgcttgagggagatggtcacttcatttaccctgatgtgatcattacacattgtatgtctgtatcgaagtatcttctacacctcataaatatgtgcacctaccatgtacccacaaaaatttaaaatttaataaatagcaagtgtatatctatatactagaatacttggttaccaaaatcaaaaataaacatatatgtaaggttgctcaaaaaaataatacaggtgtcaatctaacaaagcatatattggatcttatatactggtaaactataaaatgctaatgaaagaggtcaaagaagttccttataaatggagagatattacttaaacatgtacatgaatttttcatacgtaaaattgtccaacatagccaaaaatagaaatgatccagatgtcttgagtggtaagacaggtgtgtgataccttcatttcatggatactaatcagcactagaagaaatggatcatgaaatc

SEQ ID NO: 718318 - DNA, 1008 bp, Homo sapiens
cgtatcctgaaaagtggagggcttgaagggctctcatcgctgatcagtacagtggggctcaggtccgggtgctctccgctccatccaacttccattatggtcaaatcaagcgaaccccatgcaatttactccgaagaattttccttggcggtaatggtcccatgcagttgtagaggggtgacttgagtggattcgtcgtgtgttgtgagaggcgagacagcacagtgtgccgtactatgttagccaatgaggagctgcgtgggaagtagtccgagaggtcgacgtacggccagagtggtgcaatggggtgacgcgttctgggtgattccgataatatgatgtgcctcatggcaagtagcctggtgatgtctcctccaccgttgggcatcaatgcaccacaaaacaaaacaggtcaacatgaagaaaatgcttaaaggaagtgaccggtgaggctcaaattcctgggggctgctggatgcttacgttgaaacgaagaggactatttacttggtgagtagagaagcgagttgaccatatggcatgacaatccacagttccgttgtgtaaacccttgtattgttggctctataacgcaagtgtgtctaaaaaagccttcatttcccggacaggcctgtgtccgcaaactaaatcagagacggatggggtttcactcatcgtggtataacacccattgtcatcgaggttttcccgggggctggtcatttgggtgcgacagtgtagagacatgtgtggagaacagatatggtcccacagattttgaattggcgagacaacactagtttgcatggagatcccaaactttagaatagtggcatcagcaagagaaacagacgaaggcggtcacgtggaaagaagatgcagacatgccgtagggcctgagccggaacgaggtggaaacaagggggggagcctacgcctgaggaggatcacggttcaaatgtgagccgggcgcggaggtgggccaaggaaggcacttgtacaggcaaa

SEQ ID NO: 718319 - DNA, 366 bp, Homo sapiens
catgagtgactgcacagattttggaggctgaagcgggtggatcgtttgagtgccaggagttcaggaccatgcctggcaacatagtgaaaccccattagccaggcatggtgatgcacgcctgtaattctagctccttggagggctgagaatcgcttggacccagtgaggcggaggttgcagtgagccaagatcacactgctgcactcctccagcctaggtgacagagtgagacggtctcaaaaaaaaaaaaaaaaaaaaaaaaggtttttggattccccttttaaacccaaagaaggcggggggggggttgcgcaaccaaaggcaggcgttttggcccccaaagggttttaaagaaatgggggggcg

SEQ ID NO: 718320 - DNA, 1815 bp, Homo sapiens
cacatgcaatgatatgtgcgtctcgtatccagtgaattcccatgacatccaatgagatgcgcccatcgaatgaagaacgactgcgtgctgctctctcaggggtgcatgatatttacacttacgaccaaagttatactgtgcatgctctgcgtgcctgcacaggtgcgcacgctgggttgatcaagtacatctacgaacatgcgaataaggtacaggcactagtctgttgtccacctcgtcttgtgctaaggtgatccacgactccgcgacagaggagaacattccctgcacattacctcccaagcacctctgtgtagcctgtgtagtgactcactaggtagtttctctctcgtcacatttatctgactactgagctgcgacgcacgctgaatttgtcccgaaggtctccaaggaactattaaccttaccatggggatcttcgatgcgtccgttcccatgtgagggggccatgtgacatataagtagtcaagtgctagcgctctgggggcgggcaaacgattcgacacgagttgatagcgtaatccatcactcaacgtggatgtctgggatattaaccattcctattgccaacgacgtcgcgcattgttgaccacacgttgtgcatatttccatgtgccccatttatacgcacaacgcatgtgtatgtcgtatcgcgtgtacgcattcctagaggaagcaacgaatggaaagacgcgcggtgagaggcccgcggaaaaggaccgcgaacgtaactaggatctgtgtaaattcataggggccatgaatactatgttcttggcggtagccacactggggtgccttgaacagcggctgcccctaagaattttccttattgaccggtttgggggaaggagaccttcacaacttgcagggtgccaccactctttggacaaggtcaaacagaggttcgaggagtcagaacattaatctcttgcgcaaaggccaaatgcggggtccctctttgaaaatgcctctcaaaactgcccctatcgccacgtggttcggcaacagatccgaccaaaaccaactgaggtataagaggttcgcgtccaaagttacttcggtttaacacattaaattccagggtggggatttgcctaaggagatgccagggcgacacgtttttacccactcctgtttgcgaaacacaggtttacgggcacaccatggtgacacattaaggaggcacacacaagccaaaccacacatgggcgctgttgcgcattgatctcacccctctgggggggagaaattcacgcccacagaaggggtatgctcttccccaacagatgtcttctgggcccacgaatctgtcaaattgtttgcccccccagatggaaatgggcaaggtggccctaggagagaaatagtgcattcgacatcttggtgcccaggagcacaacttttggcccaccgagacaccgcagatggggtctagcgcacccggaaagcggaatagtggcgctataagacaatactcgacgagagggtcatagagaaccagcacaaatagagcccaaagcgagtcacgaccaggtggggggcgcgtaccctatgtgagaaccacgctgatacacaacaacgcgcgtgataacacagaccaaccacaacgacgggtcaagcaatgcagcatccaggcgccggcacagtggagaactcgcgaccaagagtacgctgcaccacagacaacagaaaggaccacataacagacacagcggaaagtagacaggcgcacaccacagcagaagagcacgagaccacaaccagaggccaccacagcccacgcgcgcgcac

SEQ ID NO: 718321 - DNA, 569 bp, Homo sapiens
ggattatccccttcgacggtgttctgatacaaatatcatacaagtcaggttagattacgaacaaattatcagccttggactatagatatttaactctgaatctcaacctttctgtaacacagtcaaagctctttgcagtctgaaaatggtgctaactaactaatgatatgtcatctgaatcgttttgtttttgtttttttttcacaaggcacgtagacaaagatattctctgttgtactaggccagtggccaagtaaagatcctgatgtaaagtagtgctattcccatctactacctgtgtttaatcatctgaggcaaatacttgaaatgttgaaaagacccaaatatggtcataaatacgtgacttgcaaaaaatgtcaagacagcaaatgaatccatctttctgagtactatgtgctcagcattgtgtaagacactacaattataggaaacataactttaaagctgacattgaactgactgctacctcagggtttagaatcattttgaaaaacaaatttaggccaggcgcggtggctcacgcctgtaatcacagaacaccgtcgaag

SEQ ID NO: 718322 - DNA, 599 bp, Homo sapiens
  misc_feature (419)..(419): n is a, c, g, or t
taaaaaaggggatcttgctccttgggccgggggggtcccaaaccccgggccggaagggacccttctggcctggtgccccccaaaatggcgagaaattggtgagggcttgagaccccgccatggcttaccccagttgggtgcttttgtggtgtacttcccacgtgttttcacaaaagaaacaaaaatttaaattgtggagtgagaatgccacaattatatttaaatttttaaaaaataagagggggattttttgtggcgcaggtcttaaaaaactttgtgtggtcttagtctccatgagggcccataattctctctccttgtgtggtttctctctctctataaatgtgtttttattatattttatacacgatgtgtgtataacgcgtgttataatatattatatgtgtatctctatattntatatacatgtgttctctcttctctcagcgtgtgtgtgcagggtgttttatagtgtgtattgtgtgtgtgtgtggtgtgtgtgtaatagagagagccacactatatgtgtgagtgtgtaggtgtgtctctatatgtgtgtgtctctccccacgcccccctcttgtgtgtgtgtgtgtgac

SEQ ID NO: 718323 - DNA, 220 bp, Homo sapiens
gtcccatgcatacgatgttcatgtccctgttgcacattgggctgactgtgcttgcggactgtgaagtgggaaatatctgaatgaacacttctgtatttacagaaaatgataacgatgacgatgaagatgttcaagttgaggtggctgagaaagtgcagaaatcgtcttcccccaggtaacactgaatactcaggaacaattaatggatgggcccgacctt

SEQ ID NO: 718324 - DNA, 903 bp, Homo sapiens
  misc_feature (900)..(901): n is a, c, g, or t
  misc_feature (903)..(903): n is a, c, g, or t
cgtggtggctcacgcctgtaatcccagcacttgggaggccaggggggtggatgacgaggtcaggagatcgagatcatcctggctaacacggtgaaaccccgtcgctactaaaaatacaaaaaaattagccgggcgtggtggcccggcaccctgtagtccaagctactcgggaggctgagatcacaggcaagcaccaccaaccagctaagttgtatttaaatatatgtccatttttataacacacgtgattgagaacacaggattaaaagtcaattagcagaaccaacattaatttcttagtttggtcactgatggcagttcttcatatggttaccattagggaaagcaagggtgaaggtgtttattaaaaaatgtggtacactatctgtgtaaactttttctgtaagcctaaaattatctcaaaataaaaaatttgtggcggaggaggtggtcagctgtaaatccagcacttgtggaggcgagggaggggatcacgaggtcaggagatcgagacatctggtaacaggtgaaacctgttcattaaaatacaaaaagagtctcagaataagagaatagtcgtaaaaccttcagaattattattctagcttaggtgtggattgttgtgtaattttaggaatgacagtcatttatataatgctttctagtagggtaagttctggatatgcgtttacatttagccttcttagaaggtgggggtatatttccccaaaggtagggttgatttcgaaataatgtcttttcctgtggaggtggtctggtgggagatggacaaattgttaacgggttcataaatttgtgggtgggttataccgtgtgggagtgtgcaggttgtgtgtgttaaaaaagcggggtgggtgggtttgtgtgatttatagtttnngn

SEQ ID NO: 718325 - DNA, 137 bp, Homo sapiens
cttatggaatcctcctcctccttattgagatcagcagcactgcctttctgaatcctattatccacaaacatcacggcataattgacggcagggccctggaggaatgccgcgacttccttaaagaactgtgatccact

SEQ ID NO: 718326 - DNA, 345 bp, Homo sapiens
ttctctaaaggtaatatggaaaccaccttatccaccacgcattataagaaaagcactcgcgttctgcacaaaattctgcctataaggaacgtgtgtataaataccagttcttatataagtgctaatagtcacacgtttaatttggtaaccaccaccaccccgaggcatttccaccattaaccagaattacacaatttgaatgtgaaaatccataggacctatgtttcttggctcaataatttttaagtcctagtctcacaaggatctaatgtgtagtaattacatatgctccacatatggcgaccttcacagtgtagtcagcaacacagtatgtgcctcgtgccg

SEQ ID NO: 718327 - DNA, 534 bp, Homo sapiens
gcgtgctggtgactctagcaggatccttcaggagagagaactggagagtgcggagactgtggtgcagattgggcggctgctcccttgctcctgtgttggcgtgcgggtagctgagtcctcagcgggtggtcttggtggaactggtcgcgggaagagattaactttgcaatcctggacctcttccacaatggtacgcacctgacgggtggtcaccggttctttcttgtactgagtcaggtgggcatcctctccctccagcaggcggcggtaggtgggcaatctcctgctccagcccgcgtcttcacatcctagcaggatattgtatacctggttctggtggtccatcttggcagcgaagttgggccagctggtcctccacgctgccaatcatgccctggatctgggaaaggttgacgcagtagcggttctctgtctccgccaggttggcctcccagggaatgcttccatgctgagctgggacttggggctctatctcgcaaggctgcattgtgcgccggaggtccgaggatctta

SEQ ID NO: 718328 - DNA, 380 bp, Homo sapiens
  misc_feature (6)..(6): n is a, c, g, or t
  misc_feature (33)..(33): n is a, c, g, or t
  misc_feature (81)..(81): n is a, c, g, or t
  misc_feature (153)..(153): n is a, c, g, or t
  misc_feature (301)..(302): n is a, c, g, or t
cagtgnagccttctaaattctggagggaagtantccttcccaccttagcttccggaggagctgagaccacacctgattaanggcttttctttttaaatttttagtagagatgggaactctatgttgctcaaactggtcaccaactcctggctntgagtgttcctcctcttcggcctcagattgctgggattactgcatgagccaccgaacccagactacctcactgttttaaaaagcaattttttttttttttttttttttgagacagagtcttgctctgtcacccaggctggagtgcagnnttgcaatctgagcccactgcaccctccacctcccaggagaattgcttgaactggggagctggaggttgcagtgagcca

SEQ ID NO: 718329 - DNA, 1177 bp, Homo sapiens
cccctccgcgggagtgctgagctggagagcccagaggtgatgccgtgatggagtgaggacagatggactgatgatgtgatggtggtgagaggagtgcccccgcgtccatgtgatgtgtggctgtgtgcaagtcttgatgtgtgcagcaaccactggccgactgggctatccactgtgctgatggcttgcctgagggaacgacacgtgagcttgtgacgcaccgttgacctatgatcagcaagtgccatccatcagtgtaccgtgccatatccactctgtgcaatgaagtgatcaggcatgcaaaggtcacttgacacgtgttgtgcattgacttccatgcatcctcaaggatgatcgtgtgtgctcagtccatgtgatgcctaaagacgtaccatagagaccatgtatcgacatttgccctattgaacatgggcgctcgagagagtccggtcccagatgtccaaaaagagaggacagaatacccaagggcaccttgcgaccttctgcctcatgcatgaatgcttgacccgcatcaagaagccgtgggccttccacgactgcgtgcactaacaggattggagctcgcaacgcgacggcgcctatgggtccattgtgggcatccgctacggcaaactggggctattcagggatgcctggtcatggcgtggggaacccccctcggaaggtggagacaggggttggtttgcttgacggcgcagtgagcacaaagcaagaaccaccattactgatgctgttccgacaggaggcgactgatcgcaccattgtaccagaccaccacgcgggcccaatcacattcagatcaaaaaaccacctgcactgtgaaccgactaagccctctcaagccagcaagctaggcccgttaacagtggactcactccctggcccttgtaatcagcaccttggcatccacaggttgcccaacgttacggcgaatattgggggagttctaccctttgatacaccgcaccacgttctctatacgaaagacgacaccattagtgcccaataggctattagagcgaggacaattgccgatgtcagctcccacaagcaaaacaaacgaacggtcgccgacattgcaacaagcgaccaatgagacaaacatacatacaactgagacagacagtcatatatgccaaaagacacactctgcaaa

SEQ ID NO: 718330 - DNA, 144 bp, Homo sapiens
  misc_feature (29)..(29): n is a, c, g, or t
ttgtcagtgaggccacgctggggagtggnggagtgcttgtatgtgagatgcatggagggaggctgacacaaacgtgcggccatcgggggccagggacagggacatcacatccccactgtgtccagcaaaacccactgacaacgg

SEQ ID NO: 718331 - DNA, 846 bp, Homo sapiens
gaagacagagcatctcaaatcggctgatatctagcatctggaaactgccttcatcttgacagaaaagctccaggtcccttctccagccacccagccccaagatggtgatgctgctgctgctgctctccgcacatggctggcctcttcgagtgcggcagcagggacaacgcactttcatacttgaggcaacgctgccaccaaatcctccgagtgcacgagagacactcccgacgctgacatacacgtatctcggaaccatggtcacgaacacttgagacagatcccaaacaaccttatgcacgatctgcgcccggctgccatccaggaccaaactaactcatctaactggaacacacggcacacacgacccaaagctgctcaacacacccagcgcacccggcaccacgaccagaatgcgcaacctagacgcaactccaacaatcgcaaaggacgcaaagaccaaccgcacagctcacaccttacaacaagagcacacagcacacaggcctagcacaagacctaaccacacacacccatgacgaaaccacagcacaatacgacgccaacccagccaactagcccacaccatgaaacacatcccacgcaccattaatgcaaacaacacatctaatgtcctccaacacattgataactttccccttactaacacctgtcaccatcaacattcccaaaaccttaaataaatcaaactaatagacaactcacatatactattcagaaaatcacatcagaacctcacacccaactatccctcttcaaccactattccacactccccaagaaaacataacaaacaatacacacctccatccactcaaacaacca

SEQ ID NO: 718332 - DNA, 1242 bp, Homo sapiens
cccgcctccacccgcccgcgctacctcggcctgtgggttttactggcagagggtgacggctaggcatggcagggatacggctacctggctcttctcttgcgctggattctccagcccttgcccgctgttgcttgactctgctgagagatagcaggccatggcacgcggctggtaagaatagttcagctggcggctggcctggcagttgccctctggcgctcaagcagcaatcattaactagcgcagcgggcaatgcacctgtacgctagctgggctactactgcccagcctgcacagcaggcaacgtggctcgcactccttgaccactggcctggcggctatccctgagcgactgcagcttacacacccttctccactgctacctggcggcgctctgcaggccctaccagcgactcagcactgctcgacacctgcacgacaggccctcatcacaaccagccctggcccgcctgcatggcttcgcctccgtgccaccccacccatccctcactccccggcgccctgacgcgccagcgccctctccccggctctcctgccgcagcccgccctcgcgcgcccctccgctcccgccaactcgccccgcccacccccccgacccctgcgccgctcctcgcaccacctgacacccccgccacctgggccccacccaccccgccccctgcccccccggcctccccctccccctcgccctccccctgctcccacgccctgcccccgactgcaccttcccggccacgccactgccccctacctcctgccactgctgctcacccccgccctgccccccgcgcccccgcccctccgcgccggcccctcccccctggcccccgcgccccctcctccccccgcctgcccccactcccctgctggcccgccccctgcccatcacgcccttgccattcccttgccctcccagtcgcacccgccaccaccctctctgccccctccggctcccccagcccttgtccgcggcccctcccccaccccccccagtcttcgcgcctcccctgcccttgccacccgctcccttgccccttcccccggagctgacgccttggcctagcctcgccgtagccccgtatcctgtccccccgccctcccaccgcccgtacccctgactcccactcctcaccaaggcccctcccgcttcaccgcggccccgaccctgcggcccaccccccccccccccactcctcctttgcccgaccctagccacctggc

SEQ ID NO: 718333 - DNA, 390 bp, Homo sapiens
catcaagcgaatgagagcgcgagtgtgtgtgtggagggagcgaacggactcaggcgactaagagtgcgtgagtgtgtgtggagagagaacggaatcaggcgaatgagagtgtgtgtgtgtggagagagacgaacggaatcaggcgaatgagagcgcgtgagtgtgtgtggagagagagagacagggaatcaggcgaatgagagtgtgtgtgtgtggagagagaacggaatccggagaatgagaacgcgtgagtgtgtgtggacgagaaggagaacggaatcaggcgaatcagagtgagtgagtgtgtgtggagagagaacgggatcaagcgaatgagagcgcgtgagtgtgtgtgtggagggagagcagggactcaggcgaatgagagag

SEQ ID NO: 718334 - DNA, 216 bp, Homo sapiens
ggaagaaggtaccgtccccgtagaggcctggacctggacgcctgatatcaatgagccactctcggacagcgagtcagaggacgtacgaggcccagagccgtcttccacgaggaggagcagcggcgtcccaagcacctggccgtcggaggcggacgaggaagagctggctcggcgccgagaggcccggaagcaggagcaggccattcaacgcctccg

SEQ ID NO: 718335 - DNA, 218 bp, Homo sapiens
cgttaagtacctaagcactgtgacgtgatgcaccatcgcgcaatgctcctgacgcgagcactactactcacacatagacaaccagagacacgctcaatgtatccaggaacgatgcccgacatgacgtcagaggccggaggctggcgctccccgcgtctgattacttacccaccaactggcgctagttactcggcgatcagctcatctcatcattgtgg

SEQ ID NO: 718336 - DNA, 115 bp, Homo sapiens
atggtgtaagagcacgtactgactgtatctgctagtcagtggccttgatgtatcatacttagttgtctccacgtccttctgaatcactcctctcctggggtatataagccctggg

SEQ ID NO: 718337 - DNA, 196 bp, Homo sapiens
aaaccacaaagacttggaacacatctattaatcggccatagctggagtcctaggcacagcctaacctccttctcgagccgagctgggccagccaggaacttctaggtaacaccacattacacttatcgtcacagccatcattttaatactcttcatagtagccacataacggaggcttggcaactgactaggccta

SEQ ID NO: 718338 - DNA, 166 bp, Homo sapiens
acgctcctctgtggggtctgaggcagttcataatatcggcttcctggaagatcagccccttcttcaaggtatgtcttcgcctctcagcacgcatggggtgttctgcggagggaactgcccttggatttctcctgcaggcttctaggcctgttatggacccgcatgg

SEQ ID NO: 718339 - DNA, 287 bp, Homo sapiens
tcggtaccaacatgcgaacggactgatcataataggaggggaaaaaaaaaagataaccccctgaaggtacatgtgaaaatgcaggggtagagccctgtttaagaacagatttactttagtgcataagtatttggcttgatttaagccccatttgatttgaacatcgacaagatctggagcactcttcagaagttcctacattactagacatggcctagtttgctcacatttatcgtgggaggtgggttgggggaattagcacgggattctgattccagacaaattca

SEQ ID NO: 718340 - DNA, 390 bp, Homo sapiens
tggagcacaacccagttggcaaaaaaggagggagtattagcctcaaaaaaggggggtggagcaaatttttcgccccattttttccaggctttatggggggcctggtgtccctgggggcaacagttgtggcactcaagccccccagggggaccccagccccggccccatcattaaggaggttgattgaatggccctttgtgaaaagtcacctgtgactgtcaggggtatgctatgggccttttaaactgttttttatgatcccgcccttcaaaaatgaactttccccccaaaggaagaacttttttcccaggaaaactgaagttttttgactttttgcggggagggcggttcatccttttttgcttcaaaaaaaaagtcattaatttatta

SEQ ID NO: 718341 - DNA, 225 bp, Homo sapiens
gcggaccggatgtgtgggtatgtctagagacaaatcattttattgtattcatgtacattgtactccccttattcacatttccatatacctcacttgtatcatctaccatatgatgaatgacccaccacttgcacatttgtgctcttgcttccgccttgatttcctttactccatgctctttatatccatgtatgcatcatggcctacccataacaccacacaatt

SEQ ID NO: 718342 - DNA, 125 bp, Homo sapiens
ggcgggcgggggagcagcctagggagagcccccatcagggccaccacccagtcggggaggggcttcatcctttacctatccccttccaccctccttgggctggcttaataaattctggaactggg

SEQ ID NO: 718343 - DNA, 114 bp, Homo sapiens
ctgtcagtgcaactttcagtctgaggagatttctcatcttcaacatcaataaaagtactcatatctagttcctcgggaaatgtcattcgatcattcagtttaatccactgctgg

SEQ ID NO: 718344 - DNA, 239 bp, Homo sapiens
ttaaaaaaaaaagggggcctagtgtttaaaagggggtttcctggagcccaaaagcttgccttttaatccccgcccccccccaaattttttttggggttaacccttttttgcccccgcttccctttttttaaaaaggggaaaaagggcccctttttgtaaagttttttggaaaaagaaaaaaatttccttaaaaactttaaattgtaggggggccgattaaattttggatatgggtttta

SEQ ID NO: 718345 - DNA, 267 bp, Homo sapiens
  misc_feature (153)..(153): n is a, c, g, or t
cgcacttatggatacagctgctcagcccgggctgcaacggcgcccatgtttgtgcaacatccagacctcaaggcactttcagctccagttcctgctggcaagatgtgcagtgttgactacgcggatttgctgcagattaccaggtttcatatntggatgagctgacagcccgctggttctgccaaatccaggtgaagacttttggcaccctggtttcaattcctgtctgcaacaagtcgtctgtgcaggtgggtagtctagaccagg

SEQ ID NO: 718346 - DNA, 255 bp, Homo sapiens
gactctagaggtatcccctcataggcttcgcaggtgaacacttttgtaggtaaaacggtttacttttcaccagtctgttctggcactgcttctaatgatatcgagtcacctggatcaatgatttccagtgtgcacactctgctattattttccgcatgcttgtgcccagcttcaatattattgccacgtgatagttgttggacaccagtttttagccaaccatagctatagctactctatttcatgatttccttc

SEQ ID NO: 718347 - DNA, 323 bp, Homo sapiens
atattgtattctcggcgaagataccggttacctacagtatgacggaaggaccccatggagctttactgcagcttggtttagcgttttggcattgcatgtgtaggatagttgcgagactatgatgtaatggcgctatgctgtatcggagtcatcggtggaataccaaccattcaatgctgaaattgtaatctgtggtttgaagccacggatacagtgctaggtgtgcagtatgactgggacggtcgcttccgaacgattaacggaggagtacaaaggttctctcatgttggatggaaatcatccatacagtgcaatggcatcag

SEQ ID NO: 718348 - DNA, 382 bp, Homo sapiens
tctgaggtgactagagttaccctcgaatcgacggtcctcaacattggtgagacttcaagctcatggagcagttggcaacctgggcatgcggcatgtgctggacagcgagggcttccctggaggacaagtgcctgcctatggccatccggtcacacaggaacatctcagccctgaagcgagacctggacgcccgagccaagaatgagtgctaccgagccacgttccggctgcccagggatgagcggctagacgtgcacacaagctgcaccctgtggacgccgttcaacaatgctgcacatccctggccagatgttcatctccaacaactacatctgcttcgccagcaaggaggaggacgcttgccacctcatcatacccctga

SEQ ID NO: 718349 - DNA, 1082 bp, Homo sapiens
  misc_feature (1082)..(1082): n is a, c, g, or t
ggcctccttcagccccatcatgggaataattaattttctcaatgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctaatattcccggagggggaaaacccccactggttttggtttgtagaaaaggggccccctatatggagagacatatataataaatataacacgagaaccaactgcacgatcgttaaaaaaaaacgcttctgagtgtaggacaaacaacccttgtgcaactgggtattctttgatggggagaaagacacccaatttcgattgctagggtagtgtagcaaattagttgggggaccacctaacctacaacaactagatactaactcctcctggtgatccgtacaataaaactaatactagagacgttaatagtggggtagcaacacaccggcatcatacatggcatgaccgagagagaaaaaacgagtagatccacagactcgaagcatgaaaaataacaaaaaaattcatctaccccgacgcgcacgatctgacatatcaaacagcaggaagaacgataacggacaacagacgagcgacgcagcaaggacgaggcagacgaacagcagaaccgaacaacgaagcagagcaaaataacgagaaacgacaacaaggaggagcaccaaggaaagaacgaacaaccgagcacagcaccaacgaacagacatcaacgaaagaataccacagcagtagcaaaaaacagaaaggcgaaagagcaccagatacaagaggcgaagaacaagaacagaccaagtgacacagaacataggcgagagacaacagagtagagagagaaaaccgagagaacacaaggcgcagacagagcgagaaatagcagaaaaggaggacagaagggaaactcagagcacggaagacaggaaagggaaagaacgaagaaagcgaggacgcaacagacggccaagagaagtaggaacgaacagcaagagaaaggaaagaggagcagggcacgacgatccatcagtgagtcgcgccgcggagn

SEQ ID NO: 718350 - DNA, 300 bp, Homo sapiens
  misc_feature (99)..(99): n is a, c, g, or t
  misc_feature (109)..(109): n is a, c, g, or t
  misc_feature (179)..(179): n is a, c, g, or t
  misc_feature (198)..(198): n is a, c, g, or t
  misc_feature (254)..(254): n is a, c, g, or t
atatcatctcaacttagtattatacccacacccacccaagaacaggggttggtaaggactggttgcattaaataaaataaaagctccatagggcttctnggcttgctgngcatgcccgcctcttcacgggcagggcaaatttcactgggtaaaaggaaagagacaagctgaaccctcgnggagccattcatacagggnccctaaataaggaacaagggaatatgctacctttgcacgggtaggggaccgggggncggtaaacatgggcactgggcaggcggggcctctaatactggggaa

SEQ ID NO: 718351 - DNA, 230 bp, Homo sapiens
tcctatctagggctgaagaaggtgctggcaaggggacgtccaacgaagagacacctgtcttcgagcaggagttaacaccgtcaccaccttgggggagaacaagaaagctcagacggatggtgattgcacacgacgttggatcccatcagagctggtcgtcctctatgcctgccactgtgtcgtaaaactgggggtcccattactgcattatcaagggaaaggcaagactg

SEQ ID NO: 718352 - DNA, 283 bp, Homo sapiens
tttcttaaacccctaacctcgtaatccacctgcttgggcctcccaaagcgctggtattacagacgggatccaccgcacccggccagctgccattttttaaaacaaaatccaagcccttagcttttgagccataaaaaagaaatagagctatctctatactggatccacctcaattttagcaacgcatctttgcatctccacaatgccattttcttaaaaacatttgcttgtttttaacatctggaataggtggaataagggggagaacttaggcttgcagaaa

SEQ ID NO: 718353 - DNA, 370 bp, Homo sapiens
  misc_feature (147)..(147): n is a, c, g, or t
  misc_feature (152)..(152): n is a, c, g, or t
ggacgactctacgaggatccccattcaaaaatataagccatttatatgggaatattgactttcagtaatattcatttatacttttgcatgtaactgttctttaagttactctttaaaataacaattaactttttttttttctttttngaganggagtctcactctatcgctcgagctgaagtgcagtgtcgcgatctccgctcactgcaacctctgtctcctgggttcaagcgattctcctgccttagcctcctgagtagccgggaccacaggtgcacagccccatgcccagctgatttttgtatttttagtagagatggggtttcaccatgttgcccaggctggtctcaaactcctgacctcaggtgat

SEQ ID NO: 718354 - DNA, 889 bp, Homo sapiens
atctaattatgaagtgttcccagtgccacaccgtttcaaaagggatggcaagcactagactgggacagctctccatggtctctttgggtcggcagacaggtcaggcccctggcatcgctcttacactcagcccgtccaatatagtaactaataaggcatcatctgcgggagcaggcatacacgtgatggagtcattatggtagcaatcccaagaagtacattccttggcaaccaagatgatcgtttcgtcggcaattacgcacagccaggccagaaagggctagacttcaatgagcttatctccaataataagctcactcacatgagtaatacctggcccactgccttttatttattcgcaaaaaccagcacaattgtctccatgcagtgttcactttatgtgtacctcatctcattctacatcagcatctcgatcacaagcaagtaatctcagcatccattgcaatcgactgggacagcaatcattgtcggttgcgggccagtccttggattttaaacatactaaagcacttggccttcgtggattcaacattgccatcattgttccagtcccttcgaatccccaaggcagtcaactccaattcagtgaagatggtataactgtttagccctttctaaaagatctgattagacttcgtaagtaatgtccaacttttcacaacagatggtgaggtgcaatcttataacttactggagcatgtggtcttcaatcctctcagatgcatactaactggttatgtggaatatgttttacatacctggggaacttggttccttgttttataacctaggaaagagtcacctgtgctttgtggtcatgtgcatttgctctaaaggcaaggtgacgcatcataggttgcagttatag

SEQ ID NO: 718355 - DNA, 514 bp, Homo sapiens
  misc_feature (110)..(110): n is a, c, g, or t
  misc_feature (467)..(467): n is a, c, g, or t
  misc_feature (469)..(469): n is a, c, g, or t
ataaatatgcacctactgcgtggtgccttacacccgtggtgaagaggtaagccgtccgtccgacgatattctgtttgagattgcccagcttgcggctcagggcgtgcgtnaagtcaacctgctcggtcagaacgtgaacgcctggcgtggtgaaaactacgacggcaccaccggatcgtttgccgatctgctgcgtctggttgctgcgatcgacgggatcgatcgtattcgctttaccaccagccatccgatcgaattcaccgacgatatcatcgaagtgtatcgcgacacgccggagctggtgagcttcctgcatctgccggtacagagcggttccgatcgcattctgaacctgatgggccgtacccatacggcgctggagtacaaagcgatcatccgtaaactgcgtgcggcgcgtccagatattcagatcagttctgatttcatcgttggcttccctggggaancnccgagacttcgagaaaacgttgagctgtttgccgcgcaatttcga

SEQ ID NO: 718356 - DNA, 265 bp, Homo sapiens
tcgcctagagttccaagcatcgactgtctacaagttatgattactaggggactatatatctatctaccccaacggggatgctggaggccaagatgcatgccactggctactccatacaagcttctacacccacgaggggctgcgctacggagtcgcgtgcacatccacctagaattggcaacatacacacacacttggtgcactaccgcgtatccctggctgtggcgggcaccaagaacagcttccaaacactacagtcgaggct

SEQ ID NO: 718357 - DNA, 447 bp, Homo sapiens
tctgcttcaaactctcagagtctttataagtcttattctcaagagttgtgtcccagcgaagggaatccgccttggaaatcgcggcttcctccttgcacgccgctcgctgtttcagcgcaagccggatctcccctcacacccaacagcaccaccttccgagactagcggctcattaccgcccagtccccgcggccggcgcaagaactcctcgccgggccccattccaggctgggtcgggtctttagaataaggaccagttgtgtgtctccctgtcgctggcagcggatcactttctggctgaagaaaagacaaaacgacgagggaaacaataggacctgtatgttttacacacagttctcattcgaaatgtatcatgatcatatttttaaagatgcgtgttacctttcataaatacctaaataaaacttactttctgttgaaaaaaaa

SEQ ID NO: 718358 - DNA, 163 bp, Homo sapiens
gtgaattggtgcatcttccccaccatacacacacacacacacacacacacacacacacacacacacacacaccccacacctttacatgggggtatgctgcgcaccctcacaaacaccccatctcagatgtggtctctctcatctgataccctggctctagtag

SEQ ID NO: 718359 - DNA, 116 bp, Homo sapiens
tctacctcgcggtgctcctcggtgctgtagtccagctacttgggaggctgaggcaggaaatggtatgaacccaggaggcggagcaagaatccgtctcaaaaaaaaaaaagaccggg

SEQ ID NO: 718360 - DNA, 183 bp, Homo sapiens
tcatgcccactctccaccagagaggctgggagggcaggcatggcttgagatgagcgggagctgggaatagacctcgttgtgccttgaaagggcttctctccctatattgattcttgtatattagagttgattttagtagagtgttaacagtggtttcaaatgtgatcatatgtgtctattttt

SEQ ID NO: 718361 - DNA, 169 bp, Homo sapiens
cgactagaggatccagatcccctttcatcatcataaatgtcatcatctggtgtgtggagggaatattcctccacttacactcgtgactgtggctgctaatatcatcctgctctgcaacatcatcatatacttctatggtcatcttcaagtaggtcttgcagggggcacc

SEQ ID NO: 718362 - DNA, 281 bp, Homo sapiens
tgcaatttaaaacttcctagtaaccacattaaaaagtgacagtgagctgggtgcagtggatcatttgcggtcaggagttagagaccagcctgaccaatatggtgaaaccccgtctctactaaaaatacagaaattagctgggcatggcggtggacaactgtaatcccagctacctgggaggctgaggcaggagaacagcttgaaccaggaggcagaggttgcaacgagccgagatcgcgccattacactccagcctgggcaacaagagtgaaactcctctc

SEQ ID NO: 718363 - DNA, 379 bp, Homo sapiens
tttgagatacctgccttttgtccaccaatgtatcgtcctcgtatatccaaggctgtgtctccctttagcatctcctctcggtttttagcagactgaagccatggtttttagttctgtctctagtgatgagcagaaaagagggatgaggaagaggctttactgtaccaaccagaaagagaagctaagaatccatgactggattctctcccttggacaccccacagaccaatatctcactttgcaggagaagtccgttccagctcttggttctttaaacttattaacttagttttcttcagctagactcccaaacatcagcttttacaattcagcatatggttcaatcactatggcaagataaacatttgttcaggtgtga

SEQ ID NO: 718364 - DNA, 968 bp, Homo sapiens
ttccacaattcgcaactcgcctgccttccttcaaccctggcacatttaccgtagtccctcagttgtacaggtccttcttccttggctcccgtgaagttgcatcccctggtgcgtagcatggattggcctcaggttatggaatggcttctcactaaacgtttcggtctagaatgactccttgacccgcttggtgataggaaccaacatctcaccgtgcatatagacgaatgcgggtttctacctgtgttgatagtatgatatctagtatagccagtccatgtgctgatgtcgcgcacatggtagtttacgttctttatggctgtgctcgctcccttggcctctcttgtatggatggaaggactgtcattgatatgtcgaaccagggcgtcttggtctcgcatggagccctcaatgtcgcaaggactcctgttcggcgctacctgcccatagagctacctttgtgcttcggatgaatttaagctgcaatgtatctcctaacatcgaggacatcactcgtctgttggcacttgccatactatctgggacgcactttgataaggacggctggtccctgtggtatctcacgatgtatcgcttccctgaagaagctcactcagaccttgcatgagcggcaatctcatcactggaatgttccacgcgactggacaagctgaggaacgaatgccttcgccagtgtcatcctgtctcggaaccggacaatagcagatccatttctggagtcttgggtcattccgaggccaggagcattgcactttccgctgagatccagagttggcaggtggactacgagtcatacacatgtgcggaaactggatcctggcagcgaggagacccagacgctggtttcgagagtacttttcctgggagggggccttccagcatgggggccaaagccttcaatcagggcaagatcttgatagtgaacatataacgccatgacctagcgc

SEQ ID NO: 718365 - DNA, 245 bp, Homo sapiens
ctgtcagcacagaggttgaggcaggatctcttgtcttggtgtagtcctagcctcccgtgtccttagtcagtagctgccattggagctttcacgacactaccacatctcccttctcccatgaacacattgtacactaccccaccctccttgatacagcatcactggggcagcagatcagcagttttaaaaagatgctttccctttggtctcctgctactactttgcttgtggacattggctgttat

SEQ ID NO: 718366 - DNA, 353 bp, Homo sapiens
agctctacgagatccccgatttacctcttctgctgtttattactagttgaaggctaatggatagctacattccttcccaccttaagacagaacatatctataactgatgatcaggagcgttacagtgcaaatcgtttacacacgctaatgctggtcacatgcactcttacgtgaggaggaaaccatgctgatactagaattgtctctggccttaagtgttgtccaattatatctactttacctgaattaccatgccaagtctgaattatgaaattacttttatagtatatccggaccgttaccaccgtcttaccaccctggccaccatcacatcaccttagtcacactcccga

SEQ ID NO: 718367 - DNA, 261 bp, Homo sapiens
cctttcatatactagtcagctttatacgccactaagctatgttctccgcagcctccttcctgtcgtttccatgtggcacattctgccagataccttagtagtcccctttcattttataatagaaaaccttggactcgccagtgattaactagcttcagtagaggtgtttagtctcagtatcattctcagaatagtcacaaccagatataactttaaggctcagatctcaaccatttgcctagaatgagggggatcctctaa

SEQ ID NO: 718368 - DNA, 589 bp, Homo sapiens
  misc_feature (513)..(513): n is a, c, g, or t
aaatccaagcttcattattatcattgtacacccttttggcctgagctagagttctatggattgtctgacttgctggttatagctttgggagagatttcattcattcattcattcattcattcattcattcattcattcatccatctgtccatccatccatttgttcaggcataattattctctcatttattcatttatttgattatcttgcatttataagctattatagctgaatatatgctagtgcctgtgtgtcatggaacagacagatggacaaaaacctgtacaaaagttcagagagtccggtgggcctgtaattgcttcacttttggaaggacgaggcgggtggatcatgatgtcaaggaatttagatccaacctggccacatggagaaaccccttcttacttaaaatacaaaaaatttaacccggtggttttgttgcacccctgctttccagttgtttggaaggctgaggcaggataattccttgaaccccacaggggggattcagngagcggaaataatgcccttgcttctcaccctggcgaaaaaggcaagcctctgtttaaaaaaaaaataaacccggac

SEQ ID NO: 718369 - DNA, 375 bp, Homo sapiens
tgagacagagtcttgcactgttgcccaggctggagcacaatggcacgatcttggctcactgcaacctccacctgtcaggcgatcttggctcacggcaacctccacctctcaggttcaagcaattcccctgcctcagcctcttgagtaactgggattatgggtgcccgccaccacgcccagctaattttttgtatttttagtagagatggggtttcaccatgttggccagtccggtctcgaactcccgacctcgtgattcgcccgacttggcctcccaaagtgctacaatcacaaacgtgagccacggctcccggcctgatacacctttctaagtttcaattatcctatatataatatagagttaataataaggac

SEQ ID NO: 718370 - DNA, 103 bp, Homo sapiens
acccgcggcgagttcatgcagacagatttgagaaatggctaattaattaattaatttttgagatggagtttcgctcttgttgcccaggctggtgtgcaatggc

SEQ ID NO: 718371 - DNA, 703 bp, Homo sapiens
  misc_feature (469)..(469): n is a, c, g, or t
atcttccagggggagaagtgtctaggttcccctacggtgactaaactcctccaaatagagtaggatgtggcactaatacatgcagtgtaaattgtgcgatcggagtacgtagcctgccgatctcatagaatattagatgctccataatagctcttccatataatgtgcccgccctgcgtcgcacacttacaaaaactcaccgttataatctatggattcatacctgaccgaatgagatgaagaaagggaaaagagccgctataacagaatccgtgtgcctatgtgcatgttacctattgattgcgtagaagcgcagtccttccaatgtcatgggatggattgggttagtatctatacgagtatagccggagctttgatgcgctgctaaattgccccacacctacttctaccggcatagatatatgctcccagtatgattgagaataacaaccatgctatgtacgtgttnggtctgggaaccgcgtggcaaggttctagcataccacattcctaagagatctggcccatggcatggttagcttcgcaatacaacgagagacgactgtactgcgcttattgaccaagaggtgctacgatgtctgagggtgtagggctcgagttatctatcatgtacagaagatgaaccgcgaatgccaataaggttcgacgcaaaggaacagagataaacagacaaaaaccacgc

SEQ ID NO: 718372 - DNA, 273 bp, Homo sapiens
agggtatggcggtcccccttcgctgggaggcaccagtgaggggggtcgctccagaatgtaaggcactggcagcggaggcgtagggggcgcaccggcttgccagagcccacccccgctccccggcagtagcaatcttctgtaacgtaactacaggaatgatggacatcacatcccattaccttcactgtgttctcttggttagaagcaagtcacaggtcgccacccacactcaaggggaaggaattacacaaggcatgaataccaggagaaagg

SEQ ID NO: 718373 - DNA, 976 bp, Homo sapiens
  misc_feature (32)..(32): n is a, c, g, or t
  misc_feature (416)..(416): n is a, c, g, or t
  misc_feature (448)..(449): n is a, c, g, or t
  misc_feature (497)..(497): n is a, c, g, or t
  misc_feature (507)..(507): n is a, c, g, or t
  misc_feature (976)..(976): n is a, c, g, or t
gggcagctgtcactgctctggggcttcaaggnggtcttgcgatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggctcctgcaatagcagccaggtggtggtggctgtaggcngggccctctactatctgcagatccatcctcanngagctccggcagatcagccacacagagatggaacatgaagtggcttgnttggcatcancccattagagatgacagcaatggacatgtcccctctattgtgccatatggacctactggactggacaatcatacggacatcgtatctttgaatatatgacctctttatgaaatactgcacaaaggagatgcatgaggttgagagatgaatcattaccatcgctcccatccatgaatgaccaaccgtttagcagatgtagccaattagctacctatagtgcacttgatgaggataggacgctgcttatacaatactattgtaggctccaagcatttgagacccagggcataggaagagccagaccaggtaagaaaaggttgacattgggcgcccgagaccaacagtatttagaagaactaaacagtacatattaatactcaccagaagtctatagattgtcatagacagcccattactcactatagcagcaaccacaaatgtacttctaagatgtaacacaggacttatn

SEQ ID NO: 718374 - DNA, 821 bp, Homo sapiens
ctgccgcatctcattttattcattcagatgtaggggtgtgtgaaacacaaaaatataaataatgaacaatggaaaatatttattaaagtatattagaaatgtatagatccatattgtcatgtttagttggataacatcagaaatttgtatgggcaagatatataaaattattttatttcctataaattaaattaaatctgactttgaattgcccaacctggtaaaatatagattcatatcagtcattatgggaacacatagaaaagaatatgtctttcttcctttccttccttggtcctctccaacccaagagtagcgcaaaaacctaagaatcttttaggaaaaaagaaaacaaataggagatgggcccacttgtctgcagttatcaccatcatggactgatacccttattgaataagttctgcttcaagtccgatgacattattacttttctggtcaagcttggacatgagagtctctcttgattgtgaacccccaggaactacagtccagcctcccaaggtactccatccagccatttcttctttgaggccttgccatttgcttggagacagccaggaagtaggattcagggcacaactatccctggtggggctgaacattattccaatttgggcaagctggctttagcaggctacttaccaccctcccttacagtcgaaaggtgatgccttaacgtaatcttccacaaaaggatcgcggagggtgacgaccgcagatagcccgtgcttccagtcagaatctgattagtgccgagcatggctaccctctgtcgtgtgcctactcgggcgggtgtcccc

SEQ ID NO: 718375 - DNA, 405 bp, Homo sapiens
  misc_feature (397)..(397): n is a, c, g, or t
gcctatttcttccacagtcagatggaagtcagcggaagggctcagagactcatagggaagatgagtgagtggaggagataagaagaaggaacgcaggagcagggggacacaggagcctggcggtttcttctgcagaaacttcaaggggttccctaacgcctctcttcaaagtgaacaccagtgcctgggccctgaccagcagcaggtgtggcagccaggccccgaccagcaaaggcctcgcagtagataatttgttcaggcttttgtgcttctatcttggcttttcaacttgatctgatgaaccaccccttgctccacctctcccccacttatatcgcactagaaaatcagcctgaactaaacctccccaaatccaacagaataaaaaattaattcncgaataaa

SEQ ID NO: 718376 - DNA, 663 bp, Homo sapiens
gatgtggttgactatttctgtatgtctccatctattgatgagggtcttaaaaaaaaaaaaaaaaaaaaaaaaaaaaaaaaaaagagagaagaacaacaacaaaaaataaaaacacacaagaagagaaaccaaaaaaaaaagacagaaaccaaaaaaaataatagaaaacaaatggagggacaaaaagaagagaaaccatatagacaagcacagcaaggcgacgcgacgtcatataacaccacagcgaccgacagccgcacggggaaaaaacgcgcgcgacgaccactggggggacaacacctctgcggccaacctgagaaccactgtcatcaactctcggtggaggcgggagaacaccacacccgtgccggcgccaccaaaccacacacaccaacagagagacgcacatacaacacccctcctccacacagcgcgcctcaccatccatcaaacaagaagtaaatcaaaaaccgggggatgaaaaaacaccagagagggcgccaccacaacaacgaggcgcgcagagccacataagagcgaagagcgaccgcgcccccaggacaccgacacctatatcagggcacacacacaagcgtgagagccgaaagggaaaccacctcatcaggcagaccacccaacaatataagacactaaccaccaccg

SEQ ID NO: 718377 - DNA, 2121 bp, Homo sapiens
tataagcgcgtcatggtgccatgaacctgttcgccactgggaggtggacggctccagccccagctgcgtgcccaggttgtgcagcctgactctgaagaagctggtggtcttcaaggagctggagaaggagctgatctccgtggtgatcgctgtcaagatgcagggctccaaacgaatcctgcggtcccatgagattgtgctgccccccagtggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggctgaggtgatgcaacacccgtctgaaggtggccaggtgctgagcctctgcagcagcatcaaggaggcccccgtcaaggcggccgagatctggatcgcctccctgtccagccagcccattgaccacgaagacagcaccatgcaggccggccccaaggccaagtccacggataactactccgaggaggagtatgagagcttctcctccgagcaggaggccagtgacgacgccgtgcaggggcaggacttggacgaggacgactttgacgtggggaagccgaagaagcagcggagatcgattgtaagaacgacgtccatgaccaggcaacagaacttcaagcagaaagtggtagcgctgctgcggaggttcaaagtgtccgacgaggtcctggactcggagcaggaccctgcggagcacatccccgaggcagaggaggacctggacctcctgtatgacaccctggacatggagcaccccagcgacagcggccccgacatggaggatgacgacagcgtcctcagcacccccaagccgaagctgcggccatactttgaaggcctgtcgcactcgagctcgcagacggagattgggagcatccacagcgcccgcagccacaaggagcccccaagcccggctgacgtgcccgagaagacgcggtccctgggaggcaggcagccgagcgacagtgtctctgacacggtggccctcggtgtgccaggcccgagggagcaccctggacagcctgaggacagccccgaggctgaggcctccaccctggatgtgttcacggagaggctgccgcccagcgggaggatcaccaagacagagtcccttgtcatcccctccaccaggtccgaggggaagcaggctggccgacggggccggagcacatccttgaaggagcggcaggcagcacggccccagaatgagcgggccaacagcctggacaacgagcgctgcccggacgcccggagccagctacagatccccaggaagactgtgtatgaccagctcaaccacatcctcatctccgatgaccagcttcccgaaaacatcatccttgtcaacacctcggactggcaggggcagttcctctccgacgtcctgcagaggcacacgctccccgtggtgtgcacgtgctctcctgcggacgtccaggcggccttcagcaccatcgtctcacggatacagagatactgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggctcccaccccgtggccaggtacctaggctccgtggactaccgctacaacaacttcttccaggacctggcctggagagacctgttcaacaagctggaggcccagagtgcggtacaggacacgccagacattgtgtcacgcatcacgcagtacatcgcaggggccaactgtgcccaccagctccccatcgcagaggccatgctgacctacaagcagaagagccctgacgaagagtcctcccaaaagttcattccctttgtcggggttgtgaaggttggaattgtggagccatcctcggccacatcggccgtcctgcccgcctaagagatgcccccagcaccgcacactcgtggttcccaataaactcctgcctgcggcggaggttttatagcagcaga

SEQ ID NO: 718378 - DNA, 571 bp, Homo sapiens
  misc_feature (12)..(12): n is a, c, g, or t
  misc_feature (18)..(18): n is a, c, g, or t
  misc_feature (26)..(26): n is a, c, g, or t
  misc_feature (28)..(28): n is a, c, g, or t
  misc_feature (33)..(33): n is a, c, g, or t
  misc_feature (40)..(40): n is a, c, g, or t
  misc_feature (48)..(48): n is a, c, g, or t
  misc_feature (54)..(54): n is a, c, g, or t
  misc_feature (64)..(64): n is a, c, g, or t
  misc_feature (66)..(66): n is a, c, g, or t
  misc_feature (78)..(78): n is a, c, g, or t
  misc_feature (93)..(93): n is a, c, g, or t
  misc_feature (104)..(104): n is a, c, g, or t
  misc_feature (107)..(107): n is a, c, g, or t
  misc_feature (111)..(111): n is a, c, g, or t
  misc_feature (114)..(114): n is a, c, g, or t
  misc_feature (121)..(121): n is a, c, g, or t
  misc_feature (129)..(129): n is a, c, g, or t
  misc_feature (131)..(131): n is a, c, g, or t
  misc_feature (133)..(133): n is a, c, g, or t
  misc_feature (142)..(142): n is a, c, g, or t
  misc_feature (146)..(146): n is a, c, g, or t
  misc_feature (150)..(151): n is a, c, g, or t
  misc_feature (155)..(155): n is a, c, g, or t
  misc_feature (169)..(169): n is a, c, g, or t
  misc_feature (195)..(195): n is a, c, g, or t
  misc_feature (204)..(204): n is a, c, g, or t
  misc_feature (219)..(219): n is a, c, g, or t
  misc_feature (242)..(242): n is a, c, g, or t
  misc_feature (245)..(245): n is a, c, g, or t
  misc_feature (251)..(251): n is a, c, g, or t
  misc_feature (282)..(282): n is a, c, g, or t
  misc_feature (287)..(288): n is a, c, g, or t
  misc_feature (300)..(300): n is a, c, g, or t
  misc_feature (312)..(312): n is a, c, g, or t
  misc_feature (318)..(318): n is a, c, g, or t
  misc_feature (323)..(324): n is a, c, g, or t
  misc_feature (330)..(330): n is a, c, g, or t
  misc_feature (335)..(335): n is a, c, g, or t
  misc_feature (355)..(355): n is a, c, g, or t
  misc_feature (357)..(357): n is a, c, g, or t
  misc_feature (363)..(363): n is a, c, g, or t
  misc_feature (371)..(371): n is a, c, g, or t
  misc_feature (378)..(378): n is a, c, g, or t
  misc_feature (381)..(381): n is a, c, g, or t
  misc_feature (397)..(397): n is a, c, g, or t
  misc_feature (405)..(405): n is a, c, g, or t
  misc_feature (411)..(411): n is a, c, g, or t
  misc_feature (415)..(415): n is a, c, g, or t
  misc_feature (428)..(428): n is a, c, g, or t
  misc_feature (433)..(433): n is a, c, g, or t
  misc_feature (440)..(441): n is a, c, g, or t
  misc_feature (444)..(444): n is a, c, g, or t
  misc_feature (475)..(475): n is a, c, g, or t
  misc_feature (483)..(484): n is a, c, g, or t
  misc_feature (499)..(499): n is a, c, g, or t
  misc_feature (503)..(503): n is a, c, g, or t
  misc_feature (548)..(548): n is a, c, g, or t
tccgaaaaaaangtttangggaattnanccaanaaaaaantaattcanaaaaanctcaaaagtnanaatgaagtaaanaaaaaaaaaaaaaangaaaaaaaaanganaggnaanagtgaanagcaccanananccagcgcanaccnaaannagancaagcttctttccntccactgccagggtatcggcccgggnagccccccncccccccgctttccncccccgctttccctaacccggcncgngggggnatctacgccccgtccccgccccccccccccncgaannccccttgttcgncggccggggggncctggnactgnngggacncgganaccagggcgttcaagtggcncncggccncggggaantccaacncgnccaagcccccgcccgngtaccagngcaggnaggncttgcgccggaanaaggncgggaanngcncggagaagcgcttgaaaagctcctggatggncgggctgnngccgaggaagggggncganatcttcaggccgcggggcgggatgtcgcacacggccgttttcacntttttggggatccactccacgaa

SEQ ID NO: 718379 - DNA, 1152 bp, Homo sapiens
cgggtcacacacagtgcggagaccgacagtcccggatcccgggccatgttccacctgtccccgcagcgccgttgatcgcgctctacctagccgacagcacacgcgagccgccgtctagacgccccgacctcgccaccatgagagccctgctggcgcgcctgcttctctgcgtcctggttcgtgagacgactccagagaggcagctagtgaacttacaacaagttccactcgaagctgtgactgtctaaatggaggaacatgtgtgtccaactaagtacttcatcgcaacgattcactggtgcaactgcccactagaaattcggagggcagcactgtgaactagataagtcatagaacactgctatgaggggaatggtcacttttaccgaggaaaggccagcactgacaccatgggccggcctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctacagccgcttgtccaaagagtgcatggtgcatgactgacgcagatggcaaaaaagccctcctctcctccagaagaattacaatttcagtgtggccaaaagactctgaggcccccgcttttaagactattgggggacagaatcgaccacatcgagaaaccagaccctgggtatgcggccatcctacaggagggacaccggggaggctctgtcacctaacgtgttctggagggcagcctcatcaagccctttgctggggtgatcaagacgacacacaacctgagtcattgattatacccgaaagacaggaggaacccacacatccggccacacccatggagggaccggcatccaaggggacgattaatcccaaacaacggcaaaagtgggaacaccacgacgacgtggaccggctgcgaacaaccccacaagccgcagacaacaacagcgcgacaccacaccagacgagcaacccccgtgatccacaccgacgaagagcactagccagcctgcatacacaagcacgcgtgcacacggacaagggacaagagagcagcaccacgacacccgagagcaataacagaaca

SEQ ID NO: 718380 - DNA, 148 bp, Homo sapiens
aaaagtttttcccgggggggggggttggtttttccccgttttcccccgcctttggggggccccaattggggggtttttttgggcccggggttttggcccccccgggggcctttttttggcccccccctttttttttttttttttttta

SEQ ID NO: 718381 - DNA, 150 bp, Homo sapiens
gagcttctgttagcagttgacgcatgtcatgtggcacaggtggacctcagtgctccaggcctgtaagcttggctcgcagtgcctgatccacatcagtgaggccccacagcctcctctgggtgtccaatcaccctgagtgagtcacacacc

SEQ ID NO: 718382 - DNA, 366 bp, Homo sapiens
cgtgcgccaacagccccgcggcactgcggctttctcggtgtcgatctggggcaaacattaattacagggtgaacggaacgccaatgtcaatctggctgcccgccttccttcttctactacggcctaccattaaacgcttcctcgcggtggatttcccgctacaggatacctgatcccgctgcggaaaaaccggtcgaaagcatcagataatgccaccattggcacgcagggtttggccgttgatccaggcaccgtcgacaccggccaaaaatgacactgccgccgcaatatcctgtggctggcccagacgctctaacggtgccatttttgccaggcgctctatcagttccggcgttttgtcgacgc

SEQ ID NO: 718383 - DNA, 384 bp, Homo sapiens
ctagaggatcccccatgttacatggtacctgctctaccaggtatgggggcctctctcttatgacacaagatcagattaaagtcttgtaaagatcatctggggttagtctagcaggttcaacgtgtgaagagcactttctgagctgaatctccatgtgccatgtctagttcaagagactggatagagattagcaatttggagaatgctatattaagaaatggcaaaggttagcctacagagattccaaagttgcatcgtgaggttagtgtctgagaaagtgtgactccggctgccactgcccagaggtattcttagaagaggagactgaggtcgtgataatcaaggcattagtgttgcagccggtgtggcctgtggtaccgagct

SEQ ID NO: 718384 - DNA, 920 bp, Homo sapiens
gagtattggggacacagagaggtccgggaaaggaggagggtaaggacggggggggagtagtgcagagaggggaagaagctattcaggtcggaggactgagaggcatcacgaatcaagggaacttagagaggactggggaaaagtctgcacttgcgaagccgaagtaacagaatgagggaaccggagacatcagagacaatctgatcaaggcataaagagaattgtcccggagagaactggaaggtcgcaaggctctctgatgcttcaagacaagacagaggctaatatcactgactgatcaaaatgctctttctggaaatgagggacttacagtcacaatctaagtgtgataaggagagagaacctgctgcatgtcactgacaccggtgtaggaatgacccagagaagagttggttaattaaccttggtaccatagccaaatctgggacaagcgagtttttaaacataaatgactgacagcacaggaagatggccagtcaacttctgaattgattggccagtttggtgtcggctttctattccgccttccttgtagcagataaggtctattgtcacttcaataacacaacagacgatactcaagcacatctgggagtctgactccaatgaatttctctgtacactctgctgacccagagaggaaacactctaggacggggtacgacaattacccttgtcttgacagaaagaagcatctgattaccttgaaattggatacaattcaaaatctcgtcataaaaatactcacagttcatagactttcctatttatgtatggagcacgcaagactgaaactgttgaggagcccatggaggaagaagaagcagccaaattcgagcaagaagatctgatgatgaagataacgcgcgaagagagatttacgctgtcccctctttggt

SEQ ID NO: 718385 - DNA, 260 bp, Homo sapiens
caaagggttaatatccagagtatatgaagaagtcaactcaatagccaaaaaaaaaaaaaaaaaatccaatttaaaaatgagcaaaaggcctgaatggacatttctcaaaagaaaacatgatgatgactaaccaatatatgaaaaaatgctcagccaggcacagtgactcacacctgtaatcccaaagtgctgggatcttaggcgtgagccactgcacctggccaatcagttgcatttttattcactaccaatgagctatc

SEQ ID NO: 718386 - DNA, 949 bp, Homo sapiens
actgggccaatgtccagggtccaatgcgccaaatgttaggagctggccgggggtgtaccgcgaaacgggcatggcgcctttaccccccggacataacagtttgtgtcaaagcaggtggtaagcaaaaacctttcttttgagggcggtcgcccctgcgggtgattctttgcccccccccccagctgtgggtgccagagcgcctgtgcagaagttgtgcctcgttagacgctgtgcgaaaaaaccccgtgtatgaccggcgtctgttgcccaattgaaccccgaaggactgtgtcggtctcatttcccgcgagaagattgggcgccccctccaacaaaagaatgggggacaccatcagacccgtcagtagacacgcaaaaattggtgccccctccctgaggggtaaaattgttcggttcttcacgaggaggacccacaatagggggggccaccctgtatatcaccaaaccacatggcttggttgtttgtggcaagaactaggtgtacccagaaaaccggggtgaccaccccggtctggtcgttataaaatactaaggaattgtcgtgaagaagagctccacttatatggaggtgttaaaaaaaaggtgcgggagcaccaaaacacgaggcgccataccacaggtgatggtacaacaccaactctactcaacttgtgcgagaccggggggccaccaaaagccaccaacaaaatgtgagctcccggcgacacacaggttaagcctgttgttttggaaacaactcagccttcgtcggggtcatttttgtcgatgtccagtctttggtcccactagggaataaaatgtgctccttgtagtgcgaagagtcacggaaaaccgctgttttccccgtgtgaagtcagagagatgtgacgcggattcccaagattaagagccaaaacaaaaacaagtatgtaccctctctgacaaaaca

SEQ ID NO: 718387 - DNA, 112 bp, Homo sapiens
gttacaagtttgcctctatactgggattatccaggcacttactcaagggaatttactcgggaaatattcttggagtttaggagagataccacttattagtttctgacttact

SEQ ID NO: 718388 - DNA, 313 bp, Homo sapiens
cacaaattcctgggctcaagcaatcttcctgcctcagcctcctgagcagctgggactacaggtgcatgccaccatgcccagctaacttttttatttttatttttagtagagacgaaatcttggtatgttggccaggctggtctcaaactcctgacctcaggtgatccgcctgcctcacctcccaaagtgctgggattacaggcataagccaccacgcccggcccccaaaatcaactttttaactacaattgtagtaacttcttattatatttaatatgactcatcacaaacaacagaatgaaacagcatatca

SEQ ID NO: 718389 - DNA, 373 bp, Homo sapiens
tgtgaactaaagctttatttattgtcatattttttttccttgatttctttgcaaccctgcacctaaaccaaaagcatcgtcatctcgtcacactcctggcaagtccaccggagatgttccttgtgaaccatggatgtcattccactagggaattctttaatcattgtacatggtgtcttgtacaagtctgagttttcctttcaatgttcctgggctgggcttgtccagaaatctcgtcgcccttctgtctacagcagtttagggctcctttgtgtgtggttgtgggttgtgtgtctgtttgtcttaaatgcataagcaaagttttagtcttaacacctgtaagccagtactggtgctgctctgtcctaaaatg

SEQ ID NO: 718390 - DNA, 998 bp, Homo sapiens
ggcagtatatctcctctatagttgcagtgatatgcagcagagttatactccgtggatttagatatcaggcaaggcggattgctacatgctcccagacacattacagaaagcaagatgcaaggtattgctaggtctagagtaagatgccggaagctgaaccgttgtggactgatgtgtcggcgtgagatcccatctctgagcatcctgtagagctgacactgctcgaaagcgccgagacatatcgtctagtgcaggtgcttatcccccagtaaactagataaccttctaggtctggaaagtctagccgacaatatccaagaattgggtctagatggtcgtctcgatgcttgaacggtgaggcaactactctaccgtggactgactagccaagaatgatagtgcctcgctttatgcttggtgctacggtaggtccatttaccgtacttacacgacattcgctggaagcttacgcatattgggaactgtcgaatcatctcatggggatgtgcctaccgggggcctacctccataatggggggagatgtcttgaggcctagattcactcgcagcactgtcttatcctagagcaatcgaacagtttccggagtaggatttcctcatagttgggcagagcttttatggactcgggagaggacgtgactgattatgacattgctctcgtgtgctgtcgtgtgggtaaaagggcttggtgtgcatgggcacgatccgtctgcgtggagtttgcgtagctggacctgtgtccgttgtggggtgtttcagaatcgctgtctctgtcctccatgggggtggaatgcatcgcctctatgatggggtacgttcgttcaggtgttcggggcccgagcgtgtggtggaccttccggtggcgggcccctggtggggaggggcaccccccggacacttcaggggggcttgtcagacgggccggaacccgtgctcgtgggggtctaactctagggggtttgcccccaaaggggacc

SEQ ID NO: 718391 - DNA, 960 bp, Homo sapiens
  misc_feature (261)..(262): n is a, c, g, or t
tctcatttaacttttttaatgggttctcaaaattctgtggtgacaaatttttgggctcaagttgtgttttccatttaaaaagttccgtgatttttaaaaccttaattaactttaaaacgtgccacacgcaaaaaagaaacaccaaaggtggctccacaaaacatttcctccttttcctttcgtgaaaggtttacacgaatgcctatgtgttatatctattaacaccgagttcttttcactcatctaacatcttaatgtggnnccaatgtgaacaaccaacacgagcttcgtgagaacacgcgtttcttcgacacaacgtgaatatataagagaccgtgttgggagtgtggacaaggatatatatagggagatatacaatatatctcattatatagcgccttctctatagaagctattctctgtgagagccaagatctttagtggcgtagcacctttttggccaggctctcacaagacaacgcacttctctatgtgtctccacagtggtggcgctctctgctgtgatcatgagcacacgcgccacgaaacccgaacgaacatctgtgtgctaccgtggtctctcttcatattatcctcccagcagaaccaaacacgcacaaaaatgcgcggtaaccccccaaataagtggtctgcgccatattagctttctgtagagacacacggcttctctccaacacacacccctattttgcgcctttgcccccaaggggacacccccatgtttctccaccaacacatgtgggcaccaggctatctacatcaccgaaaaactcttctcagagacaattttttaaggggggccccaacattcttttccccaggaccctacctatatgcaaccccacggaacagccgggcggacacttccaatctccgtatttctccccgtttcaggcttctcacgcgcaacaccttgtggcctcgtgccaattgtgttca

SEQ ID NO: 718392 - DNA, 109 bp, Homo sapiens
cggtaccaatgcacgactaagagaacagaaaaatgcaggacctcggcgcttcaccgagagcatggttgtctttgggtgccccaactgaccacacccccattctccacat

SEQ ID NO: 718393 - DNA, 909 bp, Homo sapiens
taattagcctgatggattacaccaggtgtatacatgtaatgaaacatcacatgtgtcccataaatatatatattattatttgtctgtatttgtactatctttttgttaggaaaagggaggcatccaatcgtggtacaccgggggcggggagtagcgggggcaaggctcacaaaggaatcaaaaacaacacacacacatcgagacgagagaacaccccacggctgttaaacgacacacgaacgtagccagaaacaaacaacaaaaacgcatccaccaacgagcaaaccaaacagcgcatgcacgaaaacgaaacacacgaccgaacgtcaccagctcacccccaagaacgacggagcgagatacaacaacaggaagagggcagatgaggagaacgaaaatacgacaccaaagctgcggacacacacagatgctggggagacacacgccaaacagagcggaccagacacgacaagggagggcttacgggaacagacacataaaccaaaacagcaacgcagcctcaagagaagaacacaaaataaacaagagcgataatggccacccaagaaaaagctgagaaacaggagcgcaccgcggacggcactcgccatcgaacgggggcgaaacccaaaccaggatcctatgcttgtccgcagcagagagagacgaggaaagagccgaccgcgagcgcccaacccaggaagactctctgcgagaccgcacagcctcctccggaccgaacaacaaaagcggcaggcgacaagcaacaccgccaacagaagcagacacgcatcagaccacaccgcaccgcaggagaccagaagacgcacaaccagggacgaaagaccacaccgaaggagcagcgagcgcaccgacccacggggccgtacctccacagtaaccagccga

SEQ ID NO: 718394 - DNA, 527 bp, Homo sapiens
tccagtggcccaatgcctgcccaccatcctcaggctgtgtcctgcaggctgagcccccaccagctccctgcaaatacattcacaccctcctgcctgtggaatagcattcacggaggtctcattcagttctggaaagctagccatgttcactcgtgggaagttagacaaggcagaagcctattaagaaaaaaatcggccgggcgcagtggctcacgcccgtcatcgcagcactttgggagggcaaggcgagtagatcacttgaggtcaggagttcgagaccagcctgaccaactgatgaaaccctgtctttactaaaaatgcaaaaattagccggccgtggtgacgcgcgactgtagtcacagctactcgagagactgaggcgggagacccgcttgaacccgggaggcggaggttgcagtgagccaaggtcgcgccactgcactccagcctgggagacaaagtgagactccggctcacaaaaaaaaagggggtggaagtccgccctcttgagctcttggtaacctcag

SEQ ID NO: 718395 - DNA, 152 bp, Homo sapiens
  misc_feature (71)..(71): n is a, c, g, or t
  misc_feature (74)..(74): n is a, c, g, or t
  misc_feature (114)..(114): n is a, c, g, or t
acacggtcccttcgattggcgggcacttagaggtggggagcagagaatctcttatccaacatcaacatctnggncagatttgaactcttcaatctcttgcactcaaagcttgtnaagatagttaagcgtgcataagttgcccgccaatcgaa

SEQ ID NO: 718396 - DNA, 281 bp, Homo sapiens
  misc_feature (73)..(73): n is a, c, g, or t
  misc_feature (220)..(220): n is a, c, g, or t
  misc_feature (228)..(228): n is a, c, g, or t
ccccggcgaccgcttagccgctcctgaactcggcttccagtggggccaccactgaaaccggcgaccgtttccncctcgctgcctgccgctcggagtgtactatttcttgaacctcctgtccgcgggccgcaacatctagatcgtggaagagagggcagttgttttaggattctacctagggttggccgagaaaggaggagaaatacggtgtctgcgctangcgtgcgncccggggttagactttggtgcgcccagcggacgtggtaggtgggtgggtgggt

SEQ ID NO: 718397 - DNA, 504 bp, Homo sapiens
cccatgcacagttcaaactcaaagtatacaattcaggggtttttagtatattcagagtggtgccaccattaccacaatcaactttacaaggtttacatcaccccaaaaaagaaaccccatactaattagcagtcaccccttggtcctccccaacccttcagcctaagcaacaactaatcggccttctctctatatatattcgccggttcgggacatttcatataaatgaaatcatataatatgtggcctttcaggtcgggcattcttcactggatatgttttcaaggttttgccaggtggtggtgcatatcagtacttcatctctttttgtatggcggaataatattcctggtatggatatgccaggtttggtttattcactggtaagtggatagaaattagggcggtttcaatttggggctattataaataaggcggcaaagaacatcggtgcacaagttttggtgtagacatttgtttttatatcacgtgggtatccaccaa

SEQ ID NO: 718398 - DNA, 357 bp, Homo sapiens
  misc_feature (12)..(12): n is a, c, g, or t
  misc_feature (38)..(38): n is a, c, g, or t
  misc_feature (59)..(59): n is a, c, g, or t
  misc_feature (105)..(105): n is a, c, g, or t
  misc_feature (185)..(185): n is a, c, g, or t
  misc_feature (241)..(241): n is a, c, g, or t
  misc_feature (347)..(347): n is a, c, g, or t
cccaaacggacnccttcctaaccccttcccatggccanccctgttgcctccttaatatnaagtttggaacctgccgtggccttcccccggcacccccccttgaancaagcctcctacccctttgcccagcccagcccttgtgatctcctgagccttagggaagtgcctcgcacataggaagcacntcataaatattaatgaatataagcagaaattcaagagaagggtctagaaatgcagnaagtagaacaggattaagaatgtatgtgccatgcaatgtgaaactaggacatatatattatgggttgcaatgaaaattgttagaattttctcagaaagccatttgnaaatacatat

SEQ ID NO: 718399 - DNA, 245 bp, Homo sapiens
tgttccagaggatcccgtcgtcagcatcacggcaacagatgctgtgcctggagcggcataaagagccacccaaggagctggacacggcctcctcggatgaggagaatgaggactggagacttcacgtgtgtactgagtgccctgggccttggcccctgacctggggaaatggagtgtgcgcaacccgtctgttcgaccacgccgtcactgtcctgcgcccctgctcggcccccagtctcacctgc

SEQ ID NO: 718400 - DNA, 453 bp, Homo sapiens
  misc_feature (97)..(97): n is a, c, g, or t
  misc_feature (412)..(412): n is a, c, g, or t
ggcgatgaggtctcagcttcttagcctggcagccacaaccccttctctaggtggcccagagctctctttttattttacctctacaggtttcccactncacttcagcctgggagacagagcaagactccgattcggaaaaaaaaaaaagaaaaagaaaaagaaaaaaaatttaaaaattaaagaagtccacccttgccactctacccaggctgagctcattttcccttgtcgtttccaggacacattttggccctcagcgcattctgcctcatgctctctggagcagaccgagagagattctctgagacatagaactttcttttttttttttgagacggagcctggggtgacagcgagaccccgtcttcaaaaaaaaaaaaggggaaagctcggggcatgttggttacccttncatggaaactctttttgcgttatctccctaggatttttgag

SEQ ID NO: 718401 - DNA, 282 bp, Homo sapiens
  misc_feature (150)..(151): n is a, c, g, or t
  misc_feature (159)..(160): n is a, c, g, or t
  misc_feature (173)..(173): n is a, c, g, or t
  misc_feature (251)..(251): n is a, c, g, or t
ccaattgggtgagccatcaggcagggtgtaagaagcgcaagaggacatgatgcttaaggctctggctctgggtgtgaaagaatgaggtggaattgtagcagattcattcctgagtcaatctgtttttggggagggctgcaggattccagnngcctgccnnatgtgcaatggangtgctgccctctatatctctctgggcaccactctcgcctcaaacactatcccctggccacgtgtcactacacagggancagaagatttatctctcaccactctcacaca

SEQ ID NO: 718402 - DNA, 271 bp, Homo sapiens
  misc_feature (9)..(9): n is a, c, g, or t
  misc_feature (61)..(61): n is a, c, g, or t
  misc_feature (119)..(119): n is a, c, g, or t
  misc_feature (131)..(131): n is a, c, g, or t
  misc_feature (151)..(151): n is a, c, g, or t
  misc_feature (201)..(201): n is a, c, g, or t
  misc_feature (235)..(235): n is a, c, g, or t
  misc_feature (257)..(257): n is a, c, g, or t
agaagcgangctcgcaacgcggacgtgtttctgcgctcgcgtggtcatggaggcgctgcgntgcatagccgcgacaactccggaccacggccgccaccgaagcatgcttctgctgccgntactgctgttcntgctgccggctggagctgtnagggctgggagacagaggagaggcccggactcgcgaagaggagtgcactngtacgcgggtggacaagtgtaccgggagaggcanccgggtatcggtcgcgacacanccgtgcacctaagc

SEQ ID NO: 718403 - DNA, 916 bp, Homo sapiens
ggcgggcccatggaggtgggcgtgtgtacggactcggcggacccgatgtggagctgcactcgtgtgtgaacgttcactcgggcgccatcctggtcgacctaccgcgggggccacgcgtgtgtgacccccgccgcgccgtgtgctgctgcttccaaatggcggacgtatctgcctggtggcgcaggtggtccaagaattacgtcactcgcctgtgagctccagcgtgaagggaccagcgtccagacagaatgatcatgtagccccgggcctgtcaacctgtctgacgtgcatcagcccaagtggtctctacgtcgctggcaggagttgcatgaacgcattcacctgtgggaggtctcgcaccgggaaccttctggtcatcctgagtcgacactaccaggtactgtctcctgccttcagttcacaggggacagcagtccacttcatctcagcggggcaatggactgcctgtggtgctggtttggagcctctgcagcagtgctgcgatggccagatcctctccaggattccggcagccccaggacagtctggatctcatcatacgctccccatcagggacctgctctgcggctttgggggcccctgagccgggtggcacctcctcgctggatcagacggtgaagctatgggaggtctcctctgggggagctgctgcttctccgtcctctttgacgtgtccatcatggcaagtgaccatggacctggctgagcaccatatgttctagcgcgagggcagtgcagggctccatcttccaggtcggagctcttcaacgtggcccggacagaggcgagaggggcttccaccaagagcaggacgccgtgaagatcttcaacagggcacaggaaagcaggtgaattgccttgtcagttgtccacttgaggcaggttggtggtctca

SEQ ID NO: 718404 - DNA, 1850 bp, Homo sapiens
ggccctggtctgagtacacagcattccaggaagagagtctaccgctgctaccgtgcgctgctctcgtcgtcagtaggtggggactgcgagattgttcgtcgaaccgtaggcctcaatgtggataacggagcgactgcagcctctctcagagttcgtgagcacgtatctggagcgagcgatggccgacactggtcgagaggcccaacgagtcctgagacagcaggcaaggtgatccctttccttgaagcgagacagagcgttggagtgcctgtttggctcgttacataggacacggctggtgcatatgaactggcatcgatgaacaccatagatcatggaactagcgagaccattactgaggcatatatgacagtccgagccttggtgccaacccaggggtagacttgcgctcttgttaggaagcgctggggcatttgtcgaggtactacttgcgggtcggagaccaagccccttggtaccataggggggaagagcacgtccaattactatcttccttccggaaaggtcgctttgggtaaccgcacccgggaggggtaggatgctaagctctaattttccgcatggaccaattagcttctatatgagcacggtgggtgactttctcggacattgaataaacctgagaattgaggcgataacacccataactcgtcgaggtgcacgggcctatggacgggtttgtaggaagtgccctctagtgggcttggccgaggtcccataggccagaggccatcggggcaaggcaattggggaagcggtcaacccgcctgtgtctgtcgaaattgtaaacggagagcccaaatttgcggaagggacactatgcaggggtcgctggagctcgattggtctaaacccaggtgagcggtggccgtactccgccattggtgtcaagccatccgtatgcggaggacagtgggccacgtagagaacggttcggccgctttgcgaacattaagtcggctaggacaacctagtgaattgaaaccattctaatttcacccttggtaccgtaaccgcgtttgtcagagggcccaagtacgttaaggcgcaacgccacaattgttgccggaagatagactccagaccgggtaggcagcacacaaatgggcgacaaggaccaaagggggaacacttgtcatatccccctttattctgaagtgacggacacaaggggttgtgtttgccataagggacggtaccgggatgaaagcagggagatataagggcatggacgtggcctgccgaacgcctgtggaatgtccacgttaacagaacactttgcggtgagaggatgtgcgacgttttgttcgaacacctgagggtgtgttaacgggtgtgttacccagggggtggaaatgaggagaacacataatgcgccaaaagcgaatgaagaataacaataataaccggcgctataacgtgttggaagcaggggatttacgacaaatatagtaatattgagtggacaacaacgtggttaacatacgagggggggggcatacaattaagaagagacgagagaagagagttatgtagagtagagaaacgacgaagaagacgatgtcgaatataaaacgagcggagagacaacatagagcagaacaagaaagaatgaagtacacagatatgaaagtaggagtcggacagagcaacaactcacgcgaaacggatagatagtaagagcgcggacaacgacaaatgaaacaagaagaaacataagctaataaagtagaacatatatagaataaggagcagacatataccgatagatgaagtacagagctagatcagatcacgattattaatcagaacgcagcatcataactcaa

SEQ ID NO: 718405 - DNA, 265 bp, Homo sapiens
  misc_feature (60)..(60): n is a, c, g, or t
cccctgggccctttttggggcccctataaaaccagttttttccaaaaaacggggtgggcncgggccggaatttcccggaaattgggggtttttttccccaacccaggggggggggaaacccctttcccccccgggggggggggggattttttggaccgtttttccccctttttaacccacccccccctttttcccttttttggggggggggttttttttttttccggggaggtttttttcctttttaatggggggggaagcccca

SEQ ID NO: 718406 - DNA, 316 bp, Homo sapiens
ctgcctggattcagtggccaggatgtgaaagcaccgagaagaaggattacttccccacgcgtccaagatatgcaggcacgcaatgtggcagctctgactcctgcaggagaaggcaccaagctagggcgagtagagatagtgctgtgcagggcgaaaactctggtcgttagacctcctctgagtccaggaagcagagggaagagattcagcgatcgaccaggactccattatgccccactgccatgccagaccaaagtgtgctgagaggagaagctgcacacgagttctggatcttctccggaagatccgctatcga

SEQ ID NO: 718407 - DNA, 1146 bp, Homo sapiens
  misc_feature (179)..(179): n is a, c, g, or t
  misc_feature (692)..(692): n is a, c, g, or t
gaaaaaggaaaaaaaaaaaaaaaaataaaaaaaaaaaaacaaaaaaaaaaaaaaaaaatatgggcgtaaccttcccctccaaagaaaaaacccccccccctttccccctgggtccttttccaaaaattttgtgtaaaaaaaaaattggtgttccagcgggccctgcctgttagacaaancttgaggtttattagggggtgttaagcaacatccagttgtgtataagaccaatattaccgggggttttgtgaccccggtggccttataactcaaattctatgtccctataagaaagatactccgtgttcagaagaatagcatcggatgtcgcagagtgaaacatttattagagaaatctcctcttatgcgagggagaaaaccaggggagagagaaatatctcctcctccttttttatagaacaacacacaacgcagagagcgagcgggggcggcctttttatatatatcacacaccacgctagaaagagaattatctctctactaccacagagtatgtatctccctttttatatatctctcgtgtgccaccaacacacacgaaaggcgaggagttggtagatataaacagtgcgagcgcccaaatcacagagagtttgtgagatatcctccaggtgggggagagagccacaaaatttctatgtgtatgtgctcacccaacgggcgaaatatanacatctctctctcgctgagagagaagagcgataataaggatgatataaccctccctgtgtgctgatgagacgagagatgagagatatcacccacgtttgtgaggtgcggcgacaaatcataaatgtgcggagcaagaagaatatgaggagacaagaacacacggtaggtattgggctcctatatagcgtgtagggtgtggagaagagcagtctacatagtagaaagaacgttgtgtctcttgtgaagacagaaaccagaacttctttgggagcaaaagagtggtctcaacaacaatagagaggaatattgtgggggatgtttggggaagacaatattctctctaatatatattatacagacgagagatagggggcagcgtatggtgggacgtttttgtagagagcgcaaattataataaaatgtggcgcgccctacagaaaggggaagcatggg

SEQ ID NO: 718408 - DNA, 265 bp, Homo sapiens
ctccagaggctgttcccctggcttctgtgtctcctcttgatctctccacccgaatgcagcagcgcagtaagggtccctcctggacttaacagtttgggtatccccaacgaccgcagacctggtagcaaagcaaaagggttccttctattacttctgtgagtagcagccctgctctgaccatcgccatggccatgcggcggggacatcagtatctagcagcagcatcgactggtcacagggacttggcaggctccacgggccctgt

SEQ ID NO: 718409 - DNA, 325 bp, Homo sapiens
tcgagggtaccgactgcatctgtgcctcatatcaagtttcaaatgtctaggatcccacagacattttattttattttatttattttttatttttgagacggagtgatgctcttgtagcccaggctggagtgcaatggcatgatctcagctcactgcaaactccgcctcctgggttcaagcgattctcctacctcagcctcccaagtagctgggattacaggcacctaccacctcgcccggctaatttttgtatgtttagtagagatgaggtttcaccacgttggccaggctggtcttgaactcctgacttcaggtgatcagcctg

SEQ ID NO: 718410 - DNA, 157 bp, Homo sapiens
ggaaaggtacgctgtaactgatctgaaagcagagagaaggagtaataggtactttagggggaagagactccttgaaaggttacatgtggtggaaagtttggaggcaggagtggctagataaggcaagcgaggtgaaggcactttatgagcagtcacc

SEQ ID NO: 718411 - DNA, 651 bp, Homo sapiens
catttttggagggtcatgggtgtaatataacgggtcgtgaggccccgtcgggcggatttctcaagggcaagagttccagagcagtctggccaacactgcaaaaccccgcctttataaaattacaaaaattacctggatgagggatcaccagggtactacagggtcttcacgctgaaacgcacttggttcctgtcggcggcaggtgccgtgagctgggatcacaccactgcactccagcctaggcgccagaaaagtaagcttattataatcataatcccctttatcttcgtcgatacaggcctgatctcactgtcgtctttatcagtccggcgcattcagtttctctaccggtccggtccccgggcggacttgaaactgtgccctgactgctgaaatgaaaactcgcgcctccttgctacatcgcctcctctcggttcctcatctctggccggtccatctggattgcgtctaaaacttggtcgcccgctctcaccggctatctcttatttcactacggctttaccccgcgccgtatgtggcccacttggccattcccccgcttgtgtgtcgggcctaactctctcgctccgtgtttcgacgcagagctggcgccctcgcgggtactcccagttacatccgttctcacagact

SEQ ID NO: 718412 - DNA, 128 bp, Homo sapiens
ccaaagcatgcctgcccaccctcgctgtgccttagtcagtgtgtacgggtgtgtgtgtgtgtgtttgggggtggggggtggtagctggggattggcccctctttctgccagtagaggaaggttgcagt

SEQ ID NO: 718413 - DNA, 758 bp, Homo sapiens
  misc_feature (66)..(66): n is a, c, g, or t
  misc_feature (106)..(106): n is a, c, g, or t
  misc_feature (159)..(159): n is a, c, g, or t
  misc_feature (202)..(202): n is a, c, g, or t
  misc_feature (227)..(227): n is a, c, g, or t
  misc_feature (352)..(352): n is a, c, g, or t
  misc_feature (508)..(508): n is a, c, g, or t
  misc_feature (518)..(518): n is a, c, g, or t
  misc_feature (521)..(522): n is a, c, g, or t
  misc_feature (626)..(626): n is a, c, g, or t
  misc_feature (740)..(740): n is a, c, g, or t
ctcattctgtctgcgttccaggtgcttattattactgtgtcgcttgctccgcgccgcctcgtgttntctgttggcgcgctcgtccgggttcccgcctctgcccggnccttggggcttgccctgcccacctgcgagtggtgcttccgtccccgtcccccntgggcctctccacccctccctctgcggcttgtccgcgcccctncagccggtctttggtggctcctcancctcttgtcgcctctctgtgcttgctcttcggtcgctggtctcgccttctggcccagacgtgtttttcggccccactgaccctcgctttttgctacctccgttgtggtctggccccttctctgtntttctctgcccaccaactgctgtgagtgctccgcaggtctccccaactggttctctgtcgcgccagggtcgcgctcactccccgctgcacgtcttctctcctccataaacattaaacagctaaagtgtttgatctggcgccaattatctcctaccnaagtttaaanttnnccaaacattttttttcttaaaaccgaaaacacaaggcagtactaaccacgtgcttccagggaatggcctgtatctacccaaccactttctatacctctcttccnaccaaaagtcttaatatgggaatatccctcaccacgatcctaatactgtcagtagctgtcctgctgtccacagcagcccctccgagctgccgtgaagtgttatcagtctttgcnctacagaggggagatgca

SEQ ID NO: 718414 - DNA, 167 bp, Homo sapiens
  misc_feature (26)..(26): n is a, c, g, or t
  misc_feature (54)..(54): n is a, c, g, or t
  misc_feature (56)..(56): n is a, c, g, or t
cagactcttgcaagtgatagcctcgntgttgacattgtgaatttcagttttgcntnatccactttttttgctatttatttagggggtcgttcaacttcccacaaactgaggaatgaattccacgagcctgttctgaaaatgtggacgtaagacaaacacgtgctcgt

SEQ ID NO: 718415 - DNA, 981 bp, Homo sapiens
  misc_feature (76)..(76): n is a, c, g, or t
ggcggcgcccatcttgcggtccttttcctggggccggtggtctggtaccctaaatctctcagtattgttgcccttngcggctgcgctaaggcccactcgggcgctcaggggttactggcagcgcagcaacgctcgaggtctgcttcaaggacttcttcccggcagacggggacgaaaatagagctcccagcagcctcttcgaccgctggcccggcgagttttccccaaaccatttactgtgcgcttcgaccccacggcagactcgcttcactgctgcggctcatcctacttgcgcctgctgggcctgtctcattcgcagcgagcgggccacaacgctgactcgcgctggtggcgacggcgccacggccgcgccatgggagacccgagcggcccgtaccaacggaaccgcgaggcgcctgcgcaccaccagcagcgcgctccgagcccaacgcgccgagcctctgcgccctagcggccttgaggcccctgcccggctactcacccagccagctcttccacctgcatgggcgctcctggggcaccccttcccctgtgctggcaccctccggcctgcgctacccacaagcagccacctggtggacttcctgccggcccgcgcgcgggtccctcccccctgcggacgctgctgacccggcagagcgtgccgctgccgctcacgagccccgaggccttgaccttggccgacgttcttctcccgggtgctccaggcctttactctattcctctccccgctcttgcctccggccccctgcgccggtcgtccccgggcccccttccggccataccccaacactgccgccacccccccgcgccccgccccaacccgcccccgccaccgcacccgcgccccccgcgcacacaaccccccccggcccccgccgaccacacccgccccccccccccccccgccaccccgccccgccacccagcccccccccccaccccccccccccccccgct

SEQ ID NO: 718416 - DNA, 180 bp, Homo sapiens
ctctagaggatcctggtcttctacaagagcttttttttttcttttgtggagtctcactatgttgcccaggctgatctcaaactcctggcctcaagccgtcctctaccttggcctcctaaagtactaggactacgtgtgtgtgccaccatgcctggcttgataatacaaatttaaaaaaca

SEQ ID NO: 718417 - DNA, 227 bp, Homo sapiens
gaacaacggctaggtattctaagggcatttaaggttaacacactaggttcttttctttttattattttagttattattatactttaagttgttagtgtacatgtgcacaatgtgcaggttgagttgacatagtgtatacatgaacatagctaggttatttgctactcaagaattcagactagggaccagcagctgatggcaagttcatgaaactcctcaagctgccg

SEQ ID NO: 718418 - DNA, 382 bp, Homo sapiens
  misc_feature (61)..(61): n is a, c, g, or t
  misc_feature (83)..(83): n is a, c, g, or t
ttttaagttaaaaaagattttttttttgatttgtttttgagacagggtctttgctctgccnccttaggctgaaattgcagtgntgcaatcatagctcactgaagccctcagactccctgggttcaagcagtcctcccaccctcagcctccctaaggagctgggaccccacaggcatgcagcacccacaccctggccaacatggtgaaaccccgtctctatgaaaaatacaaaaattacccgggcatggtggcgggcacctgtaatcccagctactagggaggctgaggcaggaaaatggcttgaacctcggaagcggaggtggccgttagccgagatcacgccactgcactccagcctgggcaacagagcaagactctgcct

SEQ ID NO: 718419 - DNA, 448 bp, Homo sapiens
  misc_feature (37)..(37): n is a, c, g, or t
  misc_feature (59)..(59): n is a, c, g, or t
  misc_feature (80)..(80): n is a, c, g, or t
ctttgattaaaatggaagaaagccttcagatttctcntcaaacagcaaaaagtggattnaagtggaaagaaataatttantgacccatgaagaccaggctgctttaaaaatatacaggccagaggagaccaaaaaagaataaaatggaatgaaacattgcctgcttggccgggcgcggtggctcattcctgtaatcccaggactttgggaggcttgaggtgggtggatcacgaggtcaggagttcaagaccagcctggccaagatggtgaaaccccgtccctactaaaaatacaaaaattagccaggtgcagtggcaggcacctataatcccagctactttggaggctgaggcaggagaattgcttgaaaccgggggggtggaggttgtagtaggccgaaatcgccgcattgcactccagcctaggcgacagagtaagatgccatctc

SEQ ID NO: 718420 - DNA, 726 bp, Homo sapiens
caaggaagtcttttttcacgcttaaaatgggtccaccttgaacccttgcggtcaatctgtgtctgatgaggatagaatctctggatgtgcgctgtcagtcaagggtcccccaggcctcgatatcatatgggaaaagtcatagttttaaaacgttcaatcccggcccctgtgctgttaatagtggtgaaaatgtcatagtttaaaaaaaacaccgggacccaatgtgaccctgtgcaaatattggtagctgaaaatcttcaaggctactgatgggtggccccctaatcttgtctttgattgctgtgtgcagggaaaggtgtccccctttgttcatgctgttttggggggttggggggtatttgccagaatactccttttgacataaataggtcctcttgtcacgagatctctctaccaccacgacactttatatgctgagcacggagccaccactggagttgattgtagtccacctcaccccttgacgatggcacttgagcgtagctagcttatttccaatcactacgtgtttttgagcttgctcttacgttttaagaggtgcacggggtacaatttttgcatctgtgaattctaaagatgttttaaaaaacacttttcaccaaaatagtcctttgtcattacattatttactcatgtgtttgtacatttttgtatggtaatttatggatgattttttccagttaaaaatacatattcaaggaccca

SEQ ID NO: 718421 - DNA, 664 bp, Homo sapiens
  misc_feature (16)..(16): n is a, c, g, or t
  misc_feature (64)..(64): n is a, c, g, or t
  misc_feature (73)..(73): n is a, c, g, or t
  misc_feature (79)..(79): n is a, c, g, or t
  misc_feature (84)..(84): n is a, c, g, or t
  misc_feature (87)..(87): n is a, c, g, or t
  misc_feature (91)..(91): n is a, c, g, or t
  misc_feature (103)..(104): n is a, c, g, or t
  misc_feature (119)..(119): n is a, c, g, or t
  misc_feature (135)..(135): n is a, c, g, or t
  misc_feature (141)..(141): n is a, c, g, or t
  misc_feature (143)..(143): n is a, c, g, or t
  misc_feature (149)..(149): n is a, c, g, or t
  misc_feature (156)..(156): n is a, c, g, or t
  misc_feature (171)..(171): n is a, c, g, or t
  misc_feature (197)..(197): n is a, c, g, or t
  misc_feature (207)..(207): n is a, c, g, or t
  misc_feature (215)..(215): n is a, c, g, or t
  misc_feature (220)..(220): n is a, c, g, or t
  misc_feature (242)..(242): n is a, c, g, or t
  misc_feature (265)..(265): n is a, c, g, or t
  misc_feature (330)..(330): n is a, c, g, or t
  misc_feature (335)..(335): n is a, c, g, or t
  misc_feature (337)..(337): n is a, c, g, or t
  misc_feature (349)..(349): n is a, c, g, or t
  misc_feature (369)..(369): n is a, c, g, or t
  misc_feature (387)..(387): n is a, c, g, or t
  misc_feature (401)..(401): n is a, c, g, or t
  misc_feature (447)..(447): n is a, c, g, or t
  misc_feature (480)..(480): n is a, c, g, or t
  misc_feature (500)..(500): n is a, c, g, or t
  misc_feature (582)..(582): n is a, c, g, or t
  misc_feature (660)..(660): n is a, c, g, or t
gccacaaactaaactnattatcaaacacatcagttatttccagactcaaatagatacacattcnaccaataanctgagnaagangcntttnatgttctctttnnttttgctataaagcnttttttcttttgactnaatgcnangtgagntattgtnttttttctccttttnattgtcctcagaagatgcactatctnattcatgagnaatacgtnatttnaggtgtttttcttcttcctttnttttggggtctacaaccagcttntcttcgtggctgtgttattcgtggctgtggtattcgcggctgtctttgggaagttcctgactatnaatcncntcgggatgctcnttgctctcatcattagcttnccgcttatataatctggnctgcttgtggctgngggtttcagcactctggtcatccagctgactcgtttcataactgtncttcccacggctgtcccaatcagaaggcgcgtncaggtcctgggcaacggggntggccttgtatgcaccattcaactcctcgctttccatgtgtgtggtgatgtcctcgtctgtagcatcagggtactggatgtnagggctgcgaaacttcttagattttgacctcagtccataaaccacactatcacctcggccatcatatgtgtctactgngggg

SEQ ID NO: 718422 - DNA, 225 bp, Homo sapiens
ctgcggggtgactccatgcacacagactagaattgtagaaccacttccaggtcctatctagatgaattctaattgcataaccagtacctcggcaattgggacagcacatctactgctcctttcttacctcctctaccttcacatttgtcacaaatcacattcttatgcagagccagtccacttgtagcaccataatataagtcttctagaggtatactgaaacgc

SEQ ID NO: 718423 - DNA, 97 bp, Homo sapiens
tgcagaattgtggagtgtttttacattgattttttggtaatgcaattagcattatgtttcccccgtatgacttaataaatccttgaataataaaaaa

SEQ ID NO: 718424 - DNA, 117 bp, Homo sapiens
tgatgacccacccccaagaggaagtagaaagcatgacttgataatatatgccttgagaatgatttattaggaatgaaaactttctttaaataatgtaagtaaataagtgttacggtg

SEQ ID NO: 718425 - DNA, 756 bp, Homo sapiens
tgtgcttgttaaacacgatgcttgaaggcagcacgctccttaagagtcatcaccactccctaatctcaagtacccagggacacaaaaactgcggaaggccgcagggacctctgcctaggaaagccaggtatgtttgcttaagagaacttcagatggcccaggaggctgctggagccctcaaggaattcttgggcaatatcatataagagagaagatcgggtcagagcaacgacccccagacacatagctgctgctgatgacgcgttgtcttcaagtatcattcatcgtatcattcttatgctctgctacactgtccgtgtatcaggccaccccacctgataagacaatctactcggagaagactaggccaattacaaaatacagcaggttccacatgtggactacatagtcccacccacgggcctggggggaaaggccccttccacaaatccatgggcgggacacggccaagcgaagggaaccaacggttcaccatcctaaccaggcgcatggccagcaggccaaacaacgaataaggtcgcacacttggacgcaacaacccgaagttgcaaagcagaaacaatccccacgtgactcgccccccagcaacatgatgtgcccaggccgaaagacagtctggtgcaatccgacacgacgcgtgtgctgccaattctgcccggtacatcaccacaaccactgccttctcctataccacttttatcagctgtcaccctggcaacgatccaagaggacgga

SEQ ID NO: 718426 - DNA, 283 bp, Homo sapiens
gctttaaaatagccgaggtctggctaggttcatggagctgtagctggtggctacgccagagccatagcaatgtgagatccaagccacgtctgcaacctacaccacagctcatggcaacgcgggatccttaacccactgatcgaggcaaggatcgaatccgaatccttgtagactgtagtcgggttcgttaactgctgagccactacaggaactccaaattcaccttttaaaggtacagttcagtggtttttagtacatccgcaagatggcgtcggctaaattt

SEQ ID NO: 718427 - DNA, 215 bp, Homo sapiens
  misc_feature (17)..(18): n is a, c, g, or t
  misc_feature (90)..(90): n is a, c, g, or t
  misc_feature (96)..(96): n is a, c, g, or t
  misc_feature (123)..(123): n is a, c, g, or t
  misc_feature (131)..(131): n is a, c, g, or t
  misc_feature (141)..(141): n is a, c, g, or t
  misc_feature (148)..(148): n is a, c, g, or t
  misc_feature (150)..(150): n is a, c, g, or t
  misc_feature (154)..(154): n is a, c, g, or t
  misc_feature (156)..(156): n is a, c, g, or t
  misc_feature (161)..(161): n is a, c, g, or t
  misc_feature (163)..(163): n is a, c, g, or t
  misc_feature (181)..(181): n is a, c, g, or t
  misc_feature (199)..(199): n is a, c, g, or t
  misc_feature (201)..(201): n is a, c, g, or t
  misc_feature (214)..(214): n is a, c, g, or t
ctttttctaaataattnnctattacttgggtctttaaaaatatttgaactcacctttttatggtagggctcagggtgaataacttctgtntttctnttctagtctgcgaaacttgtatctgtnttaaaganggcacttganattacanangtangnatgangncttctcagatagcttttngtgagaaaacggaactgntntccagacgttctna

SEQ ID NO: 718428 - DNA, 286 bp, Homo sapiens
  misc_feature (155)..(155): n is a, c, g, or t
  misc_feature (236)..(236): n is a, c, g, or t
  misc_feature (254)..(254): n is a, c, g, or t
ccactgcgcccagcctgcttttgacttttacgacatcgacccttctatgatacatcactgaaactaaaacaaatggtggaagaattggtatctcatagaaacatttttagagaaatgaaaaagcagaaaagtcaagacaaattatagtgtatttntgtaaagttacacagaatgtgctagcctctcctgcctccccctccacttcttctgcctctgccactcctgagacagcaagnccaaccctacccttctgnctactcaacagtgaagataatggggatgaagg

SEQ ID NO: 718429 - DNA, 550 bp, Homo sapiens
ggcaccgaccccgcccgcaaggaaagatggcagtggcctgatccgggcccgttggcggctgtcactgacgcattactgctccggctccgtacggatcgcctgagcgtcggtggaggcatgaccgaactgtgaggctgcttgtcgcaccagttcctgcaggccgtcctggaggacactagagcaccgtccgtttggtgccctggtggtatttggattaggagccagggacctcacattcctcactctgcccctgcccggacccctcccagcacctggcccacaccctgcagcccagaccccatggtctggccctgggtgtgcgatggctgtccaggtggggtccccttcattggcctggctcccgttgctgccttctgtgcctcctgggggccagtccttctgatggacgcgtctgcaacggctgccaaccactcgtccactcgagaagacaagtagccacacacgggaggaagaacgagatcctgcccccagacacctgacacggggtgaagctggaccatggacgggcacctcaatcgcggcttccacc

SEQ ID NO: 718430 - DNA, 824 bp, Homo sapiens
  misc_feature (638)..(638): n is a, c, g, or t
gtagacatggggcggttttcgtgaaggggtatgtcccggagcgggaacagaggagagatgaatgcgtagtgtggtttggaataaatctgggctgttgctgaaagaagaaagattgctaaagcttccgtgtcagatgactaccgtaaagatgacaagatatacctcaaaggtcttcggaagaaggctcgtcgaaggtaattctagatgaattcgtctacaaaatgactcgtggttaccctccaggatgggtacattttatgaggagattaatggatgaagtgaccccagaacatttaaggtgtatgagaactcgggacgtcaaatatgtagaaatgaagagggttgcagaagcttaggaaaaatcgatagactacgatcagagctgccatctgtggttttccagggtgacgcaagagaacaagcttgtgtgctttttggacaccataaaggagttgatacagtctgtatgtctgcagtcatctgggaagaagtccggaggctagtcgacagagtgttcattaggccaggatagagaccttgggcatgaaagagttaagggagtaccatcagatggacattaagcgaatagctaatgaaagggaaaagcagtataggtgctgacaagggattggtgaggnagaattgtcgtattggtcagaaaattactcgcaagatttatggttaatcggaatggggtcagaagaaggggaacccggattatactccgagggggacagggggttgaaaacggttctgtccaaacagggggcatataatccacaaggggggggggcacaaaaacggggaacttggcaacccccgcg

SEQ ID NO: 718431 - DNA, 320 bp, Homo sapiens
gtaccactcatccagtgaaagatcaaggcaggacaatgagcataacgtaagcgagagggcgactatcaatgttaatgtgagaagcacattatcctttaaaagcctgcatacgatagaattattgcagcctagctaattcagaccgtgtgaaatggtgtcaggataaagaactgaagggctgaacgacttaattttcacttcatgtaacacacccagatttacaatgtcttaagtgcaccaaaaagcattgcttatagtgaagtactcatggtctctctgtacactaatctgccttactctttgggcgaacattcgatcct

SEQ ID NO: 718432 - DNA, 111 bp, Homo sapiens
tagaggtccccctagtttatgaagtttaatacagcaatgcccagccaaaggataatggggacgttggccaggactgcattcagatcctagttttagaagtttcaatagcat

SEQ ID NO: 718433 - DNA, 451 bp, Homo sapiens
cctcgtatccctctcgacagctccgactttaaggcactgtcatggcaataggctcacacctccgctcgtgcagcttgtagaacctggctgatctcacacttgttcacctccaggccacgttatgggcatgtagcccatgcccccgctgggactccttggaacttgaacatggatgagatagttgcaggaaaaggggcctctggaaggtaatcgtcaaacgtacctggattgacgctgtcaccctttgccacatgaggtaagacgagtgttaggtgtccagggtcacaagacagggcagcagccacacctgctgctgtgtgtccaagctcctagcagggacgagcggctacctcgcaggtgcttatgtgtcccacaagcgccaccttgccgctcactcaatgcggctagcagcccgatgatcacggatcttccccttccgacgagggcgaat

SEQ ID NO: 718434 - DNA, 948 bp, Homo sapiens
gcctactctttctggtgttagatcgagctaccctctaaaagcagtttagagtggtaaaaaaaaaaattactacccccaaaggctcgaggccaaaaaagggattgaaagttctcttctggaaattcctccggggttcctcccgatatactggagtcgtcttgctcctatagaggtccgttcgtagaaagcttataattttcccataaggaggcagcaagaattcagctcaccaggccgaaactggctggccgatataccagcgaagtggtggggaagctgggtaatgtcggtacgactgcacgtgccatattgaattgtggctagactttaaaaagcaaggagtggtttctacctggggatattatacattaagccattgtggactgggaggaatacaccagcttgcccatagacctgccaaggagaacggggctgccaaggggtttcacataccctttggtggcagtagactcgggcacggcacacacgacgcaacgagatttattaacaggctactgccaaaaggggaacgcggagaaatgcgcctgaaactcgggacaactgtaacggtactttttcacgcttacagctaattgcctgcgtgtaagtcttaataccatcaggactttgggttgggcttaccaccaaggaatcgctcaggatttgagaaacgacttttctgccacgatgacatcggtaccttgcgacattttcgtggggcgcttacaaaagggccaattctttgtctttgcaattggttctgatgtattaatccatggggccattactggctgcccttcgtggctatcgggaaggtttgggacaattgtcctggacccctatttaaacgggcgctattgggtacacccaagtttggtcttgcggggaatccttaaaactttggaagaggtacggctccctaacataagggggcaacaacctggttgg

SEQ ID NO: 718435 - DNA, 378 bp, Homo sapiens
tctctctctctctctctctctctctctctctctctctctctctctctctgctgagactgcctggcaacggctgatgccccaggtaggaccttttccatttcaaagtggtgttctaagtctgcgtccaacactgtgtaggaaaaaggtgggcgcaaaaatattcctgggcatccacccattaaaatagttagatgaggctattgccttgatgacagctgtccacactcctcatgaaataaacccgtttgccggggcatttccaaatgtctcactcgtgaatttaacccttcccccggggccttttcaaatgtctgaaagaggcattggggccttttagggggaaaatttttttccttggaaacccctgacccctttttg

SEQ ID NO: 718436 - DNA, 737 bp, Homo sapiens
  misc_feature (145)..(145): n is a, c, g, or t
tggaagtaccaggcagtgacatgccaccctggaggaggaagaggaaacgacgaaagcctaagatccactaccggtaaggaagaaacagctcatgaggctacggaaacaggccgagaagaacgtggagaagaaaacttgaccaaantacacacgcatcgtcctcaatgacccaccggactcctggttctgagcccaactaaatcactgttaacttcctcaataataaaaaacacaaaaacatcacaaaatacatcaaatataccaaagaaaataaaaatgcccgaacattatttgattcagggtgccctgatgaggaagagtatcacactcggtagatcagttcgagccgagaggcttgggttactgacaaggacgcacgcaactatctttgtgtatttgcaccccaggggcgttgaaattatccagcgggtcactgccgcctcatcattgggtattctcccttttgtccctatttcccttgacgcacctggggatttccggagcaatgtgtttgtaccaggggtctaaaactcttcagaaaaccttacctgggaagccccatcggaattggtgcaagatcgaaacaaagaagttgagggaatgattgaagtcctggggggctaggaagagctccaccaggggagggagccttgaagggcaaaatttgcaagagggagggatttctaccgaacaaggctggcagctttcaatccgccccagaaatatacgggccatga

SEQ ID NO: 718437 - DNA, 248 bp, Homo sapiens
aaaagccatttctactaaaaatacaaaaaatagctgggcatggtggcatttgccttactcccagctactcgggaggctgaggcaggagaatggcgtgaacccgggaggcaggacttgcagtgagccgagatcgtgccactgcactctagcctgggtgacagggcgagactctgtctcaaaaaaaaataataaaaataaatttaaaaagtatgattaggggctgtgctcaggtcctccaggagcttaca

SEQ ID NO: 718438 - DNA, 115 bp, Homo sapiens
gtgatgtgtcaagtgattcagtgattgtcaagtgatgttcaagtgatgtcagtgtcatagtgattgtcaagtgattgttcaagtgattgttcagtgatgggtacgagctcgaatt

SEQ ID NO: 718439 - DNA, 660 bp, Homo sapiens
aagctagagttcggctgttcggaaacaacttttccgttcatgttcttcaaagttttaacgtctataaatttggcagtttctactctcgactgtttgattttcaaatttgtttcaccatccaagttggcagtttcaatgtagcaaagaccctccggttccgaagatgacaaaattatggtatcagcaggaataggttcctctgattttactctaattatgtcacctacacgaatatcaatccatcgtttctcaacaaagtcatcatgtgcttctgaaaatatttctgctgtcgaattatttaattctttatcagaattagctctcttgatatcttcgatacattccttcatggcagaaacaatcaaaaccactaataaagtaccaattgtggtgtatctattagttggcgagacgtgaggcacctgttgaatggcagatgtacataaaaaaaacagattagcgtatttggaaaattcttggaacaaaaatttaggcagaaaggtcgcaaaattatacttggtggtagatatatggttgtcactatagccgaaggaggaattagcgagagaatcgttgatgtggatgactcttggttcaccattgccctctgcgtcgccaacgttctttcttaaaatgtaccggttgaaaagaattttaatg

SEQ ID NO: 718440 - DNA, 103 bp, Homo sapiens
gacgggagccttaacctccaactcagagggctccagatccgctctgaggtctttggagtacctcttgctcccaggcacagccctgacttttgagggctcccgg

SEQ ID NO: 718441 - DNA, 333 bp, Homo sapiens
acgagacacagacactgccctgtcacccaaacttatccctcacaccctgcgctcctgccaccacaggaagtgacaacatgacgaggggtggtactggcgtcgaggtgacagttcctgcaggggctatctgggaaatacctaggaggctccagacaaggccaggacctctcccactaccctgtggcaccagatcttccatcagggccggagtacatccctatagtgcctcaagtgccactctccctggcagccatcttgtcccctctatacctctagggagcactgtgcccactcttactgggttttcccagggaatgggcacacattatggag

SEQ ID NO: 718442 - DNA, 837 bp, Homo sapiens
gagagagccctgagggatcgccaaccctctgctggactggtgcctgtcaccgagccctgagcactcgagcccgagcgtgcggctgctgccctacagcctccagccagacgctccctgactggacattggccagtcctgccagagtgccgatgttcccagtgccactgccacccggggacccctgagaagcctgggtcctggctgtgtagaccccaggacctgcacttggcattcctggagccctccgggcactggacctcccagcactggtgtgccaagcatctgcaggaaatggagacaccttgcatccacggaacgccaggagctccagaccccagggacataggtgccgcaggaggctgcccatgttggaaacatcactattccgagctaaggcgaacgaacaactatttgactgggaacaacaactttgcataaattcatgaactcccctttcgaaggaaacgggtatgcccaggaacatccgcgatgggcctccgcacgagcaagggggttgggaatcgatgacaccgaacatcggtgagatcaccaacgccaagccaacaccttacatggatcattcaatcacttcaacacgcggtataccccggaatgacagaaccagcagaacccccgggacacaggagcaggagccacaggacacagggacaaccggcaacgcggcaaaaccctaacggacaagggggtgaaaaacccctgggcattccttttcaccagtaaggggccatacccatgagaaacggaccacacggaacgaggaacgacctataattctgggccccaggcagggccgcaaggacaccacatccgacaacg

SEQ ID NO: 718443 - DNA, 190 bp, Homo sapiens
taaggagaaacgtaattgtaagtagaacgcaattcggcgctcctatttttataactctacctggggaccgattaaggtgtcaacattttaaaattactcaagatatgggccagaaaagatgattatggcctttaaaactatgtggacataactgatgctatttaacattgggtcacagccattgtaattt

SEQ ID NO: 718444 - DNA, 137 bp, Homo sapiens
cgtcggatgcaagtgttctgtggtatagggtagggtgaagagtgtgctccatacctgtggagaggaacgcacagacatccaattttggagccgatggttctagcttagttggttttccaagcttttattcagacagc

SEQ ID NO: 718445 - DNA, 957 bp, Homo sapiens
  misc_feature (193)..(193): n is a, c, g, or t
  misc_feature (725)..(725): n is a, c, g, or t
  misc_feature (750)..(750): n is a, c, g, or t
  misc_feature (863)..(863): n is a, c, g, or t
ctgatcaggggtggcacgaagctgtgagtctctgcttctcctactgagtggtgttcccgagcgttgtgtctcgtgtaccgttttgccacacagtggggactttcgacagcgcttgggatcaccctttggttaacggctgggggtctcttcagtagtctaactccctttatgttacacagtggttggtcccctncgcgtacatagacctgtccggcctgtgtcttacctctcccggggtcccagtcccatccgtgtgaagaggtcccccccctgaatattcccccattacatgagcgagcactcgctgaaggcaggtgccgacatcacgccgcgcgaaggtgatgagcttgcccggctgccctacctacggacctggttccgcacccgcagcgccatcatcctgcacctcagcaacggcagcgtcagatccacttcttcccggatcccccccagctcatcttgggccccctgatggcaacccgtgacctacatcgacgagaatcgggaattccgcacattccgcctgagttctcctggaggagtacggctgctgcaaggagctggccaaccggctccgctacgcccgcactatggtggaacacagctgctgagctcacgctcggccagcaaccgtttcaaggcctcctaatagctgccctcccctccggagctggtgccctcctcactcccaccctgcattctggggcccatactggttggtcccncggtgccatgtctgcagtgtgcccnccagccccggtggctgggcagagctgcatcatccttgcaggtgggggttgctgtataagttatttttgtacactgttcgggtgtgggttctacacgccttgtccccctccccntcaaccccaccatatgaattgtacagaatatttctattgaattcggaactgtcctttccttggctttatgcacattaaacagatgtgaatatta

SEQ ID NO: 718446 - DNA, 224 bp, Homo sapiens
  misc_feature (4)..(4): n is a, c, g, or t
  misc_feature (54)..(54): n is a, c, g, or t
  misc_feature (69)..(69): n is a, c, g, or t
  misc_feature (148)..(148): n is a, c, g, or t
  misc_feature (174)..(174): n is a, c, g, or t
  misc_feature (192)..(192): n is a, c, g, or t
  misc_feature (212)..(212): n is a, c, g, or t
gctnatggacgagctggcaggcccaggcagaccgtccttggacttcccttctgnccccagcctgggagntccgacccacagatgcagccccaccccacggagctgccaggaccagacttactgactctgcggaagtctggggtcagcngaacgcactctctgccccaatgacanctacatgtggtcggcatnggagcactgccgaggggccnctgggacacagg

SEQ ID NO: 718447 - DNA, 954 bp, Homo sapiens
  misc_feature (193)..(193): n is a, c, g, or t
  misc_feature (725)..(725): n is a, c, g, or t
  misc_feature (750)..(750): n is a, c, g, or t
  misc_feature (860)..(860): n is a, c, g, or t
ctgatcaggggtggcacgaagctgtgagtctctgcttctcctactgagtggtgttcccgagcgttgtgtctcgtgtaccgttttgccacacagtggggactttcgacagcgcttgggatcaccctttggttaacggctgggggtctcttcagtagtctaactccctttatgttacacagtggttggtcccctncgcgtacatagacctgtccggcctgtgtcttacctctcccggggtcccagtcccatccgtgtgaagaggtcccccccctgaatattcccccattacatgagcgagcactcgctgaaggcaggtgccgacatcacgccgcgcgaaggtgatgagcttgcccggctgccctacctacggacctggttccgcacccgcagcgccatcatcctgcacctcagcaacggcagcgtcagatccacttcttcccggatcccccccagctcatcttgggccccctgatggcaacccgtgacctacatcgacgagaatcgggaattccgcacattccgcctgagttctcctggaggagtacggctgctgcaaggagctggccaaccggctccgctacgcccgcactatggtggaacacagctgctgagctcacgctcggccagcaaccgtttcaaggcctcctaatagctgccctcccctccggagctggtgccctcctcactcccaccctgcattctggggcccatactggttggtcccncggtgccatgtctgcagtgtgcccnccagccccggtggctgggcagagctgcatcatccttgcaggtgggggttgctggaatagtgataaatgtacattttaaaatctcaatatactttttagaaaaggagcccntcaaccccaccatatgaattgtacagaatatttctattgaattcggaactgtcctttccttggctttatgcacattaaacagatgtgaatatta

SEQ ID NO: 718448 - DNA, 920 bp, Homo sapiens
cggagtatggatatcgtcgacccacggcgctccgggcttgcatccgtcactatgggcaatgcttctaccctccaggcccccttctcccttagcctgtgttcttaaaaacctaaaacctcttcaactcacacctgacctaaaacctaaatgccttattttcttctgcaatgccacttgaccccaatacaaactcgacagtagttccaaatagccagaaaattgcactttcaatttttccatcctacactatctaaataattcttgtcataaaatgggcaagtggtctgaggtgcctgatgtccaggcattcatttacacattgatccctccctggtctctgttacccagtgcaactcatcccaaatcttccctctttccctcctgcctgtcccctcagtcccaaccccaagcgtcgctgagtctttctaatcttccttttctacagacccatctgacctctctcctcctcgccaggctgagctaggtcccaattcttcctcagacctctcctccatccagcctgtaatcctttatatcacactaccctcctcacacccggctccggtttacagtttccttacggtagactagacctcacacaactgacagcaagttcctacttaaacaacggtggctggagctaacaggcatagtcaaggtatcatgctccttttaccttaatccaaatcagaatagcgttaggcctcttattcactcaaatactaaaccccagtccagttcatggctcatatggcaagcaaccgtgagatgctttacacgcccgatgaacgctaaaaatgttcaaaaggctgtcttactctcaaaattaatatatttacccaatctgctcacagacattaacttaaactcaacaattaattccggccataacccgacactagcataatcacccgcttaaa

SEQ ID NO: 718449 - DNA, 475 bp, Homo sapiens
ataggaatccagagccaaagtatttcaggtactatctctatgacgatgacccctacaatcgtgtgtctttagccccactctctcctgacttgtgtatatgcgattgctactatcccatgtcacttgattgacagattcccctttccctgtctcaaacccaggtccgtcctcatctcattgaatggtaccaccatccattcagttgctcagggtataagccttggtgccattcttggattctcagtttgcctcatcacccacatccatgcaagccagcaaattctgttggctcctctcagtcctgactggcaatccacctttctgtaacatcaacaccctagtcaagatgatcactcttctcacataaattattgcaagagcctcttaagtggtcttcttgtttctgcttttgcccccatggttcattctccacacagcagccagaggcatcttttaagagtgtagctcaggtcac

SEQ ID NO: 718450 - DNA, 941 bp, Homo sapiens
aataggatctctctcacatgttcaaggtcgtcccagattgaggaagagtttaccaagttctcacatactagccccagtactcacatggagtgttaagctccaggcgcttgactagaggctgaggagatcatgttctacccctaggtgaaaagctggctgcattctgtgatggagttccctggagtgggcagaagctataaaagaccgagcattgggatttggatgtcctccatgtatgaacttctcgtgctctggacaattcccatgtaaggcttctcatgtcaccaagcagattgctgtgcgatgcctcctgtgatggttgacgaggtaaagtgccttagcgtttggcgtgctcgtggtttatcaacatgtggtactgccgatgggccatgcaccctcgagtatgccatgcgggctcgaacgtgtcacgcacacagggaacatcgcagtgatcgcgtcgagataatgaggtcttagtaatagtagagacaagggggaccactggtattgttgaccatgtttttcaaaacccgcaattttagtgtgtcgtaacccgcccgtcattgcaccaggggaatcctagggggatctcgttggatcgttgtctctgggtggagttttggtgggtctcacttcgccttgatggtccacgcttctgcttttcttgcgcccacaggctggtgtcgcgctcgtgggacatgtctcggggtagcgtggacgccgagaactcgatcacaagcattgggctcatgtacaggatgcaaagccgccgagaagtcgttccaggtgcacccattgtcggataaaattctgccttctggactggccacataagaaaagtctcttcatccggaaatttgtccccagccccccagatgggttcgaacaccagggcccagcttgggacggtaaacctctattgggctaatgtgggttcccct

SEQ ID NO: 718451 - DNA, 1603 bp, Homo sapiens
tcttcgtgtagtcgtggcgtgggctgcttccgaggggttcttcttggctgctcgtcgtgtcccttgtgtgggtctcccctagagggctcttggtctccccgatggttgtgccgccaggtgcgagagtgtgggctgcgctgtttcgtgttgtgcaggagcggtggttggattcttgctgcgttttatatgttgtgggttggtgggggcctccagagatcgtttgcttgttgtgcgccggttgtccctcggtgggaggtcccggagcactgtgtgttgaggggggagaggggttccagggtttttgtcctcaccccggggggttctccggagccccggttgtgtcgttggtccgggccccgtgttttcgggcgcaccctggtgatgtgggccccccggagcagttccctgggggggtcaccacagggtgtggtcgccaggaggtgggtcgacacggtctgacaccgggggggcgcgatgcaggttgtttgtgccgcgcgttggtgtttgccacagccgaacagaggtgtggcccgtgcgcacgttttgtttgcaccccacggacagtgtctcgggagtgggtgggggtcttatttgtatattggcgtgccgcggttggtgggcctcgcccgcgctgccccacttgtggcgccactctcctggtggggatgtgtcccttcccacaggtgtccacgcgtgtggggtggggccgtttactctcttgttgtagtgttctcttgtggagagagacccgttgatgtgttgctccctctcgcagtggaggggaggccctggggtgttgtccccacgcgcacacaggggtgtgatggtctgtctctgagactctctgttatcaacgaggggcgagggtcgcccccccccaccctcttgtggaggggtctttcacttctctctcgtgagtgagtaaactggttgtctccctctgggagacacacaactctgtggaagacccttctccgcgcgagaaagagagagtttgtcaccacagagaaccccgtgtgggtgagaacacccacacacacaggtgggggctccacaccacggagaacactcagagggagagggcccacaaatttttgttgtggtgggggaacaagggtgtggagcgcacaccacaggaacaataggcgcgcgccacttctattttttctctgtctgtgagagggcgcaactctcaccacaggcgcacctgtgaagctgtgagttggcccacactgtccacttggcgccctctccacaggggagtatgcgcctctgagttcgaggctcgcgcgccacagactgtggagaagctcccacagagaggacacttccgctgtaccaccgtcttcttcacacgctgttctggaacacatctcacctacactgcccaacggggccagatccgggcgctctcccaactgcccccactgagggcccccccatgccatgcacacctccgcgggctgtaatgggcccccagaccccgatgatttttaacacacacaaccttccttttgctcccccccccacaaatccctttgtaaatttcatgattggctttaaatgtaaggaaattaaggttaaatcccttcaagatttttta

SEQ ID NO: 718452 - DNA, 460 bp, Homo sapiens
atacagtgagagatgcgcattcaggtgggatctgcgcttcttcctccaacaatatggacgagatatattttggtcggcgagtgtgtcagctatcctggtctctttagtttatgctcagcacagttgccagtatcgatgggaggcgcgggttgtacacaggcttaactccaagactgtgttcgggagtccttggcactgtggtccatggtaaagtttgacagcattaccaggagagtgacaagggtgaggagttaggacctggcaatgtacagaaagaagtctcatcttcctttgaccacgttatcacggagacaactcgcgagctgatcgcacgttctgctgctaccctcatcacacatcccttccatgtgatcactctgagatctatggtacagtccatgggaagagaatccaagtcctgtggcactatcgagcatccataatacccatctatcgggaa

SEQ ID NO: 718453 - DNA, 1042 bp, Homo sapiens
  misc_feature (601)..(601): n is a, c, g, or t
  misc_feature (606)..(606): n is a, c, g, or t
  misc_feature (632)..(632): n is a, c, g, or t
  misc_feature (642)..(642): n is a, c, g, or t
  misc_feature (645)..(645): n is a, c, g, or t
  misc_feature (773)..(773): n is a, c, g, or t
  misc_feature (778)..(778): n is a, c, g, or t
  misc_feature (783)..(783): n is a, c, g, or t
  misc_feature (802)..(802): n is a, c, g, or t
  misc_feature (817)..(817): n is a, c, g, or t
  misc_feature (824)..(825): n is a, c, g, or t
  misc_feature (828)..(828): n is a, c, g, or t
  misc_feature (834)..(835): n is a, c, g, or t
  misc_feature (844)..(844): n is a, c, g, or t
  misc_feature (884)..(884): n is a, c, g, or t
  misc_feature (915)..(915): n is a, c, g, or t
  misc_feature (917)..(917): n is a, c, g, or t
gggcatgatgaggacctatgcacattaggcttgaggctgaattccggaggaccccctgaaccaaggcgccttctaggtactcatcatctctgaccctaggacccgatgccaaaggcccttcaatcatcccttgaacagttctcggagactcgagatcaggaaaaggggtccctgtgaaggtgaccaacgtcaaggatgcaccacccaccagacctccttggagctcttcatgtacctggtacgaagtcgcgggcaagcatggcagtgggccgtattgacatgctgtggagaaccgctctcatgtggaactcgaagtctccgagcgtatgctatcgagaccctcagtcaggcagccatcctgttcaccatagctcatgtgtagaccatcgagtgaccttcacccatggaccagggaagctgcgctagaaatccaaactaaggtcctgggctctgaaatattgactgagctgcgctgtatactcggttttctggcacacaccctgagtgctgaactttgtcagccatctgcatcgaccaagctcccaggagcgtagtggaacggtgaaagctgcaggtgtccagtcctcaagggccaggtgtncatcntcggccgggagtccccactgtctctntacaatgagnagntggtgagcatgaacgtgcagggtgattatgagccaactgatgccaccgggttcatcaacatcaattccctcaggctgaaggaatatcatcgtctccagagcaaggtcactgccaaatagacccgtgtncaatnagganctggggcctcctcaatttncagatcccccaagtncaggcgnnaantgttgnnataatttgnaattgtgacttgttctccccggctggcagagtagtggggntgccaggccccagctttgttcctggtccccntnaagccggcaaacgttgtcatctaaggtaagggtgggggtcacctccggtgggcagctataaaaatgccaattaaaagagacgtctagtcttttttttctaaaaaaccttaaataaattatagaca

SEQ ID NO: 718454 - DNA, 369 bp, Homo sapiens
  misc_feature (100)..(100): n is a, c, g, or t
  misc_feature (105)..(105): n is a, c, g, or t
  misc_feature (110)..(110): n is a, c, g, or t
  misc_feature (129)..(129): n is a, c, g, or t
  misc_feature (144)..(144): n is a, c, g, or t
  misc_feature (151)..(152): n is a, c, g, or t
  misc_feature (155)..(155): n is a, c, g, or t
  misc_feature (161)..(162): n is a, c, g, or t
  misc_feature (171)..(171): n is a, c, g, or t
  misc_feature (211)..(211): n is a, c, g, or t
  misc_feature (242)..(242): n is a, c, g, or t
  misc_feature (244)..(244): n is a, c, g, or t
tccctcagggccctgacgggctttcagagcctccaggtgtaaagggctgaaggaatatcatcgtctccagagcaaggtcactgccaaatagacccgtgtncaatnagganctggggcctcctcaatttncagatcccccaagtncaggcgnnaantgttgnnataatttgnaattgtgacttgttctccccggctggcagagtagtggggntgccaggccccagctttgttcctggtccccntnaagccggcaaacgttgtcatctaaggtaagggtgggggtcacctccggtgggcagctataaaaatgccaattaaaagagacgtctagtcttttttttctaaaaaaccttaaataaattatagaca

SEQ ID NO: 718455 - DNA, 511 bp, Homo sapiens
  misc_feature (42)..(42): n is a, c, g, or t
  misc_feature (80)..(80): n is a, c, g, or t
  misc_feature (100)..(101): n is a, c, g, or t
  misc_feature (136)..(136): n is a, c, g, or t
  misc_feature (142)..(142): n is a, c, g, or t
  misc_feature (186)..(186): n is a, c, g, or t
  misc_feature (276)..(276): n is a, c, g, or t
  misc_feature (380)..(382): n is a, c, g, or t
  misc_feature (385)..(385): n is a, c, g, or t
  misc_feature (406)..(406): n is a, c, g, or t
  misc_feature (420)..(420): n is a, c, g, or t
  misc_feature (457)..(457): n is a, c, g, or t
cgtcacttctaagcgcgcaggggtggccaatctccactcccncgcggactctgcctttcttctagaagttagtataggcntcgtgtgggtagggaccacnntgaggcggtatgggaaggggaagtcggttcacttncgcgcnatctccgcagaatatgactagaggtggggttggcgccctccccnggctctccgtgcgctacagggcgtagcccgagtctccagggcaagggccagatgccctgggacttagctcggtggagggagtgtatgggnatggggtgcggcgtgctggttctggcggctgcgagagccgctgccgccttttctgggcggcagttggaatacagaagctaagctcaccaaaatcctattggttnnngtntctagtgaatttcccagtatnatttttagagtagnctaccaaactaccctttcttaattaaaaattcattanaccactaaaacccctcccatgcactttttcttgcaaatcagatatttgtataaa

SEQ ID NO: 718456 - DNA, 203 bp, Homo sapiens
cgttcgtgcttaacgggatcctgtaactatccatatgatgctatatcacgatgtccatttcctctagtctcagctttcctctgcctgctgtctgatgcgcgctttgatagtcgttgttcagtatcatattgtctgaccggcgggagctggcgattccagctctatggtcacaggcccatcattctgaatgtgcaccagcacga

SEQ ID NO: 718457 - DNA, 174 bp, Homo sapiens
cgtcacaacgaatggctgtgagttacgactgaggatcaggatgatggatgccaatgatgaggccagcgtggaagggtacccccgtttgttctcagctgcactgtcatctgtagaagctccattatcttctagatgtagtgctatcttggtatcctcttctgtacgggacggttg

SEQ ID NO: 718458 - DNA, 1163 bp, Homo sapiens
  misc_feature (163)..(163): n is a, c, g, or t
  misc_feature (592)..(592): n is a, c, g, or t
tagggactaccgcaccttgtttgtgtatcaaaacgactaaagggtgccaccacaatggcgatatgaacaacatcttattgtgttgtgtgtttggggactatggatatgatttgatgaaaggccggcacaaaaatctatcctcgcccccaacatttctggaggncgaccaaacattcaacatgtacgtgcagagatgtgtaggcagcgcctcgtgccgctcatatagtctcttgtagtggggagcggagagcaactcatcctactatggagtgagcaaaatagcgctactcggcggcttcttgtgttgtcgccaccaccgtgttcgccgagtgagaaatcgtactacagatgtatgcgccgtctccaactgttcttgtacatcatctgttatgagggaaaacattggctcttctgttcctacacagcagccaccactgtgatgactacgtgggagggcccgcccaagcacaacaataagctgctgctgtaggtgcgtgcaacaatgctgcgggtaaatatgtgttgcggcacaacagccgcgtgccatcatggtgcgcaaacaaatactgcggagcagaggagcagaacatanacgcgtatggttcacccaacaagtgcgtctcgatcgcgcacgtgtgtgttcggggccacacacacccaaataggggcgcaccattgccgcgctctgtgtgtggagcgatgtgcacggtgtctatctgtgcacataagccacacgagaggggtatttccacattttgtgccaaattggagctgcgccaatatctggggcacacagatggacacgttgctgagatctattatcacacacattgggccgagaaatctgtgaggcccagtggcacccgacggagatcctccgcagacctttgcttgttaaatatgtcggttcttcctggcatagcgcgtgcccttccacgcattcctggcgccacaacaccctcgcagtaagcggaacatattttccaaaccacacttttatattccatcacctctttctacctatcaccacattcaccatataacaggaaacacatggggtcacattttcaaaaacttgaactaatttttaataaaaaaagataaaaaataatcgtcgatgcagtgaactcagggtccgaaaaagtatagtcttccctttttct

SEQ ID NO: 718459 - DNA, 132 bp, Homo sapiens
atatcgcccaacaccccattataaagtaagctcctttaaatatttgaacatggcaagaaggacataatttttcaaaaagagagtgagctccaagcaatccgtgactgtctgtcttattcatggtgtgtcgtg

SEQ ID NO: 718460 - DNA, 317 bp, Homo sapiens
acagtttcactatgcaagctactaattctccccacagctgtccagatttggcctttccaacattagttgccatttacaaatgtgtacactgattcaccatcctctctgtggataaatgtatgagtcctcctagggtctgcccattagtgcattagttgacaattattaggttgatgcaaaagtaattgcagtttttgtcattaaactaatggcaaaaacagcaattacttttccaacaacctaatacttggcctgcagaatgcacaatactagatcttcatccaaaatatcttttgagacattctcttaaaagttaa

SEQ ID NO: 718461 - DNA, 244 bp, Homo sapiens
  misc_feature (37)..(37): n is a, c, g, or t
ggtaacaaaaataagcaatggggaaaggactctctgntcaataaatggtgttggggtagctgggtggtcatatacagaagactgaaactgggccccttccatacagcatatacaaaaatcaactcaagatgaattaaagactcaaatgtaaaacctaaaacctcaaagataacctaggagataccattctgatttgacttttgtgcatttttggctggagtatctcgtatagatttcttcactg

SEQ ID NO: 718462 - DNA, 908 bp, Homo sapiens
gttcttccgccgctccgccgtcgcgtttcttgtgccggtcgcaaggtgcagacgagatctggcctgcgcgtggtctacttgacacattgcgctccggtcactgtgcatagagctggttttttggcttggggacagatcgctccgccggagccgtagtgtccattccactcggtcggggcgaccccaagacgaccacgtgggcgtcactggtgtggctactgtggaccgatgaagggacatccctacgatgggctgatagaggcctcgagagctagaggacggtgatgcatctctgaggccctgaagagtacacccaatttgaagcaatggacaagtcgtacactctatagcttgtgtgaacggaacagtggtatgcacaagaatgctcgtggcgaactcgaattacccttgtgctgatcaaatcgcacgactgtcggcggattgggcactcccgggtaggggaaatcgatacccaagggttggctggtcgtggacctggagggcctcgcattggtaaagccgccaaagggctcataaaaatgggaatgaatgaacacgaagtgtgaaaccttccaagcaactataattcaggtatcttggaggaatccccttttgctagaccaaacccaacactagtggtcgccaagggggtatagcggaatgggggctcccaatgtcccccgaggcggccaccgggaatggacaaattggggtaaacttgcattccgattaagcgcacccccattgctgaagtgggcgggccaacaacaaacaatgatggccatatattgtattccacgtgtgaatcccttccttgtggatcaagaaaccgggggggttctccaatcactacacaaccgggaatggcctcgtaagttctattactagacggtcgctaagagcagcga

SEQ ID NO: 718463 - DNA, 974 bp, Homo sapiens
atgcaggctggtacctggtcctgagagtttatggatccgaagccgatgccgagctggcgggcggcagcagcgcgcggagtgctggctggcttggcgcggtagcccatggtggctccgcttgtccggatggtgagtgccccagtgtgctggatgaagctggctgcatgcaccatgtcatcatgtgtctctatgccatgcccagcagcaacctgggccgacccccaggatgagctggggtggcaggggcatgcagctagcaagcggaaatgccagaaggccctgtgaggccctgctgtgggcctctcatccttgagcatccacctgggcatggagtccgttcgattgtggtcaccgagtgtgaagccggtgcttgtcgctgtaggaccttcggctttgggagcaggtgacctgtgaccccgtgggacggccgattggcacagcagagtgtcgccgcgcgttgaacgacccttccgtgggtacaccaagtggccactgtggccccatagtcgtcgtcccgggtcggccacacgtccatggatcaatccgtgaccaaaggaaggccgtgtgactccaccaatgagggcttgtttgccttgggacaagacccggggttgaggacagggcaccattgggtaccaaattgaaatccagggtatccgagccgttggcggaattcgttgggcggcccgggatacgcccgcattggccgcgccgttaagctttcgagctccctgtttcggaggacgctttcgcgccacctggagaaacgagtgatccccagtttccaggggagacgcagatcagtggatgagagatttagggccacacaccacaaggagagacagagtgggcaccacgggatatcgtgcatggataaggtgacaaagagggtaacgattacgagagcgggcaaaagactaggattcccgagttccacgaaagtaacagaaacagtggaggagagttaacaattg

SEQ ID NO: 718464 - DNA, 1422 bp, Homo sapiens
tgttagtcccacatgcgacagggtgggtggacgcggcagtcggtggtcccctgagaagtttgtgtttgacgcactgagagattcgcatcatataatcatgcacatagtagctctcgggagtgatcacgggtgcgagcctgcgcatttagctgatcctctggtattaaattgtgtgaggtactgtttttgagctagaagaagcactggcagtgttgtgcaaccaacgtgtatgggcacacggaagggggtgtcttccaaaactctccgctggtgccttcgagaggttatttctccgcctctatgcctgctaatatgcttgtgcgcacaggtgggcgtggcggagtttatcaccacggcggcggtgtgatggctcaccgtcatatagtattgtggggcccctcttgcgcagaatttcggttgttctaagacgttttgaaaacgggatgtttgtggctatggtaaggatgtttattgctcccgagtctgaaagtgtgcttaccgatctcggggaaaaaatgtcgggcgcacagtatagttggagagtgttcacaggggagagggggggggatagtttagagttagcccttggttccaagaagtagtgcttgttgggagacaagtagggtgcgtgtgtcgccacccgcgatggtgagtgtgctcgtttgaagggtttgtgtggaggtgtctaagatagcgcgaagtgttgtttgcatgggagaagggggtttagtcttgtcgtgtttatatcgactatggtctatatagactggagtgcgagactgttatgccccatcgggaaattgggggggttcccacggttctccaagtggagcccttttgggggggtatccaaagtttggtaaaactctctatagaaaagtgttgtaatctacaactttttgggtgggacaacgtttgtggggcgatgatataaggtgcacatttgtgttgacctgtgttcgagagacgtgcatgttttcaattggccacgtggtttggggttatatcaatataagatgatttcaaaggagagagttatattgtagtaaaataccacctgcccttcttggggggtgcactgtgaataagaaagaggagtgaggagaaatagagtgagaaaaggtgtgcctgagaagatatcgggaggagcacggctcttcttaccttgtccacaagaaaaatgaaagcggattggaccgaggctgggaaacctcctttagccacgagtgctgagctggcacctggtggtgttttggtttcgtagcacgtatccacgcacaatagctgaggcggctgggtggtttcagtcttgagaaattatttttggtgccttcatgtttcactgcaatctttgtgtaaatttttcaaagatttgaagttaaatcaattaaattcatttttaccaaagaagaaaataaaaaa

SEQ ID NO: 718465 - DNA, 619 bp, Homo sapiens
tatgaggccgccaccgcagaccccggacggggtgcgcctgaccggcaactgcgctggacccgggcctgggaaagaccgagtccagtccccatcgtcggacgagtagggtgtcaccaacgaagccatccattaacagtggtctcacttccttcatcaacgagacatggacaagcatgacgccatagagaagaatccagcgccaatggaatgagagtgccgaggcccgacctgcgagtagctgatggagaccatgcaccgcatgagccacctcccacccgactttgagggccgccagacggtcagtcctatgttggctgcagaccctgagcggcatgtcggcgtcagatgagctggacgactcacaggtgcgtcagtattgctgtatcgacctgtgagtcaggcgctgagcgaacgcctttcaagccgcttcctgcatgcctgagtcccggggccactaggcgccttgtctacagaatgggcagagtctgaggcgatggctcctggtcccctgtccgccacacaggccgtggtcatccacacaatttcactgtctgcagcttgtctgtctggtgtctgtcctttttggctgtcagaactttgggggccgggcccctcccca

SEQ ID NO: 718466 - DNA, 1686 bp, Homo sapiens
caaacacatacaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtctaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgcgcaacatggcgaaaccccgtctctacaataaatagcaaaaaattatcctggcggagttatgcacgcttgtagtcccaactacctgggaggctgaggcgggagaatcacctgagcctgggaggctgaggcgggagaatcacctgagcctgggaggtcgaggctgcagcgagccgagatcgcgccgctgcattccagcctgggtgacagagcgagaccatgtctc

SEQ ID NO: 718467 - DNA, 406 bp, Homo sapiens
atgagagcaaaggtgttcagatactttgtctggagagaggagcctgtttgtgatgagacaagacatgtgtgtgccgtggccaagaatcagggctgcgaacatatcagctagtctgggaatttggctatttaggggtgagttaacagagcatctactgtattgtcaaattacctggagtgagatagctttgtttctgaaaccctaaagaataccactctcagtctgtagggatacctgacctcatgggaagcttactttgaggagggaatgtgggaagtattgttagaataatgccctattcccttatcagtaatttctgccttagcagagatgggcattagtctgacataaagcaatgaaaatgctacagtgccttttcaattttttttaaagagagacttagcaa

SEQ ID NO: 718468 - DNA, 438 bp, Homo sapiens
gaccaaacaaacaaacaaaacacaaataaacaaacaaacaaagaatagctttctcatgacattgactactctgcctctgagcctctatttatagaccttcaatccatccaaccttactcagattgtgctaaaaggaaacagggcttctaaaagagtctatcgggctgggcatggtggctcatgcatgtaatcccagcattttgggaggctgaggtgggcggattacttgaggtcaggagttcaagaccagcctggctaacatggtgaaaccagtctctagagaaatacaaaaattagctgatcatggtgtgggtacctgtaatcttagctacttgggaggctgaggcaggagaattgcttgaatccagaaggcggaggttgcagtgagccgaaatcatgccactgcactccagcctgggtgacagagcaagactccat

SEQ ID NO: 718469 - DNA, 1032 bp, Homo sapiens
  misc_feature (1032)..(1032): n is a, c, g, or t
ccacgacgtccggtcggaggggccccctcaaggtgcatcctggcgctacagctggagtcaccagtgtggttctcctctgacttcacacatgcgtacaccctatctccatccagccgttctgagcgcttggggcttggcagttgcccttcgatcgagcatctttgctcatggcttctaagtttcctgggtatgagcatacgagatattggccgtatgagcgaaccagtggatggtcggaccatcgatggtcccaacgatggtcctcaccaacggtgagtacagaccacgctgggagcacacgagccaccaagcagggaagcaacaaaagacggcaacgacgtagcatggacccgtcgacctgctgtgggagaagttcccgttgcccaactactcaagtctcgccactaatccacgcacttgtacatctcgcctctctatcccgtcgtacaagatcttcgctatgggtaagaacgcgccatgtgggacacgtagggggcagcgcggccaatcagtggtagcactgctacccttatggtttcaattaggtagctccaattcctagagtggacataagttacgcccattgataggcctcccaaaaacgccagaaaacatagagagagagagagcacagagcaacgcgtgtgcgagaggggcaccgccactctgtagagaagagtgtttctcacactagtgcgaaaaggacgggccccacaagtgacgccatagtacaacgcggccagattcagccgcaacaaaaggatatagagtcggtgtggggctaccccaaaccagggggtgggggcgccacccaataataataaagacgaggaagcgcctcgagaagtgagataaaacaataggaggcgccaataacagcggccacatactagtggaggcacacggcgcgaacacggtagtagcacaaccaacaggcgcggaacaccgacggcgtacgaacgcacatggggggaggcaaagagagacaagcaggcggccataacgcggcgcgataagggacaggagaacgcn

SEQ ID NO: 718470 - DNA, 225 bp, Homo sapiens
  misc_feature (51)..(51): n is a, c, g, or t
  misc_feature (63)..(63): n is a, c, g, or t
  misc_feature (97)..(97): n is a, c, g, or t
  misc_feature (207)..(207): n is a, c, g, or t
gcgaaagctctataatcacttgcgcccgctcataaggggtatggccatggncttaggtttatnagtatagttgggtggtctggtgtaaattgagtgnaggacaggagctccgagagaggtatagtgtgtggcaattaaaaatgattaagggatacctagtattaagagatcaggtctcgtcctttagtggttgtgtatgggttatcnatttgttttgaggttagg

SEQ ID NO: 718471 - DNA, 131 bp, Homo sapiens
ttgctccgggactcattcccttcccccccccctattttaaagttttatttgggtcgtctgtatcaatttagaccgagataaattaagccaaagaaagtaaaataaatcgaaataaaatataggaatagcta

SEQ ID NO: 718472 - DNA, 191 bp, Homo sapiens
  misc_feature (12)..(12): n is a, c, g, or t
  misc_feature (20)..(20): n is a, c, g, or t
cattttgagcanagtctgtnagcagtgcccttcctctcccacttgtcaagatttcccctttagcgtgcttgctcctcaccccacctgtacctccctatgtccccatccttgcccagtctcgacgtgcaccaagggcacaagagtggcagtccagatctgccacttgttttaataaagccttctctctcacc

SEQ ID NO: 718473 - DNA, 120 bp, Homo sapiens
gcacagaggacgtgcacctccctgccctcctcctccctgggccttcaccgcaccccatttgcttaagtgctcggaaccccgtcacctaattaaagtttttcggcttcctcagagaaatga

SEQ ID NO: 718474 - DNA, 233 bp, Homo sapiens
cgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttga

SEQ ID NO: 718475 - DNA, 759 bp, Homo sapiens
  misc_feature (394)..(394): n is a, c, g, or t
  misc_feature (683)..(684): n is a, c, g, or t
gctgttctagaggatcccatagcgacgacgtacattacaggtgtgagcatgcacctggactgggtcttcatttctgaaggctctgatcactcaggaaattacaagtgttttaggagctctgtgtaaggaaccagacaaagaccaactatctattggacaaagaccatatatgtatttctcatcacatgctgtgttttatgtttctcctcctcatgcaacacagtgcttctcctcatactgtgcatgcagcactccttcccagagcctggcagattgtatcttgacctcattctggccatcttggcactggaactcatctgttccctgatatgtctcctcatttacacaggtgagaattacaacgagcctgttcttataggaacttcgaactgcntcctttcctcccagtttaaagtatagcccattagcgacaaggaagttctctgtgtatctgagtggtgaccacatgcagacttctttaatttcaaaccaacaggaaggtacagccaccaccagtgagaccccattcctttaagattgtgtcattaataaatttttgttaatgcaagtgaaacttttccattaaaacaagacacaaactttttgggctgggaatggtggctcaagcctgtaatcccagctctttgggaggatgaggcaggaggatcacttgagctctgganntcagaccagcctggacaactgatgactccatctctacaaaaaatacaaaaaagtagccacgtacgtgtcgctatg

SEQ ID NO: 718476 - DNA, 1299 bp, Homo sapiens
attctagaggccgaggcgggcggatcaccaggtcaggagatcgagaccatcctggctaacacagtgaaaccccgtctctactaaaaatacaaaaaaaaaaaaaaaaaaaaaatttggcgggggggggggggtgagcccttattggttcccagttactccaaaaaaaaaaaaaaaaaaaaaaaaaaaggccaaaaaggggggaacaagggggttattattaataaccacagatggaggaaaattgttaaggagggcgggggttgtgggacatctgttttacaaaaacttataagagggagaattttcaacacagatataatgatgagggatgagggacgggagactaatgtgtagaataacaagatttgttgcagcaaacaccgggaggaagaaatagacccccctctataaggggaggcgggaggcgagacaacaaaagtcttcctcacacaacaagcggggggccacttcatgttgtctacaaagcttttgcgcaccacaaatgtgggagcaacaaagacgaagcgataacaaagcggcggtacacaaaaaaacagcaggggatgacaaaccccccacgtggtgggcagatgggaagataccccaactgtgaaagcgagatcacacaactcctataaaagcagagaacaaatgtcttagcgacagggagagaagagggcgaaccaatatgcgacggaagagcacaccacgtaatgtgggcaatcagggtgggggcgacgacatgcatatcacaccaaactggggggggcccaaataaaaagcgtctctcccacaaacgaggggctgcacacaggaagaaacgactgttaacaacactgctgagtaaacgcgggaggagaagtgagggggagaccaccccgcgggtagtacaccgacgacaacttgtgagacgaagcgcgacagtcggcgggcagcaccaaaagaggcgtagacagtagctacgacaaccacgaccgtgggccacgagtgtggtggaccaccccgcgcgggttcaagtagaagaccaacaacaacttcagaccgcgaagatggggggacgcacccacagggagtgcgcaacaaaaatcggcggcgcggcggcggcaacaaacagtcgtggcaccagtgtcacgaacagtagtggtgtgaggcacacaatactgcgccgaaccagtccccccgccggggtgggcaacaaacctcggcagaaaaagaaacaaacaaaccaacacagtgggaggcggccgcgacgaagctcgtaacactacggtgacagcagcgcagacacagacgacagtg

SEQ ID NO: 718477 - DNA, 1188 bp, Homo sapiens
  misc_feature (1188)..(1188): n is a, c, g, or t
gctgcgggatgctgaggcgctggggcagaggctcggagaggtaggctgcgatgggggaatgtctgaggtctgagggaggagtgctgctgagcgaatgtggtacgtatcgaggtcctgagaccaagaggggatcgcgtggtgcgtgaatgcgtgcatgtggcgtatgtttggcataattagctattatggatcaaggccagccaatgaagcctcaccgaatccgcatgactcataatttgcatgctcaatctatggtctctaccggaaaaatggaatatcgtatcagccctcacgagaagccaatgctgaggagatgaccaagttacgcacagcgatgacgtacacttaaattcttgcgctccatccgtccagataacatgtcggagtacagacaagcagatgcagagattcaagcgttggtgaggactgtccagtattcgatggtgctgtttgagttctgtcagttgtctactggtggttctgtggcaagtgctgtgaaacttaataagcagcagacggacatcgctgtgcaattgggctgggggcctgcacatgcaaagaagtccgaggcatctggcttctgttacgtcaatgatatcggtcttggccatccttggaactgctaaagtatcaccagagggtgctgtacattgacttgactattcacaatggtgacggcgttggaaagagggccttctacgccaaggaccgggtcattgaattgtgtcctctcatacaggatatgggcgacgatctttccccaggatcttggggacctacggggaaatcgaggctgcgcaaacgggcaagttttacgccgcgtaaaacaaccggaacggaaacggctttgtgacaagatccatcatgagcaccttgtaagggcgctatatccaatatgagcgaagtattcacgccaaagggaggagctacaacagaggaggcacaagacaccactctcgggggaatagtgagaagatgcacagcacaaccatcgagcagaccacacgaggtgtatactcttattgacacgagccgcctagattatgggagcggccaccacacataactgagggacataaaatggagcatgaataatcatcagacaccatactaaagtgaacccgctcaccggacagagacgattcccccgtgagacactaccagactactttcttgtattaccgatan

SEQ ID NO: 718478 - DNA, 236 bp, Homo sapiens
aatagagcacacacatggtcacccaacgaagcaaggcgtccctgtaaactgtgcggctgactcattggggacaacaccagggctgacctgagaaaagggcaaccagtactcccagcgatgacttcgggtcggcagaaggaaaagacctgagcgctaagagcatgagatacgagtcaggaccatccttaggggaaaacgactgacaagagagagggagcgcaggccgagccgcaacg

SEQ ID NO: 718479 - DNA, 962 bp, Homo sapiens
gggtcggggggcggggaaagggaggcccactgatactgtgtatctcgttgttaagaccctcaagtaacaggatcatgttatcatccatccaatcagtgactgcgtatactagttgatttcgaacagttcacattatgatgaaacactctcagagaaatgaggaatagaagttatgtttcctcaaccacaaataacaggccatcatgaacaaaaggcaaagctaagcatgatactgaataaggaaaagcgtgaaagcttttcatctctgagatccggaacaagaacataatcatccccacattgcagacccttcttattcaacaatagatactggaagtcctagccaaaggacattatgccacgaggtagaaaatagaactcaatacctacgtaaggcaacagagacgcaagttcgaaatgtgtctctggatatgtgagacagacactcaaatcttcatattgatggaaaaactcttaaactggtaggtcacgaaaaaactaaaataaaaaacgtaatacaacaaaatactgttaaacttgcagaaaatcagcagacgtaagcagactgactgtattgcttgatagaacaaaatctatgacaacatacagttgtaaaatcccaaatcaataactaacaaaaaatgaagtaattagtggaagtgaagacataatcatagagtgagcgacttacacatgcaccccgagaaagagcgacaagcagcgcaaaaccgccacaggaaatcatgctccagagatccagagacatatcaagcaacaggacaagagagagaaaaaggagaagcccaccacaacagcaagcggagaagtggaagcgaggtacagaatgaaaagacgaacaacagaacaaaccaagaagagacaagacacatagaaggtaacaacagcaaaaaaacaacaaaaaaaagaagacaaaagaaagaggcgcacaaggaagagaacat

SEQ ID NO: 718480 - DNA, 87 bp, Homo sapiens
tccaatcacacttggtggaaaaacatttccagggactcaaaattccaaaagggtggtcaaattcgggaagtaagcatttccgtcttt

SEQ ID NO: 718481 - DNA, 308 bp, Homo sapiens
gaatgttggggatatccctggatctactctgatcatcaaccaggacccactgggataattctcagcaatattggaatattactcgactctgtgacgtaggcgatcagagattcgcaatgagtcctctgcgtcataagtagcgatcaatatctagtgtaaagttcagactgtgtcaggcaaatcgcagagatcatctcagttgactaagcaacgtaaggagagcagtgttgagggggcagagaactcagggggtccttgggaaagcaaaggtcatataaaattactgcaggtacttacctctccttctg

SEQ ID NO: 718482 - DNA, 117 bp, Homo sapiens
ttggaagcatgcaggaaatgcctcctacattctgtcgcccaccaagactaagatctttgctgcatgtctgactgacagagctgtaagataataaattcgtgtcacgactttgtgatt

SEQ ID NO: 718483 - DNA, 197 bp, Homo sapiens
atctttattagggtgtagttggtgcaatgcttcgttgtatttagtcagcgtttacaagactaggtatggatgtcagagtgccccaagctggcgttcttgtcccttcctgccccacaagctccttttcctgaatttcctacctaaatattatccatatgcctagtctctgaaactcaaaacttggaccaccctcctgt

SEQ ID NO: 718484 - DNA, 110 bp, Homo sapiens
taagcggtaccatcattacccgattgcacacgcggtgggagagccggggagacggtgtagggtggggagaggtgcgaggttggggagaagcgactcttccggacaaggcg

SEQ ID NO: 718485 - DNA, 311 bp, Homo sapiens
tacttttccacagcggatgatcatattctttctacgtatagtggaaatacaaaacgtaagcgtttaaaccaaggtgaaattatgctcttaaacattaagagagatcttatttcttttggcttagccaatcaataaatattcactatatattccatggagagcatcataatacgtatgcctctgcaacgctacagaaatctataactaagttactcaatctttcattaggccatcagccacacaagtcagtatttctaagctcttctacagaggtactcccagcactacaggagacgtttatatgccctgtg

SEQ ID NO: 718486 - DNA, 325 bp, Homo sapiens
gacgagggctgcagcggtatatctgcattgaagggttgccagctcactcgcttatctttggtcccagtttgatctgacagtccgcgtctctactgacgatcttatcaggttcatttatggaggagatggcttaaatcctgctgctatagagggaccttacgacactttggggtttaacaaggttctgggcaacattagcccatccttcccgtgtcccagtcagcctgctcacaggaacacccactggatcctgacaacagactccatcatggtgaagagtgagttcctctgctgccaggacagtttcctgcacgaaataaccaca

SEQ ID NO: 718487 - DNA, 404 bp, Homo sapiens
ccttttaaattatttcacttattgaacagatattagtgaacttctaggtgctgaggaaacaacaaagagcaaagcaaagtccctgtcccccaggagttcgcgtttaccggggaagaaagataagtcagtccaatggccccttgtgaggacatggagcagttagaggtttggtttgcaggtagggtggtgccacgatgctagcgtctgtcacgccattagagcctgtggtagtgaatagccaccttgtgggtgtgtgagccctcattatgccagcttgttccacccctctttcatcacctttcggtatggtggaaataacccccgtccccaagataacagcataggtttttttcatgttgcagataaaagctttagccactttacaaaaggtaaaatgtgcttaa

SEQ ID NO: 718488 - DNA, 103 bp, Homo sapiens
ctgtacccatgaacaaaaacaatctcatagtgatatgatgtaacctctacctcccaggttcaatgctgattctccatgcctcagcctccctgatgttgctttg

SEQ ID NO: 718489 - DNA, 808 bp, Homo sapiens
tcttgccgccagaagacagggtgtcgtgaaaacttaccccgtaagacgtccatactcatgttgacaaggacgaagactcatatcaacattgtcgtctacttggagagcgtagatacgcgcgcgaaggtccaccagtacgtgggccatctgagtctataaatgcggatgcgccatcgtaccaacagaacgcatcgagaagaatctggacgaaacggagcgcgagcgtgagtagatgggtacaccgtggcttccttctcacaggataatgcacgtgaggttcgtaggcaatagaacgtcgaaagcctgaggcgtgcaacgtggtgctcaccacttgatagtctcgcttgtttggaaccgtttgactatgccagacaaggtactaatgtgactactcaatcgagtgcgcccaggaacaccacgagaacttgtgtcataacaacatgacttagcagggcaacatgtctcagcgtttgacctgtgactgtcctgaattggttgctgctggatgattggctgacacttgtgatagctggctagtctccagagaatggggcgataagcctagtagtcagtgtgcctcttcatggacttagcatcactgggtgatgaaggagaaccgtaattgtcgggtgttaccaagagagtggacttccacttgagccaccctacatgtccagaagagagtactgacggaacattgctgaacggagagtcatcacttacgattctgacaattggggtacaaccccggacgacacgtagccattgatgccaaattcgtggttggaatggtgacaacttgcgtgga

SEQ ID NO: 718490 - DNA, 4450 bp, Homo sapiens
aatgctgacttctctacatgggggacaagtggatctcagggactatctacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactc

SEQ ID NO: 718491 - DNA, 491 bp, Homo sapiens
  misc_feature (85)..(85): n is a, c, g, or t
  misc_feature (97)..(97): n is a, c, g, or t
  misc_feature (255)..(255): n is a, c, g, or t
  misc_feature (258)..(258): n is a, c, g, or t
ggctccccgctcaggcgcacatctgagtcaccacctcctccacctcccaacccacagctcagcatgtccgtggctcccacaccanttttcagtcatntttaacatactgaattcctgatgctgttctctggagaccctatgctccagagacctatgctctggagacccagatgctcattcctgcatctgtttgagtctgtgcctacctgtgcacctgtctgccatgtgctaccttgaaatgcaacaatggctttnggngagagagagaggagggaagggtgacaaaagagttgaccaccttccatctctgctgcctaggggacagatggcttgaaggtataagctgggcccaacatggctgcaaagagaatgggaggtttttcctcccttctatctccttccttcagtcgagcatcttctgtatacaaagcattgtgcttaatggaaactacagggagatgtaagctgtgacttgatcaagaagactttgt

SEQ ID NO: 718492 - DNA, 4898 bp, Homo sapiens
aatgctgacttctctacatgggggacaagtggatctcagggactatctacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaattaagacattatcagcccagtaaatttcttgcttaatgtttttccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactcataaaaaaaaaaaaaaaaaaaaaaaaaaaacacaaaaataaacaaccaaacaaacaaaaaaaaaaaaaacaaaaaaaaaaaaaaaaaaaaatacataaacacacacacaccaatcaaaacaaaatacatatacaaaacatatgctcgtccagacacacatactattttctcactccattactcctttagttggaaccggaaacgaagaaatcatgcagagataacacgacaaatcattccatctgtcatgtacacccgacacgaacaaagaaagactgcacgggagagagagggagcgcaatcataccaaccaaaaacagagagatgtggatacgagcagatagaccagtggttacatcaacaacagcgagttagtaggcggatagattcaatgaacagcgaacgaggtggatcaacacaaacaaacagtggaaggcttgatagagga

SEQ ID NO: 718493 - DNA, 340 bp, Homo sapiens
  misc_feature (98)..(98): n is a, c, g, or t
aaaagccaaaaaaagaaagaaaaaaatattttttcttttctgttttatttgctaattaaaaatggggagggggaaagtggtccctatttcctcctccntgtttcctctcctcccctgtaggtgccccagcattttggggttttttaccaatagcaatagttttagtgaatgtgtgaaaccaaaaacccctttgtattgtgtggggacccccagtgcgggccagtaaagtggatttaactcccaagtgtgtcgggccggaccccgggccctggacatgttgtttccatgttcagtcccttcccggtttttgggtgttttttttttcccccctcccccccta

SEQ ID NO: 718494 - DNA, 326 bp, Homo sapiens
caacccccgggttcctttaacaaaatgtttccggcattcccggggggggcagggggtcctccaaaaaacccttggggttgccccccgggggggttggggggggtttacaaaaggggggggaaggtggggggggggggccctgggaaaaatttttttgggggggggggggcaaaaaagccgggttgttttcagggtttttccagggggggttgccctaagcagaaggggccttttggggtttttttttggggggtttttaggggggttgggtttttttttcccccggttttttgagggtttaaataaaagggggggttttcccttta

SEQ ID NO: 718495 - DNA, 183 bp, Homo sapiens
gctgacctacaggttaccccgtacgccaaccctagtaggataaggaagcatattttatttaacatttatatgatagctgcagtgtgtctcaatcctaagtgtattttttacaatagccctatggtgcaggttataattatcattttcatatttgtggccaaggaaaaaaaaaccaaacacgaa

SEQ ID NO: 718496 - DNA, 1631 bp, Homo sapiens
  misc_feature (966)..(966): n is a, c, g, or t
gtggagcgagttggtgcgaagatggtaaccatccgtcggaggggctcgggaggatcaacttagagagtgttgtgggggcgggccaccaagcatcgtggtgaggaaagcacgaagggggcgtttttttaaataaaagggggcgggagcgcagattaatatttgatcaagggagaggtgccctcctttgtcccgccagtgtgcgcggcccgaagaaatatgtcgccgccgggtttgtggagggttctggctccaaggacgccccgcttcctggcgaggagagagggcgacttctgttcactcgcccgcgcgtgggagaggagagttgtgtctctgccccccgaatgtaatagacccgggtggccaatgtgcccccccaacaccccgcaatatgatcccccttggtgtgtttccattttgggctcccccccagatagagaagggcgccccccaccttgggattgggaagaattcccacgggggtgtaatcctgggaggggccaaccgtgtgggccccggaggaaaagctttggaacttgggggccccccccggtaagaaaggcttttgtaggcccacccaaggtgaacactcggtgggaacccacaattggtgtttggcgcacaaggaatgtaagaattgtagtcggacaagtgcctcatctcggggggtgtacccccaaagggcccaaaaggcgttacccaaaaaagggggttctcacaccaggtgctggtttgggcgcaacacgccccgcagagagagagctgttggcccccccccgcgctatgagctcctcgctccggaggggcgccgtgcgcgcccaacatggtggggccctctgtgagttttggggcgcacttgggcactgtcctcgcgtttccggggttaagggcctctggtctgtctgtgtgtggcgcacaccgcccgtctctgggcgcacagaaaaaagggcttacaccactgtcaccctncgcactctcggagagagtgtcacacgcacacagagaagattttgttataaaaaggagtttgtgggccacacaagaggcttgtaagccctctgtagtgtcacacaggagacccgcggcacacagctctgagtctctcaacagagacacatagtggcctctctccgctctgagcttatagtgagcgctcattgtctctgagacacacagagagcgatatcacaaaccctctctctcggggttggggctcttttgtgcccacactcatttggtgggaaagttgagccacacaagaactctgtgtgtcactcgggctcgagaaaggggctcgcttgtgtggtgtggggagacaccacacgaaagccgggggtggtctctcacaccctcccgccacaagtgtcctcttgtgctggtcgcacagacgaaagcgcgcgggcttctggaagaaagattgacccttaaagtttacattgagcacccaccctccccaagtttggccacatggccgcctttccacgacccacatggaaggaagaaagaaaagcactttcactggggaaccactcgaagaaaagaacccaattgccaagagacaaagagagcttaatagcccgggaccagattttgccacttggtggggtctccaataaaaattattttcccctgta

SEQ ID NO: 718497 - DNA, 103 bp, Homo sapiens
ctaagatcccctgcgtacagttgcgggtaactattcctggcaggcgagagggcggttgtcgcctcggcgagacgcaacttgtacggcggggggtacagaagct

SEQ ID NO: 718498 - DNA, 664 bp, Homo sapiens
ggtctcgagtatttttttcttttacgggtagggggtgtagagcttgaacgctatctaaatggggggctgctttaggcctactatgggtgtaaaattttaatctctctacaaggttttccctattgtccaaagagctgtcctcttgggactaacagttaaaatttacagggggattaacgagggtcacgggggggcaaatttaacgttcgacactcaagattctatctggcgacaacccagtctatacaccaggtctcggatagtgttggtacgcctctacctataaaatctatcccactaatttggctcacatagacgggtgtagctactatcataagcatggtacctctaaggtaagcctacgacccgggtattccgggggggtactataagctatagggctactccctatgacaaaagtatattctcctaaagctataaactacccatatatgggcacagaaaggggtaaatcaagggggtaacaagaccctcgtgcataataatttacatcgccctgggctataaataaactcattctcaccaattcatttttccccctctatgacagagaccaactaaatactacaactctggcgcgcacaagtgatatcaaccaatatacacctaaccgggccattataactacaataagggggtaaca

SEQ ID NO: 718499 - DNA, 1212 bp, Homo sapiens
ctatacatgaaagattcctattgtgattagactgttggtacctcagtattgccgtgatatttgcgagctcaatcgagcacgagatccagatgatagcttatattcttctgacctaagcaaaatgacatgataagctagtagccgagatatactagataatggctggatggattgtgggagaggaaaagagtgaagcgtggggttggtgtctaatatcagatatgcctacgagacatcccaggtagagctgttaatgaggcacttatcgtcctgaggtcaagagagtaggactagaatataaagatttgaggcatacataggtgttaagtggaatgtaaaagcatgtgactgggagagtatgtggtaaacaggggaaggaagccccagaagagccaggcagaggagagaagagccggccaacggaaaggaagaggtcttgtgctcgatagagagacaagaccagcagagaggtgccatggaatgctaagaagaaagatgatttccagaagagagtgcgcaggtgtcctgttatgaaagagcaagctatgcccaaaacttagtataggcagcccaaagtcacaagatttgggactcttgtacctaattcccctaattgtccttcacaaccatgtagtgagaccacggaatggtcgacagatttagcttagatggccaacagagtggtaagacggccttcggagcagagggggaggaggtaattagtgcctgatagcatagggaaatgtgaattgtgtcaagctcctgcttgtggaccatgccttaattagagattcacgtcacatcataagccactatacaataatctcacccttggatattcacgtaaaacctcaccggagagcaacccacatatagagaccaaccttgccaaggacacagggtaccacaagagacgacgcgagtctataacaaagaggagttgccaccagaaggagagatgtgacgatatgggcccgggggcgctgctgcaggccatctctccaggtgaaaggcactgcgatagacgagcgataacgcgggagactaatgaggtacagagagacagcgggaggtgcacagaaagaacggtgacgagatatcgagagatggaagcacgatcgacgaccactaactataggcaactggtaggggacgacgactatgcgatagcagggaaagggcgtgacaaagacaagggacgacgcgagctaa

SEQ ID NO: 718500 - DNA, 249 bp, Homo sapiens
cccccccccgtttttttcccccccttaaaaacccccggggccgttcccccccccggtttttaccttgggccggggggggggacacctttttcccccggaacccgttttgccctttggccctttgcgaaaccttttttggggccccctttaaggggcccccccccgggtcccggtccggctttcccgggtcccccccgggttcccaattttttttttttttttttttacccttttttttcccccccccca

SEQ ID NO: 718501 - DNA, 173 bp, Homo sapiens
actctgaatcgacggttctcatagataacttcaaggagccggtgcaggagtgaggcctcagcaacgtatattgggtggcagggcagttgtgagtgtgcccacatcctgcattcatgataaacagtttgcagtttgataatatagtctccagcggaacgctgagttggtcatga

SEQ ID NO: 718502 - DNA, 341 bp, Homo sapiens
tgcggtgatctagaggatcccactagtccacggttggctccatgcaggtctgttcggcctctgcatggagacaacgggtatattctgtagaaaaatcattaggtctgtgtgcatgagaggaggatgggactggcagaccggctctgtttctgcagtcacaccttgtcaaaagtcatggctgtgggacacctagttctcactttcttattttagtagcttccctggtaagaaagttcatcaacaaaaaaaactaattacggatacatataacaattggtgcaaatctcagaagtgctgtgtttctgcagtcacacgtggtcaaaagccaggcgtggactagg

SEQ ID NO: 718503 - DNA, 563 bp, Homo sapiens
  misc_feature (1)..(1): n is a, c, g, or t
  misc_feature (5)..(5): n is a, c, g, or t
  misc_feature (33)..(33): n is a, c, g, or t
  misc_feature (81)..(82): n is a, c, g, or t
  misc_feature (128)..(128): n is a, c, g, or t
  misc_feature (160)..(160): n is a, c, g, or t
  misc_feature (166)..(166): n is a, c, g, or t
  misc_feature (168)..(168): n is a, c, g, or t
  misc_feature (227)..(227): n is a, c, g, or t
  misc_feature (378)..(378): n is a, c, g, or t
  misc_feature (464)..(464): n is a, c, g, or t
  misc_feature (512)..(512): n is a, c, g, or t
  misc_feature (540)..(540): n is a, c, g, or t
  misc_feature (561)..(561): n is a, c, g, or t
ntaanggacacaatggcgcccaagcggaaatgnaatggtcattgaaagccccacttccacaaggaatggcagcggcgcgtnngccacgtggttcaaccagccggcccgtaagatccgcagacgtaagnccggcaagccaaggcgagccgcaatcgccccncgcccncncgtcaggatcaccatccaggcccaatcgtgcgcatgccccacggttcggtaccacaccnaaggtgcagcgccggccgggctatcaagcatggaggagctcagggtggccggcattcacaagaaggtggcccggaccatcggcatttctgtggatccgaggaggcggaacaagtccacggagtccctgcaggccaacgtgcagcggctganggagtaccgctccaaactcatcctcttccccaggaagccctcggcccccaagaagggagacagttctgctgaaggacttgaaactnggccacccagcttgaccggaccggttattgcccgttcggaacgttctnttaggatggaggaagcttcgagttcttncttgagggagagaaggttttnca

SEQ ID NO: 718504 - DNA, 904 bp, Homo sapiens
tacctgtcccggtttccttgtctctcctccgccttttggaatcccttctctaaacttatttccgccgccgaaatccgattttcttctgcggcacacttgttgtccgtacgacatctttgcagaggcggtgcacagctcccgcagttttgcaggaacagagtgcctgtgtgtcgccggggaacacgaagtggcccaatggggccatccttgtgctcccctatgtcccgagccctgcgtcgctcgtgggttccctgctgttcggtcgcacacaaaggggacccccccccactgggtctcaaggccccagaccgatgcgcagtctccccttgttggagcgacacaaatgggccgccatgaccatgtcaacacccaaatcgtctgagacagcccgtggtgccccaaatgtaacggacccttcgggtgcggctggcggaccctcggccccacccgccccccgcaaaatctcgcccccagtggcaagcaaaggagtgtctcaagaaaattaataggggggcctggcagtcggcccaactacttgctcacaacgactcgctgtcgcgcactagtgtaccacccgactcgtgccctcttcctgacgaggcgaatgtcatagagagagaagaaacagtagttacaggccgaggaaaaatgaggaatgaaatattattgaagattcacctatggggggctccccaataattcacgggacgcactcatatgagggatgtaattctttaaatgcccctaaatgattttcccgcgagaacacgtctgaggttgtctccccttctccaaagccccactcggggctcctttcctatataagggggtaactctaaataaaacaatacaaggaaaataaaaaagacaaagaaaaaacccaattttaagcccgaaaaaaaca

SEQ ID NO: 718505 - DNA, 267 bp, Homo sapiens
agctgactctagaggataaacaaatggccccggagcactggaatgtctcggtggatagccccagaggataaaccatttactgagataggagaaaaccaccttaggactggtgctgggacatgcatgacagcaatactgctctttaaggcattgagatgtttctgtatatgcacatcaaaagcacagcacttttttctttaccttgtttatgatgcagagacatttgttaacgtgtttacctactgatcttctctccactattatcct

SEQ ID NO: 718506 - DNA, 617 bp, Homo sapiens
gcacgaggatttcttatggaaataaaaatagaactaccattccacccagcactcccactactgggtgtctacggaaaggaaaataaatcattacattaaaaagatgccattgggagaccaaggagggtggatcacgtggtcaggatattgagaccatcctggccaacatggttaaaccctgtctctactaaaaatacaaaaattagctgggcatggtgctgcgtgcctgtaatcccggctgctccggaggctgagacaggagaattgcttgaaccagggagtcaaaggttgcactgagccaagatggtgtccctgcactccagcatgaagacagagagagactccatctcaaacagaaccaacctaaatagccatcaatgtgttaactggataaaagaaatgtggtgtatatatacactgaggaatactacacagtcataaaaaagaatgtaatcatgtcctttgcagcaacatgggtagagctggaagccatgatcctaaatgaactgattcaaaacagaagtgaaatactgcatgttctcgcttattaaggggaacttggagcaatggatacacattggccttaaatatgagatatcacttgggactccaggagg

SEQ ID NO: 718507 - DNA, 250 bp, Homo sapiens
aagaagatgatacccagtggctgacctactgggtagtgtatgggtgtgttcagcattgctgaattcttctctgatatctccctgtcatggtccccttctactacatgctggagggtgggttcctttttgtggggcagggcccccggcccttttaatggggctggactctcttttaaaaagggatatatcccgtctcttttttccctgatggacgcgtgcccacactggcactttagggtacgggcctttc

SEQ ID NO: 718508 - DNA, 1745 bp, Homo sapiens
cgcccaccgcgtccgacgccctgggctggcactggagtgtgggcatgccacgcctcaactacacacgagcatagggctaagagccgacacaggctaggcctaggcaaggcgaggttgcgattggcgcagtggtgccacctccagaacagctccaccaaggacttcggggtccaggcaacacgtggcatgcggtgggcccgagaacttgccgcccgattggtcgccgcacataatccgaccagcatgggagcccctcagcatagcagctggggttggacttgtattcttgcgtgccctatgtggcgaagttcatccagtacctaagtgcagcagccaaaacatacgagcattggctggagcgtggttgcaccacaacaaagggataacccatgagaacggaggccattcgccatgagaagatcgtcgatgcgcacccgcagttatcaaggaatcaggaggcaacagtctggtcactgtgacggatggcacgggactgctgaggagcacacgacaacgggccaaggcgttccaacaccgcccgtggaaggccacgtggccggggaatccccccaaaaatcgcccccaacgcaaggcgcaacgaggcagagcactgaagggcaacccccgcgacgagacgcaaccccccgccgctcccacgcgggcaccagacgacgccagtgcctcccagaggcacgacgccacaagagaccagacgagccgcccatgccgcagacgccaacaacccatccagacacaaggaaggccacctaaccgcagaaggggcccaccgcacggtgcccaccccacaaggaacccggtggcacatacccaggacaacagacaaggcgagccagctgcgaacaacacgcggccccacatcaccgcagcgtccccccgcgtagcaaaccctagtcacaaggcgcacagcgccatcgcgacgcgggatactcggcccccccaagggccacatccaacgtgacccgacgacagacaacaagagaaggcacaacgaccagcacacagccggcgccagccccatggcccacaacgccggtgcacaccaacagtcgaaaccaacccttgcagccagtaggacccacaccaacgcacaatgggcccgccggggcgagcacacaaccaccagtacacatagcacaacccccccatcggtcgaaagacacgaaaagtgcacacgtagcacgaacgcgggcacggacgcaccgaagactagccaacactcacccaaactcgacatcgaacgccacgacggcccagacgtcagacaagcggagactcgtgcaaaagcacgggagcgccgagtaggggacacgacgagcgcagccgaccgcaggaaaagcgaggcgcagaaatcgggacgccagagcgactacacaccggcgagaggagcaccgcgaagcgcggatggatcgaaagaagtggtacgccgcaacaaggccgcaccacgcgggaacacacagccgaccaacacgccacaccagcgcgcacagcaacgagcagcacgcacaaaccagcaggcgaccacggacgcgcactcagacctgaaacgcacagacgcctgaaccacggatcagagcgtgggaggacgccggactgaacatcgacgtcacacaagccgagcgacggcaacaagagcagactcagggcgacgacacagaccgaccgacgacacagagcgaccacacacgcagcagatgcgaacaaccgcaacgcaccgacgacgagac

SEQ ID NO: 718509 - DNA, 291 bp, Homo sapiens
aggatgtggaagcccaagttgagaacaataatgaacaattattgtatgaacaattgttagagacagctaatcacaaacaacctgcgggcacaaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 718510 - DNA, 270 bp, Homo sapiens
attataaacatctttaaaacagaagtccttgaataatctgatataaaaaggcatgcctctgtaaggcatggggagggctggggaggggcggaaggagctttccttacgtagtgatgaactctccaggcgggggagggtcccagtgggggggggaatgggctgttcctgggaacctgtgatgtccacaggggggtgacgggggagagatggtcgggctgggctccttcactgggtggagtgtggcacatgggtgtgacctgtgccttgggc

SEQ ID NO: 718511 - DNA, 560 bp, Homo sapiens
  misc_feature (47)..(47): n is a, c, g, or t
ggaaatattttttactttgttttcatttttctgttttagttcaaggngggaacttttttattcatgggaacccttcaaaattttggctttttcaatgaatcccccttgcccgaattttcaggtggaacaggtactcattttccctatttttgaacactttaaggggcttcctttgggggagcccaacacacaaaacgtcccttttagcaaaatcttagagggggtgcttagggactaacacaaactttaagggcacaaaaccattggtggaacaattttctgctgggcttttctgaaaaagaagaccgttctggctcttttatttttggggaaacttactaaggccccaggattctagcttattctttagaaggaggtcccaaaagcatttaaccagatcttctttcaaaatgggggatttcctttaagaaaaggggtggtttccgggaattttctaaaccccaaaggtggtgggatttttttggggggccctttttttttttgacacggcccttttaataaaaatttgggggactgggaaatgggccacaaacgctttc

SEQ ID NO: 718512 - DNA, 296 bp, Homo sapiens
ctgcatgagaggagcgctatgagcgtagacatcatcactcagccgtctggctgtaagcgcgtgacccaccagtcctgtgagctcgcatgcagaaatgggtcttcccgaccacaactgcaacagcttcagcgtggcccctacgcgccctcctcaccccagcttgcgggcgcctaaagccccggacgctacttgctgacacgggcgccacgagttcacctatgcactgatgccgcacaagggtgagtgctggggacggtggggccttcctgcagccctagacacctctctgcccttct

SEQ ID NO: 718513 - DNA, 130 bp, Homo sapiens
ctctagaggattgtcccagaaggaggagttaggcaaagatttggaggagtcgcctgggtgaggggtacagtacagggtaaatggcctggatgctgagatggaccttgctttttagcattttacactcatc

SEQ ID NO: 718514 - DNA, 235 bp, Homo sapiens
ctggaaaggttttttgggttagggggatccaggacctccccaacctcgggcccctgatagccctttccccctaacatttgcattttttttgccctaaagcctctgttccatttgtctccttctttgggctccccccccttttttttaaacaaacctttccctcctttctttaggggaaaatccttgttcccttccctttaatacaaaaaccccttttttaatgccagcttgttta

SEQ ID NO: 718515 - DNA, 376 bp, Homo sapiens
  misc_feature (99)..(99): n is a, c, g, or t
  misc_feature (178)..(178): n is a, c, g, or t
  misc_feature (260)..(260): n is a, c, g, or t
aggccatccttttattccgttttggggcccaggaagtggggaaaagtaggttttcggtacttaggacttgatcctgtggttggccactggccatgttgntgcccagttttacccctcccagggacctacccctcccagggaccgacccctggcccaagttccccttgttggggggggntgggtgggccctgcactttttaaggttccccatcatgggcaaggaagggaattcccccagccctccagggtattgaggggantggcctagccatggggaattccctaccctgactccttccccaaacccagggaaaaggggtttcaattttttatttttaatttttgtttgaaaaaaagtccttagttagccccttga

SEQ ID NO: 718516 - DNA, 178 bp, Homo sapiens
cccctctactccgaaaggcaacatagcattctacagcaggataaatctattatcaagtaacagtcaccctggcttaataacaagtgatactgatcagttgctggtataggcttggttggttggcatgtgggtgtgtgggtgtataggtgtgtgtgggtgtgtcgccttgcggagaaga

SEQ ID NO: 718517 - DNA, 455 bp, Homo sapiens
  misc_feature (355)..(355): n is a, c, g, or t
ccgaaatccggcgatgggatcacttgaggtcaggagttcgagaccagcctggctattatggtgaaaccccatctctactaaaaatataaagattaggccaggcacggtgggtcatgtctgtaatcccagcactttgggaggccaaagcaggtggatcacttgaggttagcagtttgagaccagcctagtcaacatggcgaaaccccatctctactaaaaatacaaaaaataagccaggcatggtggcatgtgcctgtaatcccagctactcaggaggctgaggcaggagaatcacttgaacccgggaggcggaggttgcagtgagtcgagatcataccactgcactacagcctgngcgacagagcaagattccatctcaaaaaaaatgcattattcttctcttatctttggccatgacataagcaggacagcttaagttatagagggaggacgtg

SEQ ID NO: 718518 - DNA, 255 bp, Homo sapiens
aaaaggaagcattattttatctgtatgccaaatgattacataattgttaacaacttcccgaaggtcctaataaatatggtataataactatcgcattatataaatagcaagaaatgttttgagctttatcccctatgtagcaagatgacaccacacatttctagttatttgacacttaatatagatgaattaaaaatgtgcatttattatataaagatttgaaaatggcacgctttcaaacacaaaaaaagacaa

SEQ ID NO: 718519 - DNA, 254 bp, Homo sapiens
ggatctaaggagctactcagtagacagtcccacctcacacgattctttaactctcacttcatcttgcccttcattattgcaggcctaacagcactccaacttctattcttggacgaaaagggatcaaacaaccccctaagaatcaacttccaattcggataaatcaactttcaaccttaataaaaaattcaagaaggccctcggttacttttttttctttttttctttattgacatttgcaaaagggtttctca

SEQ ID NO: 718520 - DNA, 328 bp, Homo sapiens
aatatagaatgagtactacacgagatactgatagtataataagcatactaggcattttccctgctagcagctactccctcctgctagtacatagtgaagatttctagctgtccagtaagggtagcactagctatgtgtgacagtttagattagtgaataataaaataaaagaatacaatacaggggtaccttgatatccccttacaccttacctaccatgatatagggtaccctgaggcctctctggccatggggaactatgagtcaattaaacctcttttctttatgaattacccagtctagggtgtttatggcagtgtgagaaccg

SEQ ID NO: 718521 - DNA, 280 bp, Homo sapiens
tgcacagggggttggtttctgctggtgttgtactttccaaggttccgtacacttacacttgaggttttcttttttgtgccaggcgcggtggctctcgcctgttatccccgcgctgggaggctgagtgctggccgatcacgaggtcctgagatggccaccatcctggcgaataccgtgaaaccccgtctctaccagagacatacaatatattagccgggcgtaatgtcgggcgcctgtagtcccagcttacttgggaggctgaggttgcagtgaggggata

SEQ ID NO: 718522 - DNA, 330 bp, Homo sapiens
tcgacagaaatcaatggcatttgaaccaccaaaaagaaataaagggctgagtgtggtggctcacgcctgtaatcccagcactttggggagcccaggcgtcgagattgcttgaacccaggagttcaagaccagcctgggcagcatggtgaaactctgtatctacaaaaaatacaaaaattagccaggcatggtggtgggtgcctgtagttccagctacctgggaggctgaggtgggaaaatgacttgagcccaggaggaggaggctgcagtgagctaagattgcaccactgcactccaacctgggtgacaagagtgaaactgtgtctctca

SEQ ID NO: 718523 - DNA, 866 bp, Homo sapiens
ggctgcgtgcatctgtgtggaaaatgtgtggctgccgtcttcgctggagcctggagcctacatggtttccagtgctgtcgctacggaatgcctggtccactggctcgtgtccgtagccgtgtggaaggcgtgacacgccactgacacgtgtttattgccctctggcactacctagccttagtacttcgaccttcagggttgcatgtacgcaatacatgaaaatatccagatatacgtagcaacagcgatgtgctgactcctgcgccattgatcatgtgaagagagagaaggattgtcctggtctacccattcactcgtatgggctggttctcacagctgattttcacagttctctggctgtctctcagattttgttgctattctcctagcaagcgttttacatagtgccctacaaaagtgcacctctgtggtcacatacgcgtgcacaccaccttcctagccagctggcataaagaaatctggtatgatgtggtgttccgtatgcaggagagctggatattactgttgcttgtctatatcaacttccactactgggtggaataaagcaccagactggaagcttcaatgcgagtcaagaagatttcacggaagtgaagagcagttgtaccaacaaagcgtacaaaggtatcattgatgcttttcatcagatcattcgcgatgaaggaatctcggctttatggaatggctacatttccctcgattgctgtgtggtcttcaatcctgccaatccagttcaatgtattatggaaggtttcccacgggcgcttttttagaaccggctggagctttcttccctggggtggttcatcattggggccgcgggtcaagcgttggccccccggggc

SEQ ID NO: 718524 - DNA, 630 bp, Homo sapiens
gtatcaacgcagagtggccattacggccgggcacagtggctcacacctgtaatcctagccctttgggaggccaaggtgggcgcatcacgaggtcaggagatcgagaccatcctggccaacgtggtgaaaccccgtctctgctaaaaatacaaaaattatctgggtgtggtggcaggtgcctgtaatcccagctactcaggaggctgaggcacaagaatctgtggaatctgggagtcggaggttgcagtgagccaagatcgtgccactgcactacagcctggcaacacagcgagactgtgtctcaaaagggacaaacaacccctcacaagaacagtgacaaattggcgaaacatatgtataccacatattccacagccataggacaaattcccttaatcatatccacacacacacagtgctaagtccaactacagacacaacgaccctgttaacaccttcaccacacgaacatgggcaaaccaatcacaccagtctgtcccctacagtattcccattgaggaaactgggcgtcccaggaacccccctacgaccagaaaccccacaatctctcccagcatggctcatagctcccttaactataacgcgtgaacaacagcccatatggcaatg

SEQ ID NO: 718525 - DNA, 239 bp, Homo sapiens
  misc_feature (105)..(105): n is a, c, g, or t
gaagaaatgaactgggacagatatctcaagacacatggttctttggctgggcgcacggtggctcacgcctgtaatccagcactttgggaggctgaagagggtggntcgcctgaggccaggggtttgagaccagcctcggtaaaatggcgaaatcttgtctctacaaaaaaatataaattagccaggtatggtggcgcatgcctgtgagtcccagctactctggaggctgatatgtgaga

SEQ ID NO: 718526 - DNA, 798 bp, Homo sapiens
aaatcaagtatacagaagaatcggtgaagagaggtttggaattcacgcttatggtagtgggtgaagtctggatggggaaagtcgagcattaatcaactcattattcctcacagattgtattgctccgagagtatccaggtccttctcatagaattaaaaacgactgtacagggtggaacaatccaaagtctgaatcaaggaaggtggtgacagtgcggctcagaatagttgataccccaggattgggagatgcagtggataatagtaattgctggcagcctgttatcgactacattgatagtaaatttgaggactacctaaatgcagaatcacgagtgaacagacgtcagatgcctgataacagggtgcagtgttgtcttgatacttcattggctccttcaggacatgggacgttgaaaccattgggatatggagtcttgatgaagcgtttgcatgagaaaagtgaatatcatcccacttagttgccaaagcagacacactcacaccgagaggaatgccgaaggagtttaaggaagacatgataatggaaagaaatccaagaacataagaattgaagaatatacgaatttccagaagacatgatgatgaagaaagagaaataaagttgttgataagataaaggaccgtttacctcttgctgtggtaggtagtaagtactatcagtgaagtcaatggcaaaagggtcagaggaagggagtatccttggggttgttgctgaagtcggaagttggtgaacattgtgattttacaatggtaagaaatatgttgaataagaag

SEQ ID NO: 718527 - DNA, 1100 bp, Homo sapiens
gcttccaagaggtcttagagggcctctacttcttggaggtggaggccctccaagaggtctcagaggtggaagaggaggaagtggaggaaccagtgcgacctccctcctagggcggaggacgacatggatgatcggtggagtattccatgatacttttaagcatgatgttcttccaggggaccagctcccagtataatagagaggatctagcaccaagaagtgggggtcctccgtcctaatgagatctgcgccttcatggaccatgttcgcagtaccaagcttggatacctcggcgaccggaaccgagcgctccgtggattcacccagttgcgaaagacgattatcgtgtactcgagatgagtccattctcggagatgtgcgagacgctgcgtcgccgcgtcttcggtagaccactgtttaattattggtacccccaagaactactacatggccgtatttgggtactttgacagaggatccacagcgtgacttgcctacgtggcgatagaagattctactcgcgaaacggtcgtttcggcttgactagctaccgaccactcactcgccacgctagccaaccccccgctctaggcacttccctcactgtgtactcttgctgcacttatcactaggatcaacaactcaagggctcaccatcgagtttcgaacctcgactctcattcacaactccaacgcgaaagcggtagagttatcgtacgacaacagatcggacctgcgcccactcttgcgttccccgcttgcgtcccggcggacccctacttgtcagggcctcttaccgccccaaccccgttgtccaccggtcgacctacaacccgtcaacgcatcccgcgaaaatctcgtacgggaataattcaataggccaacaaacatcacttgcgtgacggtagacctgcccactgccctcacctttccgcaccagagcggcaccctctcacaaggcaagcctagacatcggctctggaggcagcgccaagtgtactcggacatggctctgaacttgcccaaccgcggagcacgcttaacaatgcataccctggcaagtcacttaggcactgcaggaaaagtatcccggcaggtac

SEQ ID NO: 718528 - DNA, 532 bp, Homo sapiens
gtaacacttttctattttaaaaactcaggtccccactatgtactttccaacataattatgtttggaaccaggattctcataataggagaaggggaattcagtagaggaaagatgaaggagaactctattgtgttgattttgcattgtccctgaaaagggccccaaaactgagcacacctggcccccagaatttggtttctaaagttttctttctctaaaagaaatcagaggtccttggagaaactgccatatcagatctgaaagtaaggcaagatgagcttagagcaagcaagtgctcgcagactaataggaacatgccaaaggaaaggggccttccactgaacaaatttggaaccctttgggcatgaaaaagaatgacaataatagcgtactaacaaacggaattgaaaactacccataagatatcctctagtccctgctacttgggaaggtgaggagggaggattgcttgggcccaaaagttccagaccagcctgggcaatataaaggaggccttgtttctataaaagga

SEQ ID NO: 718529 - DNA, 361 bp, Homo sapiens
  misc_feature (208)..(208): n is a, c, g, or t
  misc_feature (306)..(306): n is a, c, g, or t
  misc_feature (321)..(321): n is a, c, g, or t
gatagagcgtcggcgggatgttgatggtgttatccagcaccgtggtcactgcgttggtagccgagtcgcccgtggtattgaactggacctggctgctgtcgctgctgccacgtgaggtggcccacgcgcccagatcgctgatcaagctgaccatgatggccccgccaaaccgctcagcgaagtgcgtgtagatgaagccgtctaggcntgcttcgcccagggagccggtgccaggggaatccagattgataacgacgcccttgggcgtctccagccgcgaccatacgacaccgacacgtggctggncttgtgccagcacgncttgctgatagccgatgaatcgcgtccctttgtcggtcag

SEQ ID NO: 718530 - DNA, 140 bp, Homo sapiens
gacggggttcaggtctggctccataggcagatgaggctgcatggttgtgaggttcatgaggcaggagaggttgtagggtatggctggagggtagcctgcgcgcagctcaacctggtccagggatctgcaggcgtgttgcc

SEQ ID NO: 718531 - DNA, 800 bp, Homo sapiens
agtttcaccatattggccagggtgggtctcgaactcctggagctcaagtgatctgccgtgcctcagccttcccttaagtgctggggattacacgcgtgagccaccactacccgagcctccaatctttaaacttgctagaatgtgaaattctatcatgtaccgttagcctaagggaagatgtatctttcgctatttctgactggtgcctttcccctttttaggagcaacgaagaagctactctcttaggttatgttcttgtgatgtgacaaaagtgtcaaagaagataggagaagagaatatcgttgaatttcgtggatgctttagtatcccagagtgtgaccctaaagttcagcttgtaggagtggacattctttcatgtcccttccctttactcatgccgaaactatcaactgggacatttggtgctttgggtttaaaagttaatggatattatagctttggttttatctagaaaagttaaatgtatttgcctttgacaaaagactgagcacaagagcaaaataagctttaaaatcgggtgttatgtgctttcctccatttttgagcatattatccaaaatggtctgtactaatataaatgagaatgatgcagtttaagtaagctaggtgatacccattggtcatggacccccgtggtcataaaggccatttctaggtagtagggacaagcaggctatggggattgtattccagattccactgtgtgacatgttgactgggcgactctgtgtcactttgctcaataaagggtagtgaaaccatcacacaacaaacaggg

SEQ ID NO: 718532 - DNA, 809 bp, Homo sapiens
  misc_feature (1)..(1): n is a, c, g, or t
nccacaaaattttccccaagttttattaacaattttttaaaaattctccacaattttaataaaaatggccccccattgtttaaatttcccgaaccacaaaacatccccatgccaataccccctttaccggggccccgaccccgttaattttagtgcttgggcacccgccagtaatgtctattttcacaaatccccgttaagcctcttttttttccacaaaatcccttttttaaacttgtcaattttccaatgaccctctccttcccaaatagtttactggtaaagcatataccgtccccccaaatattatgcacactttttaaatcaaagaaactaatcatgaatctacctgctccatttcaacgtaatccaactcgaagtccaaggctctgaaacatcatcttatatctgttatggatcatttcgcactcctctgtaaaaacctgatgcaaggcttgcccttaacaaaacatttgttcctcatacgtgtaaacacttttctactgcaacttcatccccccaagacttccaacgtagcctttgttatcctatcacccagccatgagaatatccaaaatcaaatcaagatcaacaggttattcatccgcttttcttaaatgtgttgtgtcaaagcaccagcctgtcttctgatcatacatttctttgatcaatgtgcttaatttctcttcccttccaataataaaatattcaaataatctaaaaaaaaaagcgataactctagggggggctttcaacagggtccacaaatagttcccatagggacttagaggaaatggttaaatgataat

SEQ ID NO: 718533 - DNA, 361 bp, Homo sapiens
ccctgaatatgattcagcccatatatacctgtctgcccgtgctctacagtgtctgttgttctgtgatcacttctaagtgctcatcatgtatttgaccgtcccatatatggagtcatcttgattctagcgattggttctcactggtgcgtgcgctattgatcttatgcactgcggttctcctatgggtccatcgttgttctgcagcatcactggatctctgttccattgacaccagtgctactgacagttgccaccagttcctttccatactagtgcgtcagtgctcgcaatcgactgtatgtagcgcaaggtagataacaatattatagtggtttctcaaaactatatctgagcatgtccc

SEQ ID NO: 718534 - DNA, 198 bp, Homo sapiens
atgttactgggatgtcacttccagtaactagtcctttcctggcccccctcctgcttgccttgacccggaacctttctggatcagatccacggcgtgtccttggtctcgggaggcagtgtgctccactgctctgtcttgtccatggtagcgtgaagcagccagtgtcggagccaagtagatcatggtttgctccccaca

SEQ ID NO: 718535 - DNA, 343 bp, Homo sapiens
aaaaatggcccccctttggggtctttcttttggccccattcctggattggcggggtgaaacccctcaaaaatttgggggacccggtgaccaccttgggcaaattgggggcgcccaattttggcttggcggaatatttttttgacaagccccccctgggggccagtgttaatgaaagttaagcctcgggttattttccccatagccgtggggtgccttccctggtccccaaggcagggcatgcatgttggggtttcctttccctttttttttggttggccccaaccatccccttaggttttttgttttgtccccttccttcaaataaagaattttggtccccca

SEQ ID NO: 718536 - DNA, 1103 bp, Homo sapiens
agcggggggcacatctgaggaggtgtggctttgtgctgtaatagtttaagctttcatttgtgtgtctttttagatagatattgctgctggtggtttaatgtagtgtagtgttgggttacatgcagctgtcaacagattatcgggcaaggtgtgcagctttgttctcggaggtttagtagagagtaaggggaaccccaagcatggcaagtcaaatcaattccagtcaggcgtagctacttaagcaggtgttaacaacctgatctgctgaccggccatcaccacgcatattggtaccatgtgaaagcatggcaaaaaaacacacctaatactcaaaccagacaagcaaggctgcatgggattgacgcccttgggaaacccacgacaaacacacaaaaagcatcacacctgatgaccacatattccaagaaacacttgtctacatggccttccagccgttggtaaagtaggtacccaggagcatagaaacataggcgttagagaggggtccaagaacgacaacaccacacaggaacgaccacaaacatcatcaccggagaccaaacaccaggttggaggcaaccctataacaaaacaaccaccatctaaaaccttccacgtgggtctgaaaccacttgcacgaatagcactaggaaacggggggatgcaacattacccagaaaccactatgtggtaaaacacggttcgcaccattcgcagtacatcactagcaacagccatgagagatagcattatcacaaacaacaagataaaataacatatccaaccatagtagagcttggattccacagccctaagtgaaccagaagaggaataggattaaagcaaaagaaaccacccatttggttcgcacttaggatgagggacctaacgtagtagaactataccaccaatactgtagaaaaccaatatcaaaagccaagacaacgataccaccagcatatagtataccattagacaaccccggccgtatagagggaccttaccacatcgaggtcagacagctataccgaaggacactaccctcccatcagagaaacactagacgacaaccagcaacacaagcaacaatatgggacaaacag

SEQ ID NO: 718537 - DNA, 439 bp, Homo sapiens
  misc_feature (26)..(26): n is a, c, g, or t
  misc_feature (38)..(38): n is a, c, g, or t
  misc_feature (70)..(70): n is a, c, g, or t
taaccccctatttttagtctaattcngactccattttnccttccttcctccttatccctgtctttgtgcnaccctgcttctcaatatcccagaaaaaaatcagtaattaaacacacaggtatatggtgtagaggatttcagtcagtgaccatggtgggtaaacagtttaaggaaaaactaagaaactattgtattcatatttgacttgtaacctctcttttccccaaacttgtctagtgttggtatttatgtcttagtttacaagccaagaatgttttttacatttttaaatggttacataagtacctatgtaatatccttaatttttgcctcttgacttacaaagcctaaaatatttcctgtttggtcctttatccacctctgtcttagatgaatatacttttgtgtttatcctaaataaaatatatacctaaaatat

SEQ ID NO: 718538 - DNA, 816 bp, Homo sapiens
gagacgtcgctgaggggcttgcctgaagcgaggggatctaacattttcagagaaccttgtggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctacactatgataccctggcaactggaataatttattttcatcgcttctatatgtttcattccttcaagcaattcccaagatatgtgaccaggagcctgttggcctctttcctggcctgggaaagggtgaagaaacccccaaaaacatgtgtcaggtatctcttcaaacacgagtctgcgaagctcacattacaatgatgtacaacttgggccagtttgggcagcatgacccaaaggaggacgtaactggttctggcagagaatcttactgcagaccatcaagtttgatcttaccggtagaacatccataccagttcctactaaaatatgcaaagcaagctcaaaggtgcataaaaacaaaattcaacaagttggttcaacatggcatggacattctgtcaacatgaccagtctctgcaccaccttgtcactgcagtgggaaccagagatcatagcagtagcagtgatgtatctcgcaggacgtttgtgcaaacttgaaatacaagactggacctccagacccatgtatcaggaca

SEQ ID NO: 718539 - DNA, 80 bp, Homo sapiens
ggacagcgagcggagccgcggtccggacggccagggccgtgccccgagctctccgtctccccccggccgacagccgagga

SEQ ID NO: 718540 - DNA, 897 bp, Homo sapiens
tgcagtggctcacgcctgtaatcccagcacttggggaggccgaggcgggcggatcacgaggtcagaagtttgagaccagtctggccagcatggtgaaaccccgtctctactaaaaatacaaaaaaaaattagttgggcgtggtggcgtgcgcctgtggtcccagctgcttgggaggctgaggcaggggaatgcttgaacccgggaggagaaggttgcagtgagccgaggtcgccccactgccctccagcctgggcgacagtctcaaaaaaaaaaaaaaaaaagaaagcttacttctctgagggtaaggtttaatcagggggctcaaagattgggcagggtacagcctggtaaagtggcgcttacaataagtggctaacgtccttggtcttatggggtttataatttccacattcctcttcagatacaattctggaaaactggtggactacctgtggtgacttggcaaaatttttctatttaatatgggcttatataggggttcatagtacatcccagttcctttatcttgaatacaaggcgttggggttttattcccagtttctggggccagaaacaataaattacctaagaagctccggttctaatgaggggcatgtcctatttgaattgacgaactgtgtgttcatttctcaagggtttacggacgtttacttaaaagttaaggggctccggggatcggcaagggttccgctcctaaccctccttggttataacctttggcttctaaaaacgtttcgacccgggagggtgtgcggccgaaattacttgggttttggcatcgggggcattttattctggcccagagggcgcaaacatatgtgtgcacgtggtctgcgggcctcggggtgtgcaatccgcacatcacactcagagga

SEQ ID NO: 718541 - DNA, 104 bp, Homo sapiens
tctttcattttctcatcttgttctatcttcccattttcttctcagtttgtacattttgcccttcgctttttgtttcctcgcttgtcttttttcttctgcttcct

SEQ ID NO: 718542 - DNA, 617 bp, Homo sapiens
gtgcttgtcctgtcgaaattatagcctgaggaggtgtctgtgtgacccactgcaactttctgaatggggagcctcgagaatttagcccatgaggccgacatgcttctcctgccacccggaatgccaaaccatggagggcactgacacactgcaatggctcgggctctgatacttgtgctcaatgtgcccattttctgagatgggacccactgtgtgagacaagctgaccccatggagtccataggtgccaagggacccaagtactacaagtacccagatgttcaggaactgaatgtcggccctgaccatgagaactgcacccaggggtgtaaaggaccagagcttcaagactgatttaggacaaacactggtgctgatcggcaaaagccatctgacaatggctttgacacagtgatagccaggattggaagtgatgagcatgatgcctgcccggcactatcactctaactggacctgggcgcccggatccacgcaaacaaccgggctatgaagcgcgaaacacaggacacgggcgtgacgagcactacgacaccccaggaaccccagcgagaagacctccagaacacactcggactgagcccaagacaagtaatccc

SEQ ID NO: 718543 - DNA, 621 bp, Homo sapiens
agcggatcttcatccaggcgccatggccgcagcctgcgggccgcggagcggccgggtactgcttgctcctcggcttgcatttgtttctgctgaccgcgggccctgatctgggctggaagcgaccctggacagaatgttgcttgcgcggatgttaaagctctgtaccctccgactagtgaccgactataccacctctccgctaggctggatcccatcccagcagttgaaagtgtggtcggaggcacacgctggttgtgatgcttataccccaaaagtcatacgtgtgtcacaacaaaggctgggatgggtatgatgtagcagtgggaatgtaatgacggacttacgatattgcatactaatttaggcaaagaagctgtggtgagctgttgaaggctatgagtcctctgaagaccagtatgtactaagaggttcttgttggctaatggagatctcacttttgacttatactggaacttgtgcctgcagaacatctgacggagtctggaaacgcagcacggcctttgcctcttactctgagttatatcactaagtggtcctcgaactggattcctgtaacactgagtggattgattagcctcgttggaactccttgggatcgcc

SEQ ID NO: 718544 - DNA, 634 bp, Homo sapiens
atacacctcattgctagcctcagcgaaagctggaataagccttcgataagcaaattgtccgttgaagcttgtatctgatatcagcactggagttgtagaacttggttgctgattttgacctctgtattgaagcttaactgtgtcccctgtggtatcttggtatgtaatgaccctgtacatatctgttgagcttcaacctttagtacctgtggctctgctcacttcgtggctaacggtcagaacgtgcttgtggaagacaagtctgctggcttggtgagtctgtgtggccagcagcctctgagtctgtgcagtgtatcttaacgtgtcaggcgctgacgatgattctgggatttctctagagtctggcaagaaccagttgttttgtcttgcgggtctgtcagggttggaaagtccaagccgtaggacccagtgtcctttctatagctcgatgtctttggccagcagcatccgctggcggctgttacttgctactgagttggaagcggtgtatgcatcttacgcctgtccaatgtattcattcttaatttatgtaaggtcttttttatgtactcgattcgtcggattctttgaagagatgacgacaaatttgtgtggttgtcaaaagtactgcgag

SEQ ID NO: 718545 - DNA, 740 bp, Homo sapiens
ggcgtcttcccgagccagtgtgctgagctctccgcgtcgcttgtcgccgcgctggctaccgcggatcccggtgcacgctctgcttggctcgccatgccggtggacctcagcaagtggtccgggccctgagcctgcaagaagtggaacgagcagcgcagcaccgtgatgtcactacgccggggcggggtggacgagctggcaagtgctgacgcccaccaggttagaatagaccacagcattcggggatggtctgatcaggaagctctacacttggtctgacagacccggatgctccagcggaaggatcccaatacagagatggatcattctgtggtcaacatgaagggcaatgacatcagcagtgcacagtccctctccgatttgtgggctcgggctcccaaggcacggctccaccgttgttgctggttacgagcggacagccgtaaggtgacgagccatctcagaacgattggaacacgtggaatcaagtggcgtcttcgtacaagttgagctcaggcccgggctgcccgtgtccggcgagtggatgactatggccaaatgtcgacctgtctggagtcggggtagtggggacctgatgctggggccagcctgtcccgtccgcgtgctgttctggtctctctctgccctggctgtgcactgcggcccatggatcggggcttctgcgcggccctttcttcccctccctgttagctcggccgttgactcctggggggtcggcc

SEQ ID NO: 718546 - DNA, 271 bp, Homo sapiens
ccggcagtatacgtcagcacaggaacgccagatctgagccgcatcgtgcgagctacaccacagctcactgcaacaccagatcgttaacccactgagcgaggccagggattgaacccgcaacctcatggttcctaatgggattcgtttccgctgcaccacagtgggaactcctctttttccttacttaggcacctgtccttcccatagtgatatcgaaccggcatctctttctttctctcttgtccagtgaccttcttccttcttctatccc

SEQ ID NO: 718547 - DNA, 171 bp, Homo sapiens
gagcaggtgtctggtgctaagtcatcgtcaggcctgaaacgcaagatgtggagtacatattggcatcgtaggatccagtgaccgaatcgcattgctgccagcagtaggcatcaagtacatcgggatgaggatgagcaagcggcttgttatgctgcctccgcgattggatat

SEQ ID NO: 718548 - DNA, 291 bp, Homo sapiens
aatggtgagcagtctgtagacggcgtcacagggcttcgcggcggcactcagcagaacgccactttgtactcacaggcagcaacgagagatgcagaattctctgccagatattccacggacatcatgcaaatagcccaacaataatgcaaggctatttctcatcacggggcgtataggccaacattgctccaattcttacaaatcatctcagtaggtgctggtgctccataaacctgggacattggagcatcagggtgagccaagaggatttcagcatccaggggctcactg

SEQ ID NO: 718549 - DNA, 223 bp, Homo sapiens
aatttaggatttggggaaaaccccccttttaaacagccaccatcaagtttgaaaagcaattgatgtttcccttaatctttttttggggggaaaaccttagttttaaggatttaacctcccgtaagggaagtttaacaaaacagtattccaaaaacacccctttttttgtcagccccctgcctgtttttaaaaaaaaaaaaaaaaagggggggtttatttttta

SEQ ID NO: 718550 - DNA, 1445 bp, Homo sapiens
taaattggcaactttaactttagaatttaggaggtcgtgcgcaggttggtccatggggtatatgggtgtgagtgctgagctggggagtgcgaattgactccgtgttcacccagggtaggtgagttttagcacccaggtgaaacgtgatagtcctcagtgccaggcacgtggtgctagcccacatcgtggctcattaaattccctctcttcttgagggagagagggagaaccacagggttcccccattgtgaccagaagtgtcagaaagagagaggttccacgaggtgtgtgtgcctgtggattcgtggtccataaaacgcgtttccgcggaaagctttcccgtgggtggtggggcgcatttataaacctataattctctctacaattcgaaatctccagaacacttatttatactctctgtgttttcacacgaggtgaatatacgtggtgtatcatagagagttataaagagggaggcaacagttcccattgggagtgtgtatacctataagaaaagtggcttatctcccgaggggtggcgaaggtttctccttataagtgttgtgaaggggctttcacaaattcccaatacgaggccacatttaaaaaatttcccatttccagtgagagtttgtggacaactaacgtggcctcgtgagtgagacaccctgggggacaaattaacaccaaattccagacaaatgcggtggggggcgtggaacacactggcactcggctggggccataaacaaaggaagaggggggaacccttctaaagcaaacaaacaccctaaacaaaacacaaaacacaaaaacacaagaggggcgggggagcgcgaaggcccccaaaagaaagactatcatacaccccgagacaagggggggacccccacacaaggacttatcaacacaggagtgacaacaccaccagaggggactattcgctgggtgtcatacacaccagcagggggggggcacccccaacatatagtaagggagagagcgatcgagcacaaactcttaaacaacagaggaactaggaagcaaacacatgcgtggacgcgcgggcctgcgtaaactaaaacccaagcgtcgcggaatgaaacgcggcggaacaagaccagctcagcgcgaccgaacacggagcagaacaacacatcaagggagagaggagggagccaccaccataaacacctgaagagagggcgaggggggaagaaaacaaacaagtgggggccagacacagaccacccctacccacgaagacagcaaataaaacggcccctcaagcggaagaaccaacaacatacacacaatctaatagacagcggactgataacaggtagtgtgtcaaaaccccacacacacggaaactatgtcaatcatcagcgcaggatagaagaattgtcaacgaacgaagggtagatatactatcggacacatgc

SEQ ID NO: 718551 - DNA, 338 bp, Homo sapiens
  misc_feature (48)..(48): n is a, c, g, or t
  misc_feature (100)..(100): n is a, c, g, or t
  misc_feature (172)..(172): n is a, c, g, or t
  misc_feature (200)..(200): n is a, c, g, or t
  misc_feature (328)..(328): n is a, c, g, or t
  misc_feature (336)..(336): n is a, c, g, or t
cccaaatttgaagctttattaaaagggtattctatttccaactggctncccttaacttgaataaaatttactccccagtgccgtggctcatgcctgctgnaatcccagccctttgggaggccgaggcaggaggatggcttgaggccaagagtttgagaccggcctgtgcaanatggcgagacccagtgtccacagaattnaaaattaaccacgcagctgtaatcccagccacttgggaggctgaggcaagaagatgacttgagccctggcatttggctatgatcttgccactgcactctagcctggcaacagagtcagactctgtctnaacaaacnaa

SEQ ID NO: 718552 - DNA, 100 bp, Homo sapiens
tagggcgctgcgcggcgcaggaaaaatggcggcttcaggtgggcgcgcaaggccgttgtcctctctttgtgctcttttaccttctgtctgtctgtctggc

SEQ ID NO: 718553 - DNA, 729 bp, Homo sapiens
  misc_feature (1)..(1): n is a, c, g, or t
naggaccgcgcgaggcgtggagagcagagggaggggagagtcgcccccaagggcgcgggtccgacgccgtgcgttgggagagagccgccgaggggagagactgcggaggggtaaagctaacgccgtatggtgcgcgcgcacgggcggttggagtgcgcccagcggtgaaagaaatggagaggggggggagagggtgccacccagagggccgcccacgttgtgttgaacaaacaagcgagggcggtggtgggaggggcgaggtggccacaagatgtggcagtaggacacaaggcttaaggcggccgtgcggcgcacgaggtaagcccccctgggtgattacagaaggtgggggcgccattccccaggcgcgacagatgtgtgaaatgtcgtggagtaggacagaggaggagatgatgggcgaaagatggagtatggacaatggtggggtgcgtgtggggggggagaaggctgaaagagggcgagaaggaggggccgcggggggtggggagagcgccacgaatgctgttcacgaggaggcggcgtgttaaccaatacgagggggcgacgcctgtgaggcggaggaagttgcccacagggccacatggggacaagcccctatgggccatcgtctgtctaggggccccgtgcgggtgtcagacggctcggatgctcaaccccgggctaataaagaacatgcctcgagcaactgggggaaactaatgacaaaac

SEQ ID NO: 718554 - DNA, 606 bp, Homo sapiens
cctaggtatatgtcgtgccatgtgtaattcctttctatggcggaatagtattctaatatgtggatatcccatattttgtgcatccattcatttgttgatagacactctggttgttcctacctcttgactattgtgaataatcttgctaggtacatgggtggacaaatatctgtctgactccccgctttcaactctagaaagctttcttttaaaatcggtctatttaagtttctttaaaaagttaatttaagaaaaatactaaggtaaattgtagaacaggtgatatgtcaatatgaccccaaaaattgtaaagatggaagacgaatgcctgcagtttgggaaaccggatgagaggaaagacctggaagctattgtaaaatctatgctgagggtctggtgactactagaccaagggcatggcagcagagggcagctgaaagacttcaggaaggaaagatataagaattaagaaaggggcctggtgcagtggctcatgcctgtaattccatcaccttgggaggtcaaggcaggatgatggcttgagaccaggagttcaagaccagcctgggcaacagagcaagacctttttttaggaaaaaaaaaaaa

SEQ ID NO: 718555 - DNA, 509 bp, Homo sapiens
aacagggtattttagtttctgttctgggcaaatgtaaagcatccccccaaggggtttaatgagatttttttttttgccccccccgctggtgattgctaaatgtaacagtctggttgtgacgccgaaaaaagtgctttttttttaatgtgccggggcaaggtagttcactcttaagccctcttggggaatttcccccaccgggggaagttagaattccttcagggggacgcccgggtttatttgggatttatataccccccgcttggggggagaagcccttgtttttggaacccctgggggaggtgaactgaaagttaccgttgtgccccgaagttccccctttaaaggggttcccccagccaaatcctgggatggttattaaagggattggtggcccctcccatgccaaaaattttaattgaataatggggccccataaaattataaatggggaagaaggttggggatcccctttcatggggaatccaaaaacgattttatttttttga

SEQ ID NO: 718556 - DNA, 175 bp, Homo sapiens
cccccgtctggccaagtggcatcatacaactttggtatcgtgtaaggactcatgacacagtccatgccatcactgccacccagaagactgtgtgctggcccctccggtaaactgtggctgtgatggcctgctggggttctccatgcacatcatccctgcctctacgtggtgctgc

SEQ ID NO: 718557 - DNA, 100 bp, Homo sapiens
cgtttggactggctggttctcttggtggattcctcagattatgaacctgtgctggctgcatctgtagattatgaagacttgagaggtgggaggagaggaa

SEQ ID NO: 718558 - DNA, 507 bp, Homo sapiens
tagtttattactacctacacacgtttaatgggttgctttattcatacatgctacataccaatggcctgaccacatcgctcactgaggccattcttaccaacggaagaaaggctggtttctccaccccctgtaggaaaggcctgccttgtaagacaccacacttcggctgaatctgaagtattgggaaaaactaacggaaagaaaaaatacagaggaggttttgttctaatggctgtccaccgcagcctgggactacaacagcccatcgctcactgctgcttggagaaatatactttgctcttgtggacatcaggcttgatggtatcactgccaggttttcagccagctgggcacactttcccatgtttgacagtgaactggaaggcctgaactagtctcaaagtctcatccacagaagcgcccacagggaggtcatttacagtgatctgccgaagaaaacccttattatcaatgataaaaaggccccttgacgagatggcttcatct

SEQ ID NO: 718559 - DNA, 237 bp, Homo sapiens
gctgaggttatctagggttcactatccattgtgttgtaaatgtgtgtcagaaatgcagccagtgtttgtgggtctacaacactaaccagacgactttttcatcagtgctttactttagtcttcatgtacgtccattccctggctggaaccttcgttgttggtattggtattcagcagcagtgtgcagttttgctggccagagcgtcattctcctggctttaggttgtaaagaaaagg

SEQ ID NO: 718560 - DNA, 125 bp, Homo sapiens
  misc_feature (32)..(32): n is a, c, g, or t
  misc_feature (40)..(40): n is a, c, g, or t
  misc_feature (78)..(78): n is a, c, g, or t
  misc_feature (87)..(87): n is a, c, g, or t
tctgactcttcccccactccccatcttactgntttaattnaatttttcactccccagagtctaatatggattctgacncttacagtnttccgccccctcactacctcctttaatacaaattcaat

SEQ ID NO: 718561 - DNA, 733 bp, Homo sapiens
agtctgaaggcctcgctggtttctgtgatggctttgcagtaagtgccgcctgggctgcatgcattggctaacaggctgcagaatggcaaggaaggactctgcctagagattgtcgattggccaggagaatcatacggtcacttcaggtaacaagacccctggcaaattgggcacttggactatgtactagattggttgggatggtggcaggggtgtggggtccttcaaccctgcctgaattctcttttggcattctgtgctctgtatgctgctgtccccaagggctctttcttattatggcagggagtggggatggtcctactattctttctctggagaaggaaagcctccaagacatccatgtgcttgggcacgcttgagaaggcgttcatccaccacgcctagcaggcagaccttgaagccgtcacctttagtctatctgcagaggtattcagttcctggcacagtgggactaggggcatgtagagtatatgaggaggcagtatggctgtgcaagagccttcatttcagcttcaattaatagggaagactttatgataggtctatagatgctgaaaaggtatggcggtaagatgtaacaatccagcccttattaaaactcttagtaaattaagtctggaagaaacacgtagtctagataaaggtctgttcagaaagcaaagtgatgggcattctagagagtcagaggcggaggcattcccattaagtcaga

SEQ ID NO: 718562 - DNA, 797 bp, Homo sapiens
  misc_feature (23)..(23): n is a, c, g, or t
  misc_feature (61)..(61): n is a, c, g, or t
  misc_feature (64)..(64): n is a, c, g, or t
  misc_feature (79)..(81): n is a, c, g, or t
  misc_feature (85)..(85): n is a, c, g, or t
  misc_feature (92)..(92): n is a, c, g, or t
  misc_feature (97)..(97): n is a, c, g, or t
  misc_feature (113)..(113): n is a, c, g, or t
  misc_feature (141)..(141): n is a, c, g, or t
  misc_feature (186)..(186): n is a, c, g, or t
  misc_feature (195)..(196): n is a, c, g, or t
  misc_feature (200)..(200): n is a, c, g, or t
  misc_feature (202)..(203): n is a, c, g, or t
  misc_feature (210)..(210): n is a, c, g, or t
  misc_feature (219)..(219): n is a, c, g, or t
  misc_feature (230)..(230): n is a, c, g, or t
  misc_feature (234)..(234): n is a, c, g, or t
  misc_feature (237)..(237): n is a, c, g, or t
  misc_feature (251)..(251): n is a, c, g, or t
  misc_feature (255)..(255): n is a, c, g, or t
  misc_feature (263)..(263): n is a, c, g, or t
  misc_feature (266)..(268): n is a, c, g, or t
  misc_feature (271)..(272): n is a, c, g, or t
  misc_feature (281)..(281): n is a, c, g, or t
  misc_feature (289)..(298): n is a, c, g, or t
  misc_feature (300)..(301): n is a, c, g, or t
  misc_feature (311)..(311): n is a, c, g, or t
  misc_feature (319)..(319): n is a, c, g, or t
  misc_feature (322)..(322): n is a, c, g, or t
  misc_feature (332)..(332): n is a, c, g, or t
  misc_feature (336)..(336): n is a, c, g, or t
  misc_feature (340)..(342): n is a, c, g, or t
  misc_feature (344)..(344): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (371)..(371): n is a, c, g, or t
  misc_feature (397)..(397): n is a, c, g, or t
  misc_feature (403)..(404): n is a, c, g, or t
  misc_feature (448)..(448): n is a, c, g, or t
  misc_feature (454)..(454): n is a, c, g, or t
  misc_feature (460)..(460): n is a, c, g, or t
  misc_feature (474)..(474): n is a, c, g, or t
  misc_feature (482)..(483): n is a, c, g, or t
  misc_feature (488)..(488): n is a, c, g, or t
  misc_feature (490)..(490): n is a, c, g, or t
  misc_feature (507)..(507): n is a, c, g, or t
  misc_feature (510)..(510): n is a, c, g, or t
  misc_feature (522)..(522): n is a, c, g, or t
  misc_feature (528)..(528): n is a, c, g, or t
  misc_feature (545)..(545): n is a, c, g, or t
  misc_feature (548)..(548): n is a, c, g, or t
  misc_feature (571)..(571): n is a, c, g, or t
  misc_feature (573)..(573): n is a, c, g, or t
  misc_feature (576)..(576): n is a, c, g, or t
  misc_feature (584)..(585): n is a, c, g, or t
  misc_feature (589)..(589): n is a, c, g, or t
  misc_feature (592)..(592): n is a, c, g, or t
  misc_feature (605)..(605): n is a, c, g, or t
  misc_feature (625)..(625): n is a, c, g, or t
  misc_feature (629)..(629): n is a, c, g, or t
  misc_feature (641)..(642): n is a, c, g, or t
  misc_feature (661)..(661): n is a, c, g, or t
  misc_feature (663)..(663): n is a, c, g, or t
  misc_feature (679)..(679): n is a, c, g, or t
  misc_feature (681)..(681): n is a, c, g, or t
  misc_feature (692)..(692): n is a, c, g, or t
  misc_feature (698)..(698): n is a, c, g, or t
  misc_feature (703)..(703): n is a, c, g, or t
  misc_feature (731)..(732): n is a, c, g, or t
  misc_feature (755)..(755): n is a, c, g, or t
ttattctgtctgttctttttggngttacacatcctgggagtgttatacattgaacaaattnggnactaccttataattnnntctngcttggnaagantcctttaaaaaatgcnctgaggtacaaatcccctatgtcttaancatgggtctctgccattatacaaagggtttaaccaaatttatcanacacttccnngccngnngctctcnccccccctntccccccggcncccngcnccccctgttccccncttncccgtccnccnnngtnnccccttgcngcggcccnnnnnnnnnngnngtttttctgntttttggngtnttcttctgtngggngggnnngntcgggggtgngggttngggggnggngngtggggggggggggtggggggggggngggggnnggggggggggcattgggggggggggggggggggtgggggggtgngggggngggcgnggtggtggccgggngggggggnnggttngngtgctgggcttgcacanttnttttcgagatcncttccnattcttctaaaattttnttnttttttttttcccgatatttctnancanattttttnnctcnagngctttctcttccnttttccggggctgccgggcngctnccggctcaattnngccgggaaaccacaagacncngctcaacgtccaaganancaacccggganaccgcngcatnttcacgctcagccaaccctggcgactgnnccaatcgcgccaccgtctctcancagcctcgggattgatcaacttcctggtcttcaaatgggccg

SEQ ID NO: 718563 - DNA, 473 bp, Homo sapiens
gccccggtgatctagaggtccccagcgcgcgcaagtagtagcggtacagataaaaagggctttcttttctcctacagtctctagggcttggtaggtggcacataagtagaggagttaaccttcatctttggcagatgagctaaattggctaaaaatccactggaagatctcctcagtctcatagctcagagaagcacaaagaaggccgagacagcaagctccctccggtctcagctccggaagcaattggctactttcattaagcacatcaggtacagcagccaagatatccaatggtttaactagtaccagcttatttgcgggtggcggaataaattctttcaacggctttacagtagccaatcttcggtctcggtcgtttcccggggtgatcctctgaagaagattggacagtcgagactcatcacaataagacatggatctctcctttccgtcatgcggtatgggccagg

SEQ ID NO: 718564 - DNA, 496 bp, Homo sapiens
  misc_feature (129)..(129): n is a, c, g, or t
  misc_feature (342)..(342): n is a, c, g, or t
  misc_feature (446)..(446): n is a, c, g, or t
  misc_feature (451)..(451): n is a, c, g, or t
atccgtggtgtggcatgtggagtgctgctttcctttttgtagctgagcaggcctccacggtgcgggtggactgcatgctgtttttccgcgcctctgtggatgggcgtctgggctggtggctgccgggancggtgctgctgggagcgcgcatgttcgggaactcgcttggcttctgctttcagtggtctccttttatgccctccttcccctcacccctctcgctcttcagcccgccctgcccctgcgcccatcctctgtgtggctgcgtctgtaaacctgagtgtgtccttggaccttgtgcagtcctagattccggagcctgcaggtgtgggtccagatacncgccctgcctcctgctgctgtgtgaccatggacaggccttcgagtctctggtctctggtgggtgtctgagtctgcatgggaggcagaggttgcagtgagccgangactntgccactgcactccagtctgggcaacagagcacggctctgtctca

SEQ ID NO: 718565 - DNA, 199 bp, Homo sapiens
ggaggttgggggaaccgcccgcgacctccgtcggacacaccgccgctcaacccagacggccccgctcccgtgcccgcgcccggtccgcgcgcctcgttcccaccacctttcggtagccctggtttcggcgcgcccgggcccggcatgcattacgcgccgcctgcggccgcagcattcggtataatagacgacgcggccg

SEQ ID NO: 718566 - DNA, 180 bp, Homo sapiens
tgaatatcttttcattcacatctcctctgccttagtcacaatggcaacagtacagaaaaaggatgcttgatatcactaatcattagaggaatgcaaatcacaaccgtaatgagatatcacctcacacctgttaaaatggctgttatcaaaaaaatcaaaagctattaagtattgataagg

SEQ ID NO: 718567 - DNA, 134 bp, Homo sapiens
ttgcaaaacaggacagacaatcaaagatgtggtgtgtgtggaatacaccagcgcttgtcacactgcccataatctccaatggtacttttaaaatcaacaaaaagcgaaacggtggcccagaggctgctcctttt

SEQ ID NO: 718568 - DNA, 243 bp, Homo sapiens
ttcagttaccattactcgtaatcactggtcaattttatgaccgcgactttctggaaataaaatgtgtaattaccttttactctgagtcataatctcccaccttgtcttagaggttattcattccattatttagagggcctctattgccttgtgcctggtattattctataatcatcactttatgaagaataaaatctgtctttcctgccttcaaagttctcgtttgaatatttgctactacca

SEQ ID NO: 718569 - DNA, 3345 bp, Homo sapiens
ttggagtcagtggcaataaccagggcaataaccaggcgtgtcccagggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggatgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaatacacaacgtagaaaattagaccccctggtggcggcccggctagagagtccccgtgaaaattttcaaagcccagctccgcaaggggagggggcgaggcaccaacggggagctacggtcggggaaaacggggcctagaagaggagccgcaaagaaaaatccacgggagcccaagagctagggcgtggaagccgcaccaccaatataaaagacgcgggcggggggagagacacacggagcccatttaggcaaaaacccctccgcaggcgggtctgacggggaacatcgggggacccaactcggaggaggtccaagcagcccgtatagaaagaaaatactggcgccaccgggggaagatgacaccattctcctcccgcacataaggcccggcgtgtagacgtgagagagcacgtgaagtggcgaatctaaccagccccaagatgctacggagcacccacaaaggacacacaaagccacaaacagacaacgaaagacaccaacgcctgcgcgcgcgcccagagacacggaaaacaaacggagggcgcgccacgagacaggagcgcgaaagagccggagagcgggaagaagaggcacacaacacaaaaccggggcacggacgccgcacccggaggggggcggcacacgcgcagggaaca

SEQ ID NO: 718570 - DNA, 254 bp, Homo sapiens
agcggcgtcgcactcacacccgggcgcaggaggcgggcggcccgggccccgagcggcccccatggacgcccccagcacggggcgctgagaacccccgcgtcgctgcccacccggtccggcgcgccacgccgagggatctctggacaggacaagactccgaactactcacccagcacacagcccgggacccacaaacccagtgccaagataactgcgggagtggggacgggaacttattgggcaagggcaataca

SEQ ID NO: 718571 - DNA, 499 bp, Homo sapiens
  misc_feature (237)..(237): n is a, c, g, or t
  misc_feature (239)..(239): n is a, c, g, or t
  misc_feature (276)..(276): n is a, c, g, or t
  misc_feature (285)..(285): n is a, c, g, or t
  misc_feature (312)..(312): n is a, c, g, or t
  misc_feature (316)..(316): n is a, c, g, or t
  misc_feature (321)..(321): n is a, c, g, or t
  misc_feature (326)..(326): n is a, c, g, or t
  misc_feature (345)..(345): n is a, c, g, or t
  misc_feature (347)..(347): n is a, c, g, or t
  misc_feature (374)..(374): n is a, c, g, or t
  misc_feature (378)..(378): n is a, c, g, or t
  misc_feature (393)..(393): n is a, c, g, or t
  misc_feature (401)..(401): n is a, c, g, or t
  misc_feature (413)..(413): n is a, c, g, or t
  misc_feature (482)..(482): n is a, c, g, or t
ttggagtcagtggcaataaccagggcaataaccaggcgtgtcccagggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggaggntntacctgccgggctgccggacggaggacatatccaggntgaccgccncgctggaggactgatagcgcctgaagntgcnctgcnctgcnatgccgcggctgcgaccanangtgcagccccccccaagctgctatgcncccnctgctgtgggggcgnccccctgngccccagaggantgcccatggggtatcttgctctgctgtgcgatttcccaagcctggactactcagcacagcaggggagcnggcgcaaacacactcca

SEQ ID NO: 718572 - DNA, 3258 bp, Homo sapiens
ttggagtcagtggcaataaccagggcaataaccaggcgtgtcccagggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggatgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaatacacaacgtagaaaattagaccccctggtggcggcccggctagagagtccccgtgaaaattttcaaagcccagctccgcaaggggagggggcgaggcaccaacggggagctacggtcggggaaaacggggcctagaagaggagccgcaaagaaaaatccacgggagcccaagagctagggcgtggaagccgcaccaccaatataaaagacgcgggcggggggagagacacacggagcccatttaggcaaaaacccctccgcaggcgggtctgacggggaacatcgggggacccaactcggaggaggtccaagcagcccgtatagaaagaaaatactggcgccaccgggggaagatgacaccattctcctcccgcacataaggcccggcgtgtagacgtgagagagcacgtgaagtggcgaatctaaccagccccaagatgctacggagcacccacaaaggacacacaaagccacaaacagacaacgaaagacaccaacgcctgcgcgcgcgcccagagacacggaaaacaaacggagggcgcgccacgagacaggagcgcgaaagagccggagagcgggaagaagaggcacacaacacaaaaccggggcacggacgccgcacccggaggggggcggcacacgcgcagggaaca

SEQ ID NO: 718573 - DNA, 181 bp, Homo sapiens
atagtcaaactggtatccagtaagtaccaagtcctcatttatgtccgggaagacttttgaatactttcaagtgcatatattatattatcacctgctcgtaccattaatgtagataatatagttaccagacaacaacttagagttttatactagcacagacttccaacttttccgtcaagtc

SEQ ID NO: 718574 - DNA, 3030 bp, Homo sapiens
ttggagtcagtggcaataaccagggcaataaccaggcgtgtcccagggggagccccgctctgcagccctgtgcgccgtagagagctggacttaggctggcagcatggccgagttcagggtcagggtgtccaccggagaagccttcggggctggcacatgggacaaagtgtctgtcagcatcgtggggacccggggagagagccccccactgcccctggacaatctcggcaaggagttcactgcgggcgctgaggaggacttccaggtgacgctcccggaggacgtaggccgagtgctgctgctgcgcgtgcacaaggcgcccccagtgctgcccctgctggggcccctggccccggatgcctggttctgccgctggttccagctgacaccgccgcggggcggccacctcctcttcccctgctaccagtggctggagggggcggggaccctggtgctgcaggagggtacagccaaggtgtcctgggcagaccaccaccctgtgctccagcaacagcgccaggaggagcttcaggcccggcaggagatgtaccagtggaaggcttacaacccaggttggcctcactgcctggatgaaaagacagtggaagacttggagctcaatatcaaatactccacagccaagaatgccaacttttatctacaggctggctctgcttttgcagagatgaaaatcaaggggttgctggaccgcaaggggctctggaggagtctgaatgagatgaaaaggatcttcaacttccggaggaccccagcagctgagcacgcatttgagcactggcaggaggatgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaatacacaacgtagaaaattagaccccctggtggcggcccggctagagagtccccgtgaaaattttcaaagcccagctccgcaaggggagggggcgaggcaccaacggggagctacggtcggggaaaacggggcctagaagaggagccgcaaagaaaaatccacgggagcccaagagctagggcgtggaagccgcaccaccaatataaaagacgcgggcggggggagagacacacggagcccatttaggcaaaaacccctccgcaggcgggtctgacggggaacatcgggggacccaactcggaggaggtccaagcagcccgtatagaaagaaaatactggcgccaccgggggaagatgacaccattctcctcccgcacataaggcccggcgtgtagacgtgagagagcacgtgaagtggcgaatctaaccagccccaagatgctacggagcacccacaaaggacacacaaagccacaaacagacaacgaaagacaccaacgcctgcgcgcgcgcccagagacacggaaaacaaacggagggcgcgccacgagacaggagcgcgaaagagccggagagcgggaagaagaggcacacaacacaaaaccggggcacggacgccgcacccggaggggggcggcacacgcgcagggaaca

SEQ ID NO: 718575 - DNA, 354 bp, Homo sapiens
  misc_feature (318)..(318): n is a, c, g, or t
  misc_feature (341)..(341): n is a, c, g, or t
aggctaaatactcaacttgaactgcctgaattcaattcccagctctgccacgtatagctgagtgaccttgcggatttatttcatctctgtaggcctcagtttccccggtttattttatttttatttctatttgtattcattttgctttttagggccgcacccggagcatatggaggttcccaggctaggggtctaatcggagctgtagccgccagcctctgccacagcaacagcaacacaggatctgagcctcgtctgtgacctacaccacacagctcagggcaacgccagatccttagcccactgagcgaggccagngatcgaacccacaacctcatggntcctagtcggatt

SEQ ID NO: 718576 - DNA, 1777 bp, Homo sapiens
acgcatttgagtggccccgtccccgtgtccccaccctcaaggctcaccctcaagcctccgcagcagggtcctcaggtccctggaagccccatcccagcccagctctccttgcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccggggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagtcttttggaggctccaagcctcaaagtgcccgcagagcccaccttgagggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaatacacaacgtagaaaattagaccccctggtggcggcccggctagagagtccccgtgaaaattttcaaagcccagctccgcaaggggagggggcgaggcaccaacggggagctacggtcggggaaaacggggcctagaagaggagccgcaaagaaaaatccacgggagcccaagagctagggcgtggaagccgcaccaccaatataaaagacgcgggcggggggagagacacacggagcccatttaggcaaaaacccctccgcaggcgggtctgacggggaacatcgggggacccaactcggaggaggtccaagcagcccgtatagaaagaaaatactggcgccaccgggggaagatgacaccattctcctcccgcacataaggcccggcgtgtagacgtgagagagcacgtgaagtggcgaatctaaccagccccaagatgctacggagcacccacaaaggacacacaaagccacaaacagacaacgaaagacaccaacgcctgcgcgcgcgcccagagacacggaaaacaaacggagggcgcgccacgagacaggagcgcgaaagagccggagagcgggaagaagaggcacacaacacaaaaccggggcacggacgccgcacccggaggggggcggcacacgcgcagggaaca

SEQ ID NO: 718577 - DNA, 115 bp, Homo sapiens
gctgccttctcagactgaaatttcttttcacacttcaccaggtcctccacagacaccagctcgttcagcacggcctccatggcactgcccccgcgagcctcacactacagtctac

SEQ ID NO: 718578 - DNA, 239 bp, Homo sapiens
  misc_feature (6)..(6): n is a, c, g, or t
aagtanagatgccaggacccgctgaaagcctagaaatggtgagattgccagttccgacatctggagaggggcaagggctggttggaactggtgggaagcagctgtggtgggactcaggcctccccgcagtcagctccacaatctgcaccctgagttctccttgcccaggttggcatctgtcccctgcagccataagatggcagctaggctgacagccgggcccccgggcgtcctgtctt

SEQ ID NO: 718579 - DNA, 95 bp, Homo sapiens
tcttctcttctcccctcccgcatccgggtagcagcatagtcactctgcgtctctcccttgatccccgcccgcatggctgcgtctcctccgcacgg

SEQ ID NO: 718580 - DNA, 230 bp, Homo sapiens
  misc_feature (22)..(22): n is a, c, g, or t
  misc_feature (37)..(37): n is a, c, g, or t
  misc_feature (49)..(49): n is a, c, g, or t
  misc_feature (53)..(53): n is a, c, g, or t
  misc_feature (229)..(229): n is a, c, g, or t
ccgcaggggctcggctgttttncgcgcggcaggcggncccatggcgcantggngaaagctgctcaaggagcagaagtacgaccggcagctgaggcggagtctcgctctgtcgcccaggctggagtgcagtggcgcaatctcggctcacttcaagctccgcctcctgggttcacgccattcttctgcctcagcctccgagtaggttgtggggtgatcatgggcaagaggnt

SEQ ID NO: 718581 - DNA, 256 bp, Homo sapiens
  misc_feature (149)..(149): n is a, c, g, or t
  misc_feature (155)..(155): n is a, c, g, or t
  misc_feature (191)..(191): n is a, c, g, or t
  misc_feature (233)..(233): n is a, c, g, or t
acccagagatacttctgtgccacgacccaaggcctggttctacacaaattggtgctgtttggaagacaccaactagagcagagtttttgccataaccagtgggtctgaaatgcaacgaggagaaccatcactccctgaaaggagctaantagganccagtagctgctctgtggtcccacctccacagagcncagctagctaagtccactgcttgaaatccttgtgccagcacngcagcaatctgagctctacctgg

SEQ ID NO: 718582 - DNA, 208 bp, Homo sapiens
gcattatccgggacgtacttatggctgactcatccgctaccttcacgccaatggcgcctcaatatactatatctagcctctagcctacacatacggaagaggccatatagtaacggatcattatctctagctcgagaaatcctgataacaatcggctattatcactccttgcgttgcaacatattagcacacagcacttcattagagc

SEQ ID NO: 718583 - DNA, 135 bp, Homo sapiens
gaccgtgaactgcctgatatgatggaactgcccgaccacccctggttctgtcggcgtccagttccacccggtaggttcactgtccacccctgcgtgacggccatccgctgttctccatgctacatcctgcgccgc

SEQ ID NO: 718584 - DNA, 3530 bp, Homo sapiens
ttattaaacaatctcatttaacatttaaaagaacaatagtattcactttgcttattgagggtggtactgcagaaagattcagaacataggctctggagtcagactgccaggctttctatcccagcatcttctcttgctcttgcgtgacctggggcagattacttaaatttttttctaccccacatgcctcatttgtaaagtggagttgtagtggtaatacttcatatgattgttggggagattaaataaataatgcatatacagaatttaaagcagtgctgaaacaggaaatatccatgttaaataactgatcattttctttttaaagctcagtttccttttcttctctcaatacttaaaaggtcagaataggtaaatgtaagcaaacaagactgaaaaattaaccagcattgttttattttctaaaatcaggtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaaggtaacgcatttctttccaggtcttctcttcctccaattccagtttatcttacaccttctcgttttagcttacagttctgaaagagtataagttagaaattcctagtgcattgctttataaaccttaagcctctgtatattgtagctcaagatcttccaagtgaacatttgagatgtgtgtgtgtgtttgacttctttgattcatgggaattcacttagaaatcataagcttatttaagggcttcacctcctgggatgcaaacaaacttttttttagcttactggtttgatgttcaaatcatgacttttaggggcttaaagccctaaaatatctttaaaagatatttttaaagtatgtacagattagaagtgtttatattagaaaaggaggccaaaatattacataattaattggaaagtgaacatagtgctgccctatattttggggtactcagagtccagtagctcatcttgggtgctattgttttctctctactctccccacttctcacacatccctccagtggtttaacgtggtctctcttgctttaaaaatattttctaaactatattccatcataatgatagccaattagttattaaataatgtacaatgatgataatgaattctgttaagccgtttaccagaaacatcccaggctatggagtggattttaagcattgccaggaggcagccagactgaagcgaggctgctccctggaagagccactcagccagcttccagccaaagcagcacaatcgttcctttccttacagggtcttaaaaagcaagacaggatcttttgttttgttttgttttgttttaagaataatatcttcagagcagttttacatttacagaattaatgcaaagaaagtacagagagttctcgcataccccagccagtttcctctattattaatcccttgcgttggtgtggtacatctatcacagttactgaaccagtgtagatacatcagtaactagagttcatactttattcagatttccatagttttccctaacgtcctttttctgttccaggatcccacccagcatatcgcattacatttagtagtcatgtgtctttaggttcctcttggctgtggtagtttctcagaatttccttagtttcgatggccttcatagttttgagaatgactggtcaggtattttgtagatgatccctcatgatattagaatggggtaatatattcttgagaggaagaccatagaggtaaagtgccattctcatcacataattaaagggtacctgttggcatatatctatcagtatgtatagggaagctgggcatagtggtcactcttgtaatcctagctacttgggaggctgaggcgggaggatcacttgagctggaggctgtagtgcacaatgattgtacctgtaaatagccactgtagtccaacctgcgtgacatagcaagactccgtctgtaaaaataaaaagaagcaagtatcaaatataagggtattatcaatttgatttttccctattgaagttaactttgatgacctggcttaagatattgtttgtcaggtttctacttttcttttccctttactggaaggaagtcactgtgcatagccacacttaagatttctaccccctcagagtggaggctcagcataaattatttgaatttctgcttgggagatttgtcctttctccctcatctgtttatttatccaagcatttatttatatcattattggcccagatatttacgtgatacttcactttataatccaatactactgctttttaaaatttgttgctcagattgttccagttttgaccattagaagctccttcttttagtttccctcttgggctgctgctgctttttttttttttttttttttccttccccagatggggtcttactctgtcacctaggctggagtgcagcggcatgatctcagctcactgcaacctccacctcctgggatgcaagcaacgctcccacctcagcctcttgaataacttggactacaggcatgttccatcacgcctggctaattttttgtacttttgatagagacagggtttcgctatgttgctcaggctggtcttgaactcctgagcttgggcggtccacctgccttggcctccaaggtgctgggattacaggtgtgagccaccgcgcctggcctcctgtgtttaacatatatactgttgttgtcattgtggggtctttttgtttgtttttaagcatttcctttctggcactacaagatgcttcaagttcatcttgtatatttcatgcccttgtcctagaatcagccttttctccaaggaccagggccatttttaatctaatttgaaaattacattctcgattgggactattaagtttgaagtagagaaaaattgaacattgactaactgctgttcattgcatgatcatgaagaatagatctttgtcatcctagcacttgtattgccaatttatgaagtaaaacaaatcatgtt

SEQ ID NO: 718585 - DNA, 829 bp, Homo sapiens
agcgggctgcaccttcgagctggggcagttccggccgccgccgcgcgccctctgcctcgtagctggccgcctgccctgcggtcgacctgggcctagccggccgccgccgccaggtcacttccagcgcggccgcctcatgctccagctgccgccagtctgtcccctggccgcgctgcatggcggcttgagtgaggccggctcctgtctgctagttggacggcgctgactacgccgggcgccctggctggtcttcggggcgcagtgcgagtgcctggtggcgggagcacgggctaggccgaccgcgtgtgcaagttcggctgtccggcgcgaccctcttccctgtcccggcggtcacccaagcgctcgggtgcgccgtggtcccgatggccccagtcccgtatcgcggacggcggcgcattgcttgtcacttctggaaacttcccagggcatacggtgagacgccccttctgtcccgacacggcctctggtgcgccctttctcggggagctagtcgctcgtgtcctagttgcgctcgaaaggttcgtcccaggcacgttcgttgtgcgtggagttggcatcgcgttcccattgcagagctcaggaccgggcaccggccaaaatcgctttgctatagcccgcgagaggcacttcgcctcgagggaactccccttggagtgaaagcgctacttctcattcgggcgaggagctgttgaacgccacccgcgcgaaccgtgttccaggtgaacaaaggctagcgccgttggtgccactgtgtgttcccctggatggagagcgtcgttcttattttcctcggcgtggcgttgcccac

SEQ ID NO: 718586 - DNA, 1074 bp, Homo sapiens
  misc_feature (428)..(428): n is a, c, g, or t
  misc_feature (915)..(915): n is a, c, g, or t
gcggctctcgggccctggggctgttgagttaagtgcgagtgggggagtcccctctcgcacattaactcataacgggtgtctcggagccctgggagctgttgtttactcggatgtttgttgttgaacgctcatggtgatctcacgtcgtgggctgcagcagggcagaaagaattgatgaaagttatgagaactttgacgggtttctctccaagaggtcatcagagagctcactttgcggaggtgcatcaagtgtggcgggtgcggaggcaaaatcggtggtcctcgtctggtggcgctcttcggtctccttaggtgctagctatcttccgttcgctccatgctctcttctcttcgtgacacgagcgttggcgatgaatctttggccgagggatcctctcccttgagctcgagggcgggccatcggaatntggaggtttccagattgatagcgctcgaggcgttgattgcactttgcttgtataggggtgagatccttcgtgggggaacggaaacgtgcgggccccgtgccctctgcggtggcccgtgcaagagtcgtgggctcagagtgatagctctgtgggagcgtgttgaacaaatgtgaacccgtgtatatacggggaaggaagcccggcccagggggagccggtgcctttggttaggaaccattgaggaagtgtcatcaagcttgtcccgcccagcgcttgtgtgttgcccaagataagcgcaatatgggaagggggttccaggaaggccgccgtcattgtgggcggcgaaggggaaagatttggcgttgtttccaaggtttccagttagggagcacattgggttagaacggggtggggacacgatttcgttcgttccaccagtgggggggctttaaggttgaaactttgggccccagagggggcccccttnttagcaccagtggttgacccctattctttctacacgagcaaagagacccaaaaggggccgtgtgagggactgtggcgttcgttggggcagaaaaggagcgtcctggggagagaaccaccttgagttggcgaaggcccttgggggcttgggggttcccca

SEQ ID NO: 718587 - DNA, 142 bp, Homo sapiens
aagagtgctcaggtctgcggaacgctcattgctctggtgatgcactggcctgtcaggcagctcgtagctcttctccagtgaggagctggaagcagccgtggccatctctatgctcgaagtccagtggcgacgtagcacagct

SEQ ID NO: 718588 - DNA, 256 bp, Homo sapiens
ctgtttccgcgatagcttcgtctccggaaataaaacacttcgcggatgcggactccgtcgcgttggtcgcctctggaaagctcatatacagcagagcgtgtgcctcctgtcacggtaagcgacttcaaggtcagccgctttggcaattgaaggatcagttcgaaggaagacgtgcccccgcgcacgatcaaacgggccacacctggagtcattcaggggaggagcttttccacaaggttcagaacggaaggttcct

SEQ ID NO: 718589 - DNA, 659 bp, Homo sapiens
ctatgattcaggcaccgaaacttactgcgaacacctgactgtcgtcaacgaatatgccgattacggctatggtaatatggtctatggctcttcacatagtcattgacagattcgaagacagtactgtcctatacacaatgcacccaatgaccactatataagttgcataagtatggccatgaagtcactcctagtatatagccctgcatgacagactacactatagatgccataccgcggcatggactgacttattgatgactatgactaagacgcatgagaagcatgctgccatttccatcctactgcagacacttggactgatgaccgatgtatatgactgtatgctgctcgcaggcaaactgtgctgtgactcgccatcaaacctcgactatgaccaatgagatgactctagcagagcgctgctggagagaccgctgctgacctatcctgagctgatatcgagacaagcttggtaatcatgaggacttataccgctatagggatgctcatgacaggcttctgcagcatacatctgatggcattctatggaggatattgaaagcatgaacatctgcatgatggctatgattgacctgtgacgggactggtcgcagagaatcttaccaactccttcgttatggtccatatctggatgg

SEQ ID NO: 718590 - DNA, 108 bp, Homo sapiens
gattttttttttttccccctttttttttttcagggaatcatttccccccccgccccggggggcaaaaatttgttgggggcccccacccaaaaaatgtttgttttccta

SEQ ID NO: 718591 - DNA, 668 bp, Homo sapiens
  misc_feature (233)..(233): n is a, c, g, or t
  misc_feature (269)..(269): n is a, c, g, or t
  misc_feature (305)..(305): n is a, c, g, or t
  misc_feature (316)..(316): n is a, c, g, or t
  misc_feature (320)..(320): n is a, c, g, or t
cctgctactgtcacaggaccttaaatctactcaccttccgggttcaagcgattctccgctcagtctgctgagcagatgggatacaggcgcctgccaccatgcccggcttatttttgtatttacggtggagacggggattcgctatgtggtcaggctggtctcaaactcctgaccttagtgatccacctgcctcggcctcccaaaatgctgggattacaggcgtgagccaccgnacccagcctaaaattttactataaattcttggcttnagattagatggtgtaacagcataaaacaaggcaacnggagggttcanatanaatgagacattggagctgtaatgcctctttcacataagccccattttccccagctgaggcacaggcctttcagagaccacagcaagccatcacaacacgagaggtgctgtgcaccagaagcttctctgactggaaggtgagataaggacccattagggtgatccgaggagcagatgacgtgctttgggatatgatggaagactgcagatatcaatgcatcttgctggaaatacaactggagcttttttgcttgggttgctaataaaatctttacccagttgtcttatgtcttctcttactatcatttttccaagcttctgccttattttctgaattgtgcggatggcc

SEQ ID NO: 718592 - DNA, 137 bp, Homo sapiens
gatcccttactaaatggctgtcatttcacccagtatagcaagtgcgtgtacaaagaagtatattctgaatacattatatccattcatttagcacaaataaatcatttagtttcactttgcagtggaacactgagtca

SEQ ID NO: 718593 - DNA, 217 bp, Homo sapiens
cctctggctactaaagtggtgactagcagaagtcacagaccgtgacttggccttgtgttgctggaagcgtatgttggcagagccacagcgttgcagccctgacaagatcaagcaaaagtttcctgtctatcacatttgaaagtcttttttcacatcaaggactgggcatgtagattcttttgtagtctggacaaatcacctacttgcgccatctttc

SEQ ID NO: 718594 - DNA, 246 bp, Homo sapiens
  misc_feature (219)..(219): n is a, c, g, or t
  misc_feature (222)..(222): n is a, c, g, or t
ataggcacagcgctgaactgtgtgcttcagttccaaagtacctacctcaggagcagagatttgatatcgagtgctgggcttagtctgctgataaatctagtggagtatatgctcggaatcggcactgtcttgtcaacatggcatcgtgctctttgattcttccatctgtatggagaaggggatgatagtttaaggatagtggacgttcatgctgtccangcnttatgcagctattccttgagcgag

SEQ ID NO: 718595 - DNA, 223 bp, Homo sapiens
aattgatgtagcaatgctgaatttgccgtaatattcacacgcccaacttctacgataggcgtcttgctgtgttgcccaggctggtctctattcctggcttcaagtgatcctcttgcttcagcctcccaaagtgctgggattacaggtgtgagccgctgagcctggacccccttatagtccttgcttcacccctggaaatcactcctctgtcctctagctttgg

SEQ ID NO: 718596 - DNA, 287 bp, Homo sapiens
gaagctgagccccaccgcgtaatcgcttcagctctgcagcagcgacatgagaggaaaagtccaggatgggacaagcgcccttagtcgtgtcccgagtactgaccacaggtgccagtgcaacatgctgcattgcagccctgggccagaccatgtcccgagacctgggtcacgaggtggagcagagagtgcagcagcagcaggaccaagtggctcagagtccaacccactggatgtcgtggactttggtgccaagactatagctgtcactccctcctggtgtcacactg

SEQ ID NO: 718597 - DNA, 2547 bp, Homo sapiens
  misc_feature (41)..(41): n is a, c, g, or t
  misc_feature (46)..(47): n is a, c, g, or t
ttgctaggtagaggtctggattaaatcgggaggcggtccgnagtcnnttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccgatttgaagaccttgcttctcatcacccactggattatgccccaggctttcctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacgtgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaagttttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcaatgagccgagatcgcgccactgcactccagcctgggtgacagagcgagactccgtctcaaaaaaaaaataaaaatttattctttctgggggggggccccggccccaatctccccttaggggggcgtattaaattcactggccgg

SEQ ID NO: 718598 - DNA, 814 bp, Homo sapiens
gggcaagtggctcatgcatgtaatcccaacactttgggaggctgagttgggcagactgctcaagcccaggagcccaaggccagcgtgggcaacttggcaaggctgtgtctctgcaaaagaatacaaaaattagctggagtggtggtgcacatgtgtagtcctagctactcgggaggctgaggtgggtggatcgcttgagcccaggaggtccaggctgcagtgagccatgatcgagccactgcactccagcctgggcgacagagcgagaccctgtctaaaaatattacagagataggccgggcgtggtggctcacgcctgtaatcccagcactttgggaggccgaggcgggtggatcacgaggtcaggagattgagaccatcctggctaacacggtgaaaccccgtctcaactaaaaatacaaaaaattagccaggagaggtggcgggcgcctgtaatcccagctacgcaggaggctgaggcaggagaattgcgtgaaccccggtgggtggagcctgcagtgagccgagatcgcgccactgactccagcctgggcgacagcgagactccgtctcacaaaatatgtatatatattacagagatagccataactacttaacaggggttagagaaagccaactcttgacaatgcttgggagcaagacctacgaaaacctgtggacagcccttatgacagcacagttcctgcggttccaggggaagttagttggcaaaggatggcaggctctcctgggatacagccactgaaggcaacaataattgaaccttgtcatgtggatgcgacctcgatataca

SEQ ID NO: 718599 - DNA, 2443 bp, Homo sapiens
  misc_feature (41)..(41): n is a, c, g, or t
  misc_feature (46)..(47): n is a, c, g, or t
ttgctaggtagaggtctggattaaatcgggaggcggtccgnagtcnnttcctgcagctgtttccctgtgggtcgggttggactgacttttgacagtcagccttcggctgcggagggggctcggcggcggccggcggagaaagttgctccgagatttgaagaccttgcttctcatcacccactggattatgccccaggctttcctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacgtgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaagttttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcaatgagccgagatcgcgccactgcactccagcctgggtgacagagcgagactccgtctcaaaaaaaaaataaaaatttattctttctgggggggggccccggccccaatctccccttaggggggcgtattaaattcactggccgg

SEQ ID NO: 718600 - DNA, 449 bp, Homo sapiens
accttggagcttggacatgtctctcaagtctcatttaagtgtgtgtctataactaaacatagggtccagatatgtctgaaagacttaacctcaaatgggatactgtcatttcataatgtatgctggagtaggcttagttacaatttgaggaatatcatgtgctgcaacttcttttcctagaaagtaatacttttgatgtttctcacaaattataatttctaggactctgagctgcctacttctacttactcctttatagtaaagggttgtagtagtagtagtagtagtccttactggttactgcttttaactcctaaggtctttttttcaaggccaatttcacttaaccttagctattaagcccaagtggaggtgctaaggtgatttgaaaaatggaaatatcttaatttaaattgcacaaacaaacactatcgtgcatatttgagaag

SEQ ID NO: 718601 - DNA, 1939 bp, Homo sapiens
  misc_feature (151)..(151): n is a, c, g, or t
  misc_feature (169)..(169): n is a, c, g, or t
  misc_feature (193)..(193): n is a, c, g, or t
attcttacaagtagaatttttggattaaagggttagcataagcataagacttctgatataatgcttggaaattaaagtatttttaaaagcgtattcacttttttagagacacagccatttggaatttgggtttggctctaaagcaattttnctgacaatagttggaggnatcattttatctttttagatcgancctgtgtaaaattgtaattttaaaaatccattaacttcacattcacttaaagctaagaatctgtgaattttataatttgaacttagaattacaaattacagtgataattggtcaggttgtcattcacttaatgaatattttgaatatattatttttatctcttgctttagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacgtgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaagttttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcaatgagccgagatcgcgccactgcactccagcctgggtgacagagcgagactccgtctcaaaaaaaaaataaaaatttattctttctgggggggggccccggccccaatctccccttaggggggcgtattaaattcactggccgg

SEQ ID NO: 718602 - DNA, 495 bp, Homo sapiens
acctcacacacggctaacactccccccgggcccgtctccggcatggagagagagcggaaagtgagtatgcggctgcaccgcggggcccccgtcacatctccctcgtccgacctcacaggccgacaagatacctctcgcatgtccacctcacagaggagcagggacatggcatctctccggctgcacgcggcccgccagggcacccgctgccgtccccagcgcccacgacgcacctactgagggccccggcggcctctgaccgggctcccagccacgcaggccactgctggccacgagggcaggtgggtgttaggtgtccaggacaagcccaagcgctgggccgggctggatggaggacagggtgcaaagaccagccctgggcactgaccacaccacgcacactgccagccaggcagaggggcgaaaaagggaaggcaggagggtcctgtttcttaaacacagcagtgcataaagtggcttgttccccctcaaaaa

SEQ ID NO: 718603 - DNA, 163 bp, Homo sapiens
gactcgtcacgtcgcactctggggcccagcaggttgccaccaagctggaaggcagtgatttagaccttgtgagaataggacactggcaggagggaaaaggaagaggacaaaggagggtggtggccaaagtggcagagctctgttgctgtttaacaaaagaggc

SEQ ID NO: 718604 - DNA, 1869 bp, Homo sapiens
  misc_feature (107)..(107): n is a, c, g, or t
  misc_feature (116)..(116): n is a, c, g, or t
  misc_feature (127)..(127): n is a, c, g, or t
  misc_feature (149)..(149): n is a, c, g, or t
  misc_feature (182)..(182): n is a, c, g, or t
  misc_feature (194)..(194): n is a, c, g, or t
  misc_feature (210)..(212): n is a, c, g, or t
  misc_feature (225)..(225): n is a, c, g, or t
  misc_feature (243)..(244): n is a, c, g, or t
  misc_feature (248)..(248): n is a, c, g, or t
  misc_feature (266)..(266): n is a, c, g, or t
ggaaactgaaatctctgctgacctatttttactttgatctaaaaagaattcgatacaattctttaacagtacataaaactacaattgcaaaagaaaatggcagaaanaaatgtccngggaaagaccntaacagtttctaataatgtatnctactgacaatgcattgaggtggcggttctggntaagccctgggnaactgaaatctctgcnnncctatttttactntgatctaaaaagaattcnntacnattctttaacagtacatnaaactaaaattgcacaagaaaatgaaacttttaaatagtcaaagttctaagccgtcaggctactagttgaccagaacttgagcaagataaaaagttatttctgatggggtaggtaggtcacatgctatgagcggctcaacaccacttgaccctgcaaaagcgttatgacctaagaagcacgttcttcacacccacctccccccgccccgcccccgggcccccaggttttgacatctcatggtaccactgtgggttacacgtattaacattaagcagaggaatgtactcatatcaacttgccctgctttgtggtctttttgatatgagtacattcctctgcttaatgttaatacgtgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaagttttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcaatgagccgagatcgcgccactgcactccagcctgggtgacagagcgagactccgtctcaaaaaaaaaataaaaatttattctttctgggggggggccccggccccaatctccccttaggggggcgtattaaattcactggccgg

SEQ ID NO: 718605 - DNA, 2668 bp, Homo sapiens
  misc_feature (41)..(41): n is a, c, g, or t
  misc_feature (46)..(47): n is a, c, g, or t
ttgctaggtagaggtctggattaaatcgggaggcggtccgnagtcnnttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccggcatttcacgtggaccaggtggatcatctgtgcgtgcagctgccttggccctctcagttgcccccgccccgtgggagtcgggggattccatccttcgtgatggcatccataccgggttgagatttgaagaccttgcttctcatcacccactggattatgccccaggctttcctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcagggtaaaaatcatggtaagaaactccgaaattactatgcagcaaatagctgtcctcctcctgctagaatgagcaatgtggtcgagcctgcagctactccagttgttccagtccctccgcagatgggctcctttaagccaggaggccgagtgatcctggccacggagaatgattactgtaagctctgtgatgcctccttcagttccccagctgtggctcaggctcactatcaagggaagaatcatgccaagaggctgcggctggcggaagctcagagtaactcattctcggaatcctcagagctgggtcaacggcgggccaggaaagaagggaatgagtttaagatgatgcctaacaggagaaatatgtatacagtacagaataattcagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacgtgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaagttttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcaatgagccgagatcgcgccactgcactccagcctgggtgacagagcgagactccgtctcaaaaaaaaaataaaaatttattctttctgggggggggccccggccccaatctccccttaggggggcgtattaaattcactggccgg

SEQ ID NO: 718606 - DNA, 809 bp, Homo sapiens
tgcagtgccccccagaggttcccgtcctaggggaaggggggctctggccttttcttatgcttgtgttgtggctcttgtgtccttcggttctggactgccctggccattttcagccggttggtgcctttttcccctgagtgtttttctgtcttttctgttttcctgtctccggtggacggtacgaaggggtcgctcgagttcttgcggcgccaatatcgcaagtgggctgcgtccgccttgcggtttgcccactatcttggggaaagagcaagccacgggatgctggggttgactggtgggaagcgcggtgccgcgttagcctcccgctctgccctgcgttcttgggtccggttggaggcccaggcgtttgctaggatctgcatcagttgtacctgctttgcactatttcgtctcttgtaacacttggccctgtgtgaagtattctcgaatctcctccttgctctgataatcttcagcgattgccacttgtgataatgcgcactagtgacagcagctgtctgtcggtaatcggtactactttattaaggatctttcagattactctgtatagtagtccatatggcacccctaccccatccctttcgtgccactcctgtcctccaccccgtaccccctagtgtgtataagcatggcatttcgccagctctgtactgtagcattgccactcagtgaatataatggacattattatgagaaccgtggacttaaccgaagatggaaccaacggacattctatccgtgttgtacactagaatgatgaagggttccactgttgttgtatgtcttta

SEQ ID NO: 718607 - DNA, 81 bp, Homo sapiens
aagacagcagcatatatctctgcagcgctcaggagcgggagatcgagcagtacttcgggccgggcaccaggctcacggtca

SEQ ID NO: 718608 - DNA, 1481 bp, Homo sapiens
  misc_feature (501)..(502): n is a, c, g, or t
ctctgtctcaaaaaaaaaaaaataaaaaaaaaaaaattaaaggggcatgggttccattccagaaacaaaagtagagtattccatatattccctggaatttataacttggccactggtccttcataaaaaaaacctggaataaaatttgtcccatgggccgggtgcatgtgggctcattggccttggtaattctggaggcactttggggagaagcggccaagggtggggtggcgactccactttgaacgtcagggatgttcaaagaccacgccttgcgccaacaattggttaaaccccattttctacaaaaaattacaaaaactagctggggtatataggggcataagcccccggttaaaatcccctaagcctaaatcttgaaagcgggctgcgaaggccagggaagaaaatgcgcccggaaaatcccgggaaggcccaacaagttggccaggtggagctcgcgaagaatatcacgtggcccccatgggacatctccccagnnccggggggttgaaataagaaccaagaatctctctgggtgttctcccaaacaaacacacatacacacataaccaagaccatatatctacccccccacccacacacccatcgcacaaaccacacgcaccaacacaccacacaccacaccctcagcacccacgcactctattatacatcactgtgtgtccaatatggtgtcataacatcacctctgtatattcctatctactgtcattctcttatcacattatatccattttgtcggacgccccaccactcatatatgtaagctattaacaaacacgacacgacattatgtctgccgcagtgactaatctatccacagcgtgctctacccaacacagacgcgcgcgcctttttcagacacatcaaacacaccggcaggggggatgagataccctccccccagtgtcggtgtaacaacaaaaagaaacatggtgtggcacaagcagtccgcgacacaacgcacagacgggccccccaaacaatatagatcggcccaacggatgacacccactcatgtacacagcaaccgcagacagcggagaccacccgcagtgcggcgacaaaaacacgctccgagacgcacggcggtcgcgcgcccccgacagatggtctgcgcaccgcagaaacagcaccaacagtcataaagtcagcgcggcgggccgccagcatgcattgtcagaccaacacaccgccgcctatccctccgccgcagagagagaacaccgccaggcacgaacgcacccgccccagcgagacgctccgctcatccagatcgacgacaacacacacttccccacccgccgcggcaccctgcgcgacaccaacccttaccccatcgacgcactcagcaccgccgccggggagagcacaccaacctacacgcacgcgggccacccaacgagccaagcagacacacaccctcctcgtgtgcaacaaacgcgacacgaacaacc

SEQ ID NO: 718609 - DNA, 194 bp, Homo sapiens
tgtgccttaacctgagctgaggtgtctctgggctgacccgctgctgtacgtgccagaactggggttggcatctgcgcatccatttgagtgcaggatagatggaacggtaggcaacagaggaaaacctattcctgctgtgacacacatgcccttgtccacgcagcctaagtgcagtgagcgtgatgaagtcatgg

SEQ ID NO: 718610 - DNA, 235 bp, Homo sapiens
tttgattttttttaaaaaactttgggccaaaacgggtttaatttttcccccctgccccaaggggtgggctgggggggggaaactgggattttgggccccgggattttccctaaattgggcccccctttactccccctttattttttttcccttagacccccccagcccgggaaccaggttggggttttttttcctttttttttttttaaccccggccttttacctttggacccca

SEQ ID NO: 718611 - DNA, 153 bp, Homo sapiens
ggctcagcttcaggagcagcaggtccaggtggagatggacatgtctaagccagacctcactgccgccctcagggacaatccgggctcagtatgaggccaatcgcggctaagaacatttcttgaggcttaggggtggtcaagatgaaggtgtaa

SEQ ID NO: 718612 - DNA, 408 bp, Homo sapiens
tgaagcgtcagggcacatatactctcggacatgacataacaatactacaatcatactcttcattataatcataatggtatagagataaataggaatagccctttcattctgagccagaggttaccaaagcaccctctgacatcggactgtacttctcacatgacgaaaactagcccccatctcaatcatataccaaatctctccctcactagacgtaggccttctcctcactctctcaatcttatccatcatagcaggcagttgaggtggattaaaccaaacccagctacgcaaaaatcttagcatactcctcaattacccacattggattttaatataccttagcacccttggtttatacctttgatctatactttgcgcccctcttcaattacactctcatacctc

SEQ ID NO: 718613 - DNA, 286 bp, Homo sapiens
gaataagtgggaacaaatgaaagaaggtacaattcctgcattagaagtttcttttttactacctcttaatgactttattggagtactgcactattaacactaaaattttttttaaaaaaaaaggaaagcagaatttttataagtaccattcagtagatcaagttgaagaaataaagaattaatgtatttaaaacagtgattttctaataatttaccaaggattttagaggtcattgcttatattgactgtttattagacagaaagtcattgaagactataaaaaaa

SEQ ID NO: 718614 - DNA, 721 bp, Homo sapiens
  misc_feature (3)..(3): n is a, c, g, or t
ccncaccagaatttgaccaagctgcccccgttgggcatgccaccaggtcatttttcccatgacgcatgggaacccggattcacgtgccggtttggatgcatttgctcagactactttcatgtactccccctttccaaccattttgattggctggataatcgggcgtccaggcgccaaaatccattagatccgtccaatgtttggggcgccgatccaaatttcgaaccccgtggaaggattttctgataggccgggttccctccctgggtttgctgccagccttagcctgggtcaatatttaatcaaagtcaggccttcctcggaaacgggtggcctggggggccggttaaaccatgccgaattctcccaaattccccttttggtgttcccccccccccctgatccctttgtggagtttttgaaccggcaacgattcccgggttttaataggttggtaattttccggttttaccccctttttcctcccctcggggttttttaattaaaggggttttattcccttttttggtcagctggtgatggtgagatccctatttagttttataaggttttccccgggtttttttttttttttgggtttttttttttgggtcatgaatttttttgtttgtcatggaaaagtaagagtggaatattaatacctttccgtttagttttgtaatgtccgggatttttccaaaaaatttaaagatgggctgga

SEQ ID NO: 718615 - DNA, 576 bp, Homo sapiens
cttcgggtccattagctgggtgtggtgctcaagtgcatcttgcctcagctgagatcttcttccagcgcctcagaggctgtgcaagatgcatgatctccacggatgccggacgacggtaaacgtcccgccaatgattgcacagaatcgtggtgatgaatctgtacagcggctgccgtctctctgtgtacttgaccgtgatggggcttaggtcttaccggtacctgattgcaaagatgatgcggcccgtgtggctgtaggcgacgtattccttgttggccaccgtgtactggtaggagtaccgctgcttgccactcttgtcctcataaaccgtgggcacaatcttcaggatgtagtcgtgggaggccagggggttggaggtgagtctgtctgctcccccgagagcattgaaagctccgtggatgttctggacctgtagcgtgtccccaaaggagagcttgtggatgacatgcgtcatgtctgggttctgtggctgggctgtggcactgagtgtggacacgtggaagttgccggggaccttgttgatgctgaactgcccctcgaagcggcagcctggcc

SEQ ID NO: 718616 - DNA, 650 bp, Homo sapiens
acgcctcatcttatggggggggagggattacaaactgtactcgcgtttcttcagacgctgttgtctttaattttgtttgagacggttctgcctgtccttctcttcactcaattctactcttacacgttttgtgagttgttagattagggtgtgtgccccaagtggcggcggaggctggtcgctgtggtgtaagcttactcgtgtcactataagacacagtgggccgcgcccgccgcgcaagtgtctctgattgtccaccgcgctgctgacccctaccattacgtgacggctggtcttcttgccagggaggtacgtagttatgtatgtttctcttctgttctacgtttctccgtggcatgaggtgtatattgctttatattctgaggtagtgggctgtattactccagaatgtgctagggccgctttctttgttgttctttattcatcataattctgtacgccttacagtgacttctctctgttagagtatacctgataggattatgagtgatgagatgacaatcccgacatattatatatactagtatccaattagacccttttggttgatattgttttagttatacatctctctctatgagtggattataccacgacgtatttttcaagttttctgtttttcttttctt

SEQ ID NO: 718617 - DNA, 131 bp, Homo sapiens
cctaattacgtgtagcacgtacactcatatgtacaggcgtggagactcacttgtactgtataagaatattctgacagtgagtgacccggaagtctcctggctgtacccgtcttaccacgtcagctgcctgc

SEQ ID NO: 718618 - DNA, 691 bp, Homo sapiens
aaggtcccgcggcgcgggggaaccgggctctcggcaaggtgggtaaggccgtcactgtcatggcagagggagaatgaggagcaaagtcatgtgttacatggtggcaggcaagagacagagcttgtgcaggggaactgccatttataaaaccatcagatctcatgagacttattcactaccaggagaacagtatgggggaagctgcccccatgattcagttatcttcacctggccccgcccttgacacatgggaatcattacaattcaaggtgagatttgggtgggcgcacagccaaaccatatcactctgcctgggacttccccatctccccagtctgctgccaccgtgtcagtctcagtgaaaatgtcgtcctctctgaaagccctttcttgatcattctgtcaaaagaacccatctgccaccttgactcttacattcttcggtattcttttccggacatcttgtgataggttatccctttacttgtgtgtctctttcaggaaaagagaagctttgtgagaacaggccttgggcttgtacacttctgtgtacgtagtggccaacaacccagtggtgctcagtcaatgttatcgaaatgatgaatgaagtcacagagattgttgaggttcctgtgacaggctatgccctgtgggagacggtccgagcccaatcggaacagggctagctgtc

SEQ ID NO: 718619 - DNA, 659 bp, Homo sapiens
tgccgcggcagttcgcgtgcccgcgtatccggctctcggttcaacagtgtttggacggcacagattcgtcaactctgttccagtctgcgaccgccctccgatttcatctccgcttgcaacctccggcaccatcttctcggccatctgctgcttctgggacctgccaggaccgtttttgacgatagctcgttcttgccaaccaaccatgagctcccagattcgtcagcattattccaccgacgtgcagtcagacgcaagcagtctcggcaatttggacctgcaggcctcctacacctacctcgctctgagctgctatttcgaccgcgacgatatgcatctccaaggcgtgagccacttcttccgcaaactgcacgagaagcagcgcagaggctacgagcgtctcctgcagatgcaaaaccagcgcgtcgtgcgagctctcttacagcacatcaagaagccagctgcagacgagtgacataaaatcgcagacgccatgaaagctgccatggccctgcagcgctgaaccaggcccttttgcatcctgatgctctgaattctgaccgcacggacctccatctctgtgactatctggagactcagttgctagctgaggaagtgtttatcaagaagaaggccgactacctgctccctccacgccc

SEQ ID NO: 718620 - DNA, 661 bp, Homo sapiens
  misc_feature (25)..(25): n is a, c, g, or t
gcctgggcaatatagcgagaccccngtcctccagaaaacaggaaaaaaaaaacaaaaaacaaaacaaaaaaaacaaagagacacaacaaaaaaaaaaaaaaaaaaaaaaaaaaacatgtgtggggcgcccccggcccccttgatgaaaacgctttcccaaacccctcggtgtgggggcggggccccccaacgggaaagagaaacatggggccacacaacattgtgcccaaagagagaacactcgcgggactcagaaccaaggcgctcggggatttccccaccacaataaaaaaaacccccgccgaggaggacaacaccaggactgctgtcctgcaaaacaaaatccacaaggagggggtcccgagagcgccaaaaaagggagacatacaccaacaggagcccccaggagcggccagaataaaaaaaaaatatacgccccggggcgggtggagacaccaccaagaccacacaagacgcaagtagcaaacacagcgagcacacctgaagcccacccagcagacacgctcaacgaccacgcaccacaaccacacgaccagacccacagcaaccagcacaacaccacgaaccacgcaccaccaacaccagacaagcaacacagaccaccggacgcaagcagaagaccaacagcaaccaggcaacc

SEQ ID NO: 718621 - DNA, 914 bp, Homo sapiens
gcctctcccctagtgcaccgttggcgtctccttctgctgccgctcctggtgctgtttgtgtgctcgtccggtgcgggacctggatacctcttttgtgaagcggcatgcttggggagactccgtgcgcttcgccatggactgatgagtagcccaatggaaggagtctcactatctgagaactagacgactctggtattatattctgaaggtggcgggactggcatggatgcctgtgtgtgcacgtcgtacccattctgagggtggtataccacttagtacaactaggtgagggagcctactgtgaagcgacaggcggatgtccatgaggcagatcagattccgatgttgagggggtaaccgatcaatgagtcagaacatcacctgtagagtggggaactggaggatgaatgatacatacttgatgtgttccagatcatgcaggacgggaggtgttctacttgataatagtggatccctgcttctttagctccaagatagctctgtgtctttagaaggaccgaagacttagcctttctcaatttagaaagagctgtcatggtggtctctcaccattatcctgtactacctaagcgtgatagtttgtgctctcatgctttcatttccccactttctgccagttcgtgtgatggtacacttaaagtaccctggtactatgttgcacaaggcgatactgcatttccatggtttctaaatggaaaacgggcagctggtattgttttgctgtggccccatggggggaccgggctggggcaaattctggttttggggggatccccccttttccaatgggggggggccctagggcgcttatgttatattccacaagggattggggcccgggtgccagaaaacagcgacccgtaaattcttgctggggcccgcggaaacagtgc

SEQ ID NO: 718622 - DNA, 422 bp, Homo sapiens
cggatgaggaaatgctgtttatttatggcccccccaaccaagcaactgtgggggccataaaaacaaaacggcccgggatgttggccttcccgggcaaggccaagtgggatgcctggaattagctgaaaggggcttcccaggaaaatcccctgaaagcttccctccccaaagtagaaggggtaaaaaaaaaaaccggggattagagagacgggatttggtttctggcccctgggtttttcctaaactgagacaaacccctgtttttttttaaacccgggggggggggggattggggaaaaaaacccgttaaccccgctactcaagggggcccccccaccgggtttaccaaattagggggtaaaacgattactgccttcccctggggggtttttttttgaaaccaattaaaaggggttttgttc

SEQ ID NO: 718623 - DNA, 288 bp, Homo sapiens
tgagcggactgcagattgctgacaaaatagagaagatcagaacgggaaatggtttggacgggaagacgaggggtccagctgtccacgttttgagcaacaggtcccaggaggactttcagctggggccgtcattcagctagaaatccaggaccaggtttcaggataggggcagagatgtctagcatcgttctggggcacagtgacactgtgactgctgtgaaggatcagggtctgagcggaggaacattaccagtgaagtgcaggacatgaaatgttacttgcacagaa

SEQ ID NO: 718624 - DNA, 1069 bp, Homo sapiens
cgcacatcgcagaacgcgagcgctcgacaaggaacacgtctcctagtctgctactctttgggggtctctggtttatgctaccgctcgttcgcttcttttcttcgcgcctcactcttctctatagtcgtcgtgccccatgtttttctccacgcctgtgttatagggctttctggttcctgtggttcccctggcacgtttcgcaccccgatccacgcgtcgtctctgccagtttttcccagagaaaatattttcccctttaaataaaggctcttaagtttttaaaatctacctcccttttgattaaatcccctttcctttacgcaacccaaccctgttccccccccccacgatagagagaaaggtcccctggagattttccagacctatttggtatagctattttcttccctgggaagattccgttccctctcacggtacttttgtgcgccgtcatcttgatgaccagaatgaagcttgctctgcctcctgcccacccagaattggtggcgggacttggggataccagcgtgtaaggtggggaaattgccccgccagaacaccagaattgaagttgggaaactctagagtctgggccaaatgtttggctttttctcctttaaaaaaattccccccccttgcccaaagcaaaggtaaggtggccacccttatttttaatagtttgaaatgatgataatcctatattatattcaaatatatatattaacccccatatatatagtgattttctaaagatttgtttactctttgtgttttgtgtttactgtactatagaacttgtcctcttctcccttgaatccaagttaggacctgcatcatcctcctaattttaaatgttggctctgattttataagtggtgcactttgagttccacgcccttggtaatggaagagtttgccaacacacaccacgcggcccaccagcttcaccgctggtggtgtgcacgtgtgaggcacgctccttggctttcctggttttcaccaccagctagagattttccaagctacacttttgagtaaaaacccttattctaaagaaaaacatgattta

SEQ ID NO: 718625 - DNA, 225 bp, Homo sapiens
tctgtccctcaaatgggcggcagtctctagagggcgtggcccttcccctgaggtcttatggcctagctctgtcacaaccaggacacaggaagccctgcttggctagcctgaggcctagtctctgcttggtccccgagatggggtgggaggggacctacgttgctgggtctacctcttcccctctttagcatcccccactcactaatcccctttaccagaagcgta

SEQ ID NO: 718626 - DNA, 1284 bp, Homo sapiens
cacgttgctgctctctgttctccgtcttagcagtttcggctggactgtgtgtcggtgcgctcgccggttgttcgtctccgcgttggttggtgcgtttgctcttcgctcgtccttgtctagagtcgggcgcttggtgcctgggttttttgccgtccggggcgagttctgttgtgtactggcgcgtccttctcgtgcgcccggtttgaaccgtctggtgtgattcgcatatggctgcatctgggcatcttgtgtggccgccggtactacgcgcgggagtggccctttccctgtgtgattcctcccgtggtgttgtctatttccgcccttccggctcgttgtgtgcttgtggtcgctatgttgatgcctttgtcaggggaggtgtgggctaccacgggcgtaatttggtgattccctccccttgaatgtgcggggtttatcgtgcacgaggattgtctgagtgctttatatctgaatattgctatcattctcagaggaaaggaggtcctgggtaccaatgggttcaactggtcgcaaaattcaccactgcgcccgatatgtatctggccccccactttattaccacgcgctttgagagcaatatggtgggagtgtatatagagttccacttctcgtgtctatggggagacctcatttcacgagtccgtcccactagtacacgcccccactgtgagcggtatgattctctctgaatggtgtgcctcgccgctttttgtgagaaactgggaccgcacgaattgtcaacgagttggcccactggaggcacggcccacgcttgtttaaagggagaagaaattgttttgagaggcacatcacgaatccactattcacggttcactgtgttgcacattctttgttggagatatattggcgcagttgcgcgcaccacccacggagcccactagcactattgagaatgcccggggctggccgccacactattaacccacgcagttttctttggctgcgaaatgccttatacgcactgccaaactatttgttgtcacggagaacttatatgttctaatgaggtattgcacccccgcgatgatgacgtggtttagctattttaccacggacgtccacccacgataattataatattcttggtgttcttgtttctaattgtgtggcttttttaaaatgaccacaaatatgtacctgtgttgtgagtaaaaagtattttatttgtttcatgatatgcatgctttttttctgtaaatatataatccatcttttgtagatatgtcccaaaaaaaataaaaa

SEQ ID NO: 718627 - DNA, 242 bp, Homo sapiens
ccatcttggcttccaaaatgctgggattgcaggcgtgagccactgtgcctggtctctcatgtatgttatacttcataaaagttttttattttttggagacggagtcttgtactgtcacccaggctggagtgcagtggcatgatcctggctcatagcaaacctctgcctcccaggttcaggtgattctcctgcctcagtctcccaattagctgggaccacaggcacaccccagcccggcccgg

SEQ ID NO: 718628 - DNA, 190 bp, Homo sapiens
gaacataaggaggtggtggaggctgtgacctattgtagagacaccacccatggctggttctggggcattgtgggctacgtggaaccccctcgaggcctccgtgcaccttcaagactgtctttgctgagcacatcagtaatgaagtgcatcaggcgtttctataagacttggcatacatctcagaagaagg

SEQ ID NO: 718629 - DNA, 255 bp, Homo sapiens
ctagtttagaagttcaatagcagttttgaaggactgattggcaaacatcagacctgtcttccaaggagcacaagtcctggctacattcgcagcgctgtagttacagctgcagacaggccatgtgagccacacgctgccagcacagagcgtccttccccctgtagactagtgccgtagggggtaactgctgccccacgtgactgtggccccctccgtgatccatccatccccaggcagcaatgtgctattgaaact

SEQ ID NO: 718630 - DNA, 491 bp, Homo sapiens
ggtttctactgggagctggacacttgggtaccctctgcctggcatatactaaaatcctagattcccagaagaaaagcaggtcagctgttgagcataaaccacattgtttgtataatcagtttaggaatactatcagttaggatagtgagaaccctccccaaatccaaattcccagatgccagccaagggacagttttgtaatcaggcctttcaaaggatggcagtcaggcctgctatgttaactctgcataccagtacatgtgcgtgaagaattctgtgaaagtacaggaaataaaatgaatggttaacattgcttctgagtttgaacgtttcagagtgatggggactcagcatggttctgccaagtttgaaagtgacaattgctcacattcgtaggaatttagttaatctcattttaaatgttccttttaggtattttcatgcatttcctcactaattgctttctctttccctcaaatcacatccagcta

SEQ ID NO: 718631 - DNA, 387 bp, Homo sapiens
atgggaattttgggggaggaagcagaacactgggaaaaccacaaatattggcccaaatcgccctctcgatggcctctcccttagccctttggggacagacccttcctcttctgggctctatttttcctcacacttccattttgtgacccagccggctaaggccaactgggcctggccgacggaggccccatccggcccacgatcccaaacgtggccgtctttctagcactcgccaagtgcacctgcggctttcaaaaaaaaatcacggaagaaaacaaaattaactcgtgcaagcttagcctccactcgacaaagaaagccagacgtgcccactgaaattgttcaagaaccacgggtcaggagactttcttttttcttctctaaatc

SEQ ID NO: 718632 - DNA, 419 bp, Homo sapiens
tagaggatcacacctccatctcaccatagagccccccacagccgaaaaagccctcccacatccagttcccccagacacttggtggcttttcaggagacacggttctaacacccatttcacagagaagagcactgagtccgtctctggccgtgaggctatggcagggctgggactggaagcagggcctttcatttgacttcttgtaggtttcttccggggcaccactttgtttttgtttttgtttttgttttttgttttgttttgttgagatggagcttcactcttgtggcccaggctggagtgcagtggtgccatctcggctcactgcaagctccactccggggttcaagcgattctcctgcctcagactcccgagtagctgggattacaggcgcccgccaccacgcccggctcttttt

SEQ ID NO: 718633 - DNA, 270 bp, Homo sapiens
ttatgcgcgatattcgccggtgttcctacgttatttatagaaagtggttttattatttataagcgcttcgttaattgaaaaccctattatttcacaaagacgcgcggtagtgcgccgtccgccgttgttaattttcatggtattcgtgtgtaccgcgttccgcgtgtgtagggcgtagcggtacggtacgcgtttccgcatgtgttcaggcacccggttcggttggcggtacgtcatgggtaccgcgtaccgccgttccgtatccacgtt

SEQ ID NO: 718634 - DNA, 445 bp, Homo sapiens
tctagacgatccctttggttcttgtgctggaagagacgtttggtttggagatagccagtagaagagatggttggagctgagggagtaataccatctcaatgggaggagaggccatttggatgcctgagggtggatggctgggagagctggagcccagtgctgagaagggtctgtctcatgactgctgatgccctcctctgcttggagagttgtggtttcatgctccacgtttcaacacttcctgttctagtaacccctgtgaaattctgcactactcatatgtcctcgtcccctccccagaagggaccatttggacagcttcaagggtcacacagatagttatatgctctacagaacaaaaaaagtccttttgaaacagttgatgatgatgatctctacctcacagactatctttacatcacgtctacgagatgatacctgggtg

SEQ ID NO: 718635 - DNA, 250 bp, Homo sapiens
ctgaagcatatatcagatgaaggagcttagggctgagactatggagtaaatgagagtatagaattcagtcatctgcaaagagacgtagttagacttccctcttcctatttgaataccctttatttctctctcttacctgactgccctggccaggacttccagtactatgttgaataggagtggtgggagacagcattcgggtcttgtgtcagttttcaaagggaatgtttccagcttttggttatttcag

SEQ ID NO: 718636 - DNA, 241 bp, Homo sapiens
cgtcagaggatccccttcgacggtgttctgctgtaatatcattcacaatgtcctcccgaatcattgtgaagtactcacaagagagcgataatataatagtcaaaaagagtggttctcgctcagttatttgataccataaacatcaattcactcctgatacattatacctaaatgtacattcccttctgtcttattgaagactgaactgctagcccatctatttcctcggaatgtgcctgat

SEQ ID NO: 718637 - DNA, 161 bp, Homo sapiens
aggcgcacgtgcgtctaaaatgatggagcagtctgtttcaacaagtctcagaaggactgtgcaagtcaatgagtcgcttgtggctgcggatctggaaaggatcccacgtcttagaaccttcaccacaaggactttttcttgtagtgattctccaaagtctt

SEQ ID NO: 718638 - DNA, 163 bp, Homo sapiens
aagggatgcctgctggtttagagtactgaccccttgccccaccttcagagcctggggtctgtatgctggggccgtgccatctgcttcccctgctgtcacctggctccccctgctgggttgctgggtctccatttctccctccacccaccctcagcaggctaca

SEQ ID NO: 718639 - DNA, 100 bp, Homo sapiens
gagtatcccccgcagctcgggcatgatgggtcttggtcttcttccacttcttggtacttttcaatttcatccagttcaacagccaagcccctagctgcgg

SEQ ID NO: 718640 - DNA, 161 bp, Homo sapiens
tctagaggatcccagtcttctcactctccttaacctcctcaagggacgaaaataccgagactccggggaacaggtacgtcggaccaacagaggtaatgccgggggcagcagagcttcagcaggttaatggtctttccgcagacgtatatgtcgtgggcaat

SEQ ID NO: 718641 - DNA, 684 bp, Homo sapiens
  misc_feature (559)..(559): n is a, c, g, or t
tgcttgatttaaaaatttcagtcttgttaaatttatctcataggattctgacttcctcctctgttatcttgaatttcattgggcttgctcaaaacaggtattttgaattctctgaaaggtcaagtatctgtatcactctgggattgtcactggtgccttatttagtttatttggtgaggtcatgtttctcgggatggtctcgatgctttggatgtttgttgatgtccgagcattgaacggttagatatttgttgtggtcttcacagtcttggcttgtttgtacccatctttcttgagaaggctttctaggtattccaagtgtgttgtgtgttgtaatctaagtctttggttactgcagctgcatctgcattagggggcacctcaagccgagtaatgctgtgactcttggcagatgcgtggaagcactgtcttggtgatctggggtaagatccaagagaattccctgcattaccaggcagagactcttttccccttctcttgccttcctgcaaacaaatggagtctctctccatactgagctccctggatcctggggcangggtgacacaagagcccatatggccaccaccactgggactgcactggatcagacctaaagccagggcaacactgggtcttgcctaaagcccacagtgaccactggctgctattgctgatgttcac

SEQ ID NO: 718642 - DNA, 158 bp, Homo sapiens
atttaatttttattaagatttttcttaatgctgccaacacaatatttattccatttgttcctttaattatggtgggggtgaggtacaatggctgagtgaagatatttaatatttaatactaagctttaaaaagaaacctgctatcattgctatgtatc

SEQ ID NO: 718643 - DNA, 836 bp, Homo sapiens
cacggtggctcatgcctgcaatcccagcactttgggaggccgaggcgggcggatcacaaggtcaagatcaagaccatcctggccatggacaacgtggtgaaaccctgtctctaccaaaaatacaaaaattagctgggtgtggtggcatgcacctgtagtcccagctactcgggaggctgcggcaggagaatcatttgaacccaggaagtggaggttgcagtgagccgagattgcaccactgcactccagcctggcacagagtgagactccgcctcaaaagaaaaaaaaaaaaaggaaacgcgaggacggggattctctcataatcaaagctagggtgaagaacatatttagacgaaactggaccacggtttacttccaacttttagatcccaaaagctggccacaccattggtcaaattttcttacaggaaacaacaaacatcatggggtcagatccaagattctttctccttaaggcacaaccttttacagaaaaaacttctccttaatcttaggatgtgaccaaactggtgccggcttctttaattctcaaccaggtctatcacatactcgtactcgtgggaacccaactcctgtgggttagaattccaaatggcttggctctgggcacaaggaagaggacaaattttcccgatgttaatatattccaaagttcgatgttcaggaagaactataccaggggatccaaaatcttggggcttctcacatgctccgaacttgccacatttgatcaggccagaaagcaatggtctatctgaagaaattttggaataccaggtacacgaaagggccaaggcttagatataaccactatg

SEQ ID NO: 718644 - DNA, 266 bp, Homo sapiens
  misc_feature (21)..(21): n is a, c, g, or t
  misc_feature (33)..(33): n is a, c, g, or t
tgtttatcgactgccacccangtcgttcccaanggtgcggggattacaggcgtgagccactgcaccgggcccaggtaaggcattctaagtcacaggatgagacaggaagtcaacaaaaaatacaggtcataatgactttgctgataaaacaggttacagtaaaggggccagccaaaacccactaaaaccaagatggccacgagagtgagctcgggttgtcctcagggctacactctcggggcatcgataaacaccgggtaccgagc

SEQ ID NO: 718645 - DNA, 201 bp, Homo sapiens
ttcatagtaggccacgcgaaaagctattttcttcagggaggaccgtctttccacttccagcttcaccctccacacacattgacagagttcacagtggccaaagacctcaggcagcaccagaggttctggcacaggttggctgatgtgtttggaagcactagacagatcacagcccagcaaggggtccgtggcctctatgaa

SEQ ID NO: 718646 - DNA, 494 bp, Homo sapiens
  misc_feature (34)..(34): n is a, c, g, or t
  misc_feature (72)..(72): n is a, c, g, or t
  misc_feature (124)..(124): n is a, c, g, or t
  misc_feature (142)..(142): n is a, c, g, or t
  misc_feature (151)..(151): n is a, c, g, or t
  misc_feature (173)..(173): n is a, c, g, or t
  misc_feature (398)..(398): n is a, c, g, or t
ccccccagagagggaagcagaaggcagcaaaacnccccatgtggaaaagtcacaacatgaacccacctaaangggaagggtacccttgggccccaggcacgtgctgagcccttttaacaggttntcctcaccttaacccctncccaatcanccctttaaatggtagggtattnccttattttccacattttccctctatttaccttttaatttatattcccagcagatgcatttttaaaattcatatcaatatggctgggcgcggtgactcacgcctgtactcccaacactttgggagccaaggcgggcggatcgcttgagctcaggagttagagaccaacctgggcaatatggtgaaatgtcatctctcaaaaaatacaaaacttaggccgggcgcnggtgcacgcctgtaatcccagcactttgggaggctgaggcgggcggatcacaaggtcaggagttcgagaccagcctgaccaacaatggtgaaaccc

SEQ ID NO: 718647 - DNA, 377 bp, Homo sapiens
ggctttgccctcctgatctctcactctgggaactctttcccagggtcaatcttcaccttattgggagccacccattcctccctattaacttttcatccacttattgccaacaaccaggtgggcaacaggaatccaggcctttaacccctggatctttcaactctggcaaatccttcccaggtcttccctcaacttctgggagcaaccattcctcctatcactttcatcaataatgccaacaatgacagcagcagtcagcactcccatatgcatgttacagctggccagacaccttcatatgcactgcagcagccttataaggcaaattgggaaggaaccatcagtcccatttaacccaggagcaaagcaactttacc

SEQ ID NO: 718648 - DNA, 415 bp, Homo sapiens
atgacaagtcggctgaatcgcggtacaggataatctacttggcccggggaacacggtagatcttgggatgagcctttctggtatcttccagtcagaaaagtgcgtacttagggactcacttgatcaagaagaaccccttatgtctgggttatggcttaaaatttcatatacctttgattttctgctgtgaaggttaatgtccagtttttccctgaaagatgagtgggcttccagcctaactttcctgtggaaaagcactttctgctcataaaagttctgcaaaactttctcagtgatggcaagataagaatgttagtttaccatcttcctctacaaggaatcttggcggaaatatctcacaaaccaggcatgaaatatttatgtagtttgtaaaaggggattaaggagagagaaa

SEQ ID NO: 718649 - DNA, 140 bp, Homo sapiens
tcgagctggcaccggtaggaatactatttgccaggactgtggtgcttgtgactggattctacaatctgcagagtgggcaaggctgtgagaggtgtgactgccatgccttgtggctccaccaatgggcagtgtgacatccg

SEQ ID NO: 718650 - DNA, 278 bp, Homo sapiens
cctgcactgacaacatggagaaaccccatctctactaaaaatacaaaattagctgggcatggtggcacatgcctgtaatcccagctactcgggaggctggggtaggagaatcgcttgaacccaaaggcggacgttgcagtgagccgagatcatgccattgcactcgggcctgggcaagaagagtgaaactccgtctcaaaaataacataaataaaatgaatgggagaaaatcgtgtagccgcacctctacagagcaagaccttcatcccaaaaaaaaa

SEQ ID NO: 718651 - DNA, 184 bp, Homo sapiens
cctagaggatcgcattggcgaggagctctgctctggtctagcgaactcgtgctcagcctcctgagtagctgggatttcagttgcacgcaccaccccagctaactattggtattttggtagagacagggtttcaccaggtttggccagcctggtcttgaactccagatatcaggtgatccaccca

SEQ ID NO: 718652 - DNA, 632 bp, Homo sapiens
ggaggattttacgaatcatttataaatggcgccgaagcaggaccagtagcgggaatttcaggagggtgagcgagtgctgtgctttcatggccctattctttatgaagcaaagtgtgtaaaggctgccataaaggacaaacaagtgaaatacttcatacattacagtggttgtaataaaaattgatatgaatggtttccgaagagcagagtactcaaatacgtggtcaccaatttgcagaaacagagagaactttataaagccaatcaggagcagtatgcaaagggtaagatgataagcgcatgccccaagaaagaagacatctggactgcaacagaaaaatgatgaagtgaaaactaaaatgaacaaacagaaaacacccgtaaatgaaaatggtggcaataccatcggaaagcttgtagacaaggactctcactcacttatgcttgcatctccattaaaccattttcgatcttaacctaactattgctcaaacgatgtcctttgaggaacttagggatatcaattgatgttcgcttataggctatttaaacagcaaaaaattaaggcggtaatagactccttatcctcttttactttatatttaatttatattgcctactttcaatacaca

SEQ ID NO: 718653 - DNA, 585 bp, Homo sapiens
gtcaaacatgacccagtacccgaacgtgacgaatataacgcccatctacaacgtcaactacggcgccggtgacgtcccatcccgcatggatcaccactaccggaaccagaaacctgtgaaggtcgaaacagctgcgtatcctgtttaaatgtaagcgtatgttaaatactacctgcttttggatagaatgtaaagatgagagctattgttcacataactcaacagtaagtgatttgtcaagatggggaacacgacagacttctgttccgtatccacggccaatccagtgccaacatgccaattctacagctaaacccacagttcagccctccccttctacaacttccaagacagttactacatcaggtacaacaaataacactgtgactccaacctacacaacctgtgcagaaagtctacctttgatgcagcccagtttcattggaggcattgtcctggtcttgggtgtgcaggctgtaattttctttctttatacattctgcacatctaaagaacgaaattaccacactctgtaaacagacccattgcctacataaggactgggtcatgttctgtgggtaccga

SEQ ID NO: 718654 - DNA, 876 bp, Homo sapiens
ggatctcattgggtagccctctggctctaattgcttggtgtgcctctcacattggccagattggcgacacaaacgtgtgcgccgcgtcgctgggtaagcctccttctgagacgttccccgttgtcccccccttttaacgcgtgggagcgtgttcttgcccctcatagggagaatatttttgcctcgcgaagacgggtcgtctgttctcttggcaccccgcttgccgggcttttccagggccccggagatattgccccattatctacctgagtattcggcgcggacctgacacacacatggattcggcgccagatataccaggtatcaggcctccccccacgggtgagtcaccaacgaccgccccagggacaagtggtgtgaagcggggaacacaagagtgaggtgggccttggcccccccacacttgtggcaatcagctggccacaaggggacctcccgggtggcatgttccccccgacggcgcgatacactgtcaacacggtcgaagccccaaagacgagtcatggtacaaattgaaggctatgcttacactggccctcgatctctggacaggtctttggcgcctgggcccctccctcgggggtggtcaccacccaccaattcccacgtaaaagattgtgggctccaaaagttgtcgccaccaaagtcaaacatctcaagcagggccgcttcccgataatatctcttatgaggggtgacctcattcaatgccaccaaaagtatcttgtttccatggcagttagaaaaatatcacggcgctgataacaatggagctggcatctggatgattgggcacacgttacagggcagcatgtccccggccacaaacaaaccaatagtgcgccccacatgacg

SEQ ID NO: 718655 - DNA, 1389 bp, Homo sapiens
gacgtgttcgactggaacatgctcaaatttggtgccagccgggtgccgccgatgacgccgagcgtggagcgcagtggaccgagaggagcggctgagacactcgcggaaccctggctaccctgctggcctcccttccacatgcctcctggcctgcctgctgtggtgtgactgcatggaatgtggctcctccgcctcacaccgcctcagccctaggctcagaacagcggctaacaccgtccccgcctgtggcctgtctcctggcattggaaggacgatgatgcggacacgttgatgtattgcgtgctgcagccgtgtgggcgccccggtggaagagtcgtccgtcgtccgagcctctacagggcctgacgaaggatacgctctcgcgatgtccaggcgtcacaggaataggcagtatccgtttgcgaagcacgcaacggtgcgaaggtacgctgcgtcggtcgtcgccatcggacaggccaggcaacgtggatttccctgtgtcggtgtggctttccaaggtggttcgttcaggtcgtgctcggtgcaccgaagtgaggaaacgtcgtccttgatggcgtgtgaacggggcagacacagtgcaatggcttgattctagcatcttgtttaccaagtggggcgttgtgacgttaggcttgaaagagggttacggcgcagggattctagggaatcggaaacagtgggtttaagcaccggggtggagccttacttcgcgtaggcgcgcaagggtcgatcgcccaagtgcgggaacggcgttcggatgcgtgtggggaaaacacagaggtttacgttaagtagcgggacataggaagtatcgcgcagaaagagccttggacgacccggttgggtggtgacttgggaacgtggagagggcccagagcgaaaggggtaggagaccctccgaaggcgtggtcaacccccggggtgtcttgtgggcgaaagggaaaaaagggcaaggtagtcaggaagatacaatgtcgccatgcaggagaagttcagcgagagatggcgtgttgtagcgcagggggagaccgattcgaggggcgttgcgcagtcctgagagggcgttcgtggagccgcgggccgccggggagcggtgcccggttggaggcacaggtgccacagcgtggggagcggtacgccaaagccagagcagtaacggttggggggtagcggaccaggggtcgcggcggacccgcacgggtaggacaggaagcgcactagggggggaaacgcaggctgggtgacacgggagcgagcgcgcgccgggaaccacactcgggcgccagagcaggctgcggcaacagcgggggctcagaccagcggggcagagcggcgagagcaacagaccaccacgggacaccagctctg

SEQ ID NO: 718656 - DNA, 178 bp, Homo sapiens
  misc_feature (161)..(161): n is a, c, g, or t
tctacaggagttatccccggttctgggtagcatcagtgaggtacacctctacaacaaattttaaaaattagccaggtatggccagacgcggtagctcactcctgtaatcccagcactttgggaggcggaggtgggtggatcacttagaggtcacagagttntgagaccagcctaagct

SEQ ID NO: 718657 - DNA, 468 bp, Homo sapiens
ccccttccattcatctgaggtgaactattaattcatatccaaaagggcagaactctggcatgtcatgtccctcatactttaacagggttactagctgttcccctgttaagacttcatgtctgtgatcctcactgatgttgctgtagaaagaatggccagggcttatcggaggtggtgggatatcatacgagcacctccagatcttcatctggatctcatcctacttgacagcagtttctactttattgacgttaggcccccaaagtgccactcaccaaagtgcaaaatccttagtactgcagctgcatttgatcaatgacatctagcactgtgcagagtattggaattgctctcttctgcactgaggtgaggcagatgtcaaagtcatatccagaatctccctgtacctgcctgccatgcttcccttcctcctgttcctcaggcttcacatcagagttgtaccagcta

SEQ ID NO: 718658 - DNA, 248 bp, Homo sapiens
atcactcggccggtatagcggctgggttaaaatcttgtcggtaacatcctggacacataccggctatgtccgaataaccatctgcggctgctagattattcccggtatttacgtcttaactgaggtgttggcgaagctgtccctcgtacacggtgtttttaactttggctgtggcagtctcgcgtgattatttccaacgtggtcgttcagcggtgtgcgtgtgctgggtgagacctgctctctaccgt

SEQ ID NO: 718659 - DNA, 491 bp, Homo sapiens
cgaacgggggagtgaaggggaaagttggggaacgccaggggttagttccccgttggtaaaacgccgggtagtggattttttttttcaatttcagatcacagatttatttaccttttaaaaagataattttcatcaaatatctactaattataaaaataaaaggttataggggaataaaatggtaaattttttttttaaggggggaaaaggattttggttggtttcaaataaatttttatttatgagagaatactaaatatttaaatctagggaaaggttggattttttttatagaatggaaataggaataatttgtaaggttttaggttaaagggaggttttatgaagttttaaaataaaataattattcaacatattaggtatttttagagttaaatagataaaaatttaattaataaaatgagacagaaggattttatggtttcttttattttggtataaaggatttttttttttgggtaaatgtaaag

SEQ ID NO: 718660 - DNA, 246 bp, Homo sapiens
  misc_feature (1)..(1): n is a, c, g, or t
nagacctcagcttcctttgtgaaagcatacatcttatgtggaaaatcttatgctaggtaaacgagtcatttcggtaattataaaatctgtaaatcctctgacactttctgtgtgcttttctacatgcgcgtacccatgcatctttttttttttgggttcaaattaagggttttatttccatctttaacactagcagaggagtccaaagcagacggatactccaggcctatagtctaaaggcaatca

SEQ ID NO: 718661 - DNA, 380 bp, Homo sapiens
  misc_feature (329)..(329): n is a, c, g, or t
gatattttgcaactcgctctgtgcaaatgcctggggtgcacttttttggctcagttggtgccataagttgtggggcaccttctgagtcagctacagatgcccgtacacctcaggagcccctttcatttcccggaatgctaaactccccttacccagtttaagtatgggctgggcgcggtggctcatgcctgtaatcccaacactttgggaggccaaggcaagcggatcacatgaggtcaggagttcgagaccagcctggccaacatggtgaaaccccatctctactaaaaataccaaaaattacccgggcatagtggcgggcacctgtnataccagctactcaggaggctgagacaggagaactgcttgaacccaggagg

SEQ ID NO: 718662 - DNA, 287 bp, Homo sapiens
tagggcctccccaggtttaagacgggggaataagaggaggaagatatctgcctttagggactgcaaggttatttctatacctttcctcactggagctaccagaacagatactgggaccatggggacggtgtttctcctacgttggattgttgccttctcatctttaacatcgaaacatcatttcgtccccacactgtcgttcctcttttttcgttttgtagttgaacatctctgaatcccattcttagcagccttgtgtcctaacaccctgaacttccagttagtta

SEQ ID NO: 718663 - DNA, 369 bp, Homo sapiens
taaattcgcggccgcgtcgacgttctgtttctttttaaagcctggttaatggccgggcgctgtggctcacgcctataatcccagcactttgggaggccaaggcaggcggatccctgagttcgggagttcaagaccagcctgaccaacacggagaaaccccgtctctactaaaaatacagaattagtcaggcgtggtggtgggcgcctgtaatcccagctactcaggaggctgaggcaggagaatcgcttgaacccgggaggcggaggttgcggtgagctgagatcacgccattgcactacagcctgtgcaataagagtgaaactctgtcaaaaaaaaaagtcgacgcggccgcgaatttagtagtagta

SEQ ID NO: 718664 - DNA, 219 bp, Homo sapiens
aggtgcaagccttaaggggggttggccaaggacctggtaagggtttcggaaacccctttcccctaaccctccagggttcttgtggggctcctaaagctgaaaccttgtgggaccttgagccccacaccccccccaaagggggactatgagtgtggtaaacctataaactacaataaagaccacatatatctctccccccctctagacgacgtcgcaaca

SEQ ID NO: 718665 - DNA, 152 bp, Homo sapiens
gatcgagctcggtaccatctcgacacgtagtgcagagagtagaaatggaagagagcaagagccagagtgaccaagatgctccagatgaagatgagtcgcctccacctgaagatgccccatttgtaccccctattcacctggatccaaggttc

SEQ ID NO: 718666 - DNA, 240 bp, Homo sapiens
ttggaggtgaggcaggagaactgcttgactgggaggcagaggttgcagtgagccaagatcgcgccactacactccagcctcggcgacagagcaagactccgtcttgggaaaacaaacaaacaaaaagaaatacattgtttttggcccatgaaatggcaggacatgctcataagcaagtgaggcaatggaggctcagtggtacctgagctctgaattctgtaaatcattggtcattagctt

SEQ ID NO: 718667 - DNA, 320 bp, Homo sapiens
aaaaaaaataggttttttctaaaattaatccaaataattgaaatttttgggaagggttttaaaaaaaaaaaaaattcccagaccggggaaagccttaaaaaaaatagggtgattaaaacttcaaatcaggaaaaaggttctcaaaaatttgactttgcctacccaggtacagttgggggctttcaaattaggactcagtaattccttgtgtcactgagggaaagctgctcattgttgccaaaaacctacaaaaaaggcccaggggctgacctccacctttttggagcacgaataagccccccaaacccgactttttaaat

SEQ ID NO: 718668 - DNA, 501 bp, Homo sapiens
  misc_feature (96)..(96): n is a, c, g, or t
tattcttttgtggatcttcagttactctaggcatctgatgtatacgtgcagtcacagggatgcgatggctggctgtgtcagaggctgacattctgngcttcttatattataagacaataaaacaaaatagtgttgaagtgttggggcagcgaaaatttttggggggtggtatggagagataatgggcgatgtctctcagggctgcttcaagcgggattaggggcggcgtgtgagcctagagtgggagagattaagctgaagggaggtcttgtggtaaggggtgatatcatggggatgttagaagaaacatttgtcgtatagaatgattggtgatggcctggatacggttttggatgatttgagaagctaaacggaagatacaaggtccgaataaaaggaggagaaaaatgggtattagatgtctaagaattgggaggacctaggacatctgattagagggtgcctaaggagattccgcataagtctgccaagcacagatac

SEQ ID NO: 718669 - DNA, 835 bp, Homo sapiens
  misc_feature (548)..(548): n is a, c, g, or t
gcaaaatgatacacatgttataagcgatgctgtagcgtccaaagtattaatgactgtgacatgatagtcttatggatccctcgagtcacctttagagtgggatgaggaatgaacgcctaaacctcgttccgttgagcattgtgccgtattgccttgaactcttcgcctagtatttatgtgcctttgtcgatttataatgccggtgtaagaggagggataatttctaactgtgatcgatttgttttataacttgtaggttttgaagctgcaaacactacaatgcttgagggggtctgtgcctgaagctcaggagtgtggatcagacagtctaaagatcctaaaaacttgccaactggatcttggtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttggaaacaactgatatatgcagacaaatnttgtgacaaattcaccttttaaacacacttaaccattgtgtgaaggttttctttaggcttacattttaaacatacacaataaacactaatcctccaaattcagtggttttatagtatgatttacatttgaggttggcaatagtaagtctcatgatatatcagtggtgttaaattggccgatcaggtaggaggtgcagctaaccaggggaggtaagaatatacctgagggggtgttggcaaggggggaaaattggcgagctgggttggttaaaatggacgtgaaagtt

SEQ ID NO: 718670 - DNA, 198 bp, Homo sapiens
ctagcaggctttaaacggagctgaactacggcgagggtcacgcgggagcatgcagctctggagactcgcaaccttgtgggccgggctatcatcaccaagagctttgccaggatccacgagaccaacctgaagaaacagggtctcctgcctcctgaaccttcgctgaccctggctggactacaacaacgattcaccctg

SEQ ID NO: 718671 - DNA, 107 bp, Homo sapiens
atcaaccctgagccttttatcagtctcctggtctttaaactacgccactgaggaagtgatttggtgggattcctgtaaactatgaaaaatgtctctattatttattg

SEQ ID NO: 718672 - DNA, 500 bp, Homo sapiens
  misc_feature (9)..(9): n is a, c, g, or t
  misc_feature (179)..(179): n is a, c, g, or t
  misc_feature (188)..(188): n is a, c, g, or t
  misc_feature (200)..(200): n is a, c, g, or t
  misc_feature (366)..(366): n is a, c, g, or t
  misc_feature (386)..(386): n is a, c, g, or t
  misc_feature (419)..(419): n is a, c, g, or t
gaaactagnggaggtaaaggatgttctaaagaagagactgaaaaactattataagaaggcagaagctgatgctgaaaggaggaggcaattttgctgacagttattatgactacatttgtattattgactttgaaggccacttgtgaaggaaggaaacccaccggaggtttgtacatganataattgantttccggttgtnttactgaatacgcatactttagaaatagaaggacacggtttcaggcaggtatgtaagaccagaggattaacacacagctgtctgatttctgcatcagtctaactgggaattactcagggatcagggtaggacaggagctgataccttccctcagggtactaaaaanagtaattgactgggatgganattggaagggattagggaacaaaggtataaatnctcacttttaacagatggttcttgggtatgagtaaggtcttgacattcagtgtcaactcaggcaggctcaaatacctcctt

SEQ ID NO: 718673 - DNA, 104 bp, Homo sapiens
tagagtgatcccctctgtgcacctccattcagcatccccacattgataggcaggacttcttctttaactgccacagaggtctcttctgtgttaacatcactagg

SEQ ID NO: 718674 - DNA, 446 bp, Homo sapiens
gggggtttggttttatttatcaaattttacaacaaacttttcaataaaaccgctgctaacaatgcgcacattattagctactcacatatctccctttcactacagcctcttacctctactcgtcttctttttcttctttgctcttcattccttcgcgattttttcgtctgttctttctcctctctggcccccctctgcccctcctgtcttcttccttcggtcccttttttctctcgggtcctatcttcgtctccgtggcccttttcctccttttggggggccctcccccttccttggccgccgctttccccccggctgtggtggggacccccggggggtccccctcccttttccctcctgcggtctctccccctcttcctccgttggttcctcctccttggtgccccctcctgctgctccttttcccccctgggcccttcccggcg

SEQ ID NO: 718675 - DNA, 322 bp, Homo sapiens
gatcgacccagtgtctatagtaggtctcctaatgtttctaagggccagacatggtggctcatgcctgtaatcccagcactttgggaggctgaggcaagccaatcgcttgagcccaggagtttgagacctgactgggcaacatggcgaaatcccacctctaccaaaaatacaaaaatcagctgggcatgatggggctgcatctgtagtcccagctgttcagaggctgaggtaggaggatcctgtgggtccagacattgaggcttcagtgagccatgattgcgcctctgctgccagcccaggtgacagagcgagactctatctc

SEQ ID NO: 718676 - DNA, 145 bp, Homo sapiens
gtccggacgcatctgtgggccagagcacagagttctgaggtataaagagcgactaacggagaacccgaagtttactggagaaactgcgttgggtgacctgtaggctaccattataactgggaccagtacagagcaagtagacgct

SEQ ID NO: 718677 - DNA, 339 bp, Homo sapiens
tgtgtctacaggatccttagctttggtcaggcacagtgactcacgctgtgatcccagcacttgggaggcaaggcaggattgcatgagcccagaaattctgagaccggcctgggcaacaaagtgaaatcgtgtctctaccaaaaaatcaaaaaaattagctaggcatggtggcatcctcctgcgatcccagctacacaggatgaggggatgaggcaggagaatcattcgagcacaggaagtcaaggctgcggtgagccagtgttcgcacataccgcactccaaatctcgagcgacaaaaggcgagaacccttgtcctcaaaaatggaaaacaaaaacaag

SEQ ID NO: 718678 - DNA, 177 bp, Homo sapiens
ctgcgtacctcatatataggtaaagctctaagactcctgagcaacttttatgtaactggcttccctaggctgggggcttgaactaagtaaggaagccaaggagtacagatctaagatagcagcagaagtaagtctcattctataaacatatgcaacatactgtaaagcagtcccacc

SEQ ID NO: 718679 - DNA, 199 bp, Homo sapiens
caggcgcttgtttggatggtgctcagccagaagaagatgcaccgcaggccacaaccagcggccactttcctgccaaatgcagcttgagaacgtgtcggtggcgctcgagtacctggaccgcgagagcatcaaaactggttgtccatcgaccagcaagcgccatcgttggacggggaaccctgaagcttgactcctgggg

SEQ ID NO: 718680 - DNA, 1010 bp, Homo sapiens
  misc_feature (400)..(400): n is a, c, g, or t
agcggagttcctagcgaggaggtcgccgccgccatggtcgctctctcggtgagcgcagccccgatctccgggccgggccattcgcgtggccaccgagtgccagtgggccagatgcggcaatcacctccgtccaagatcgatgctggtctctattcttcaatcctcagtcttctgtggtgggcagtctggctattggatatgctactgttgggagccctatgatcttcatcactttattgatggactattgacgcacttctttgtaagatgtgtacacgcctcattccctgactgtgaatgatcgatagcttgtagcgagtccctgacttcttgcatccattgtgggctatatatggtctgactgtgccacacatccggggaaagtcgactgtggactcgnccacgttgtggtcagtcatccttgctctgtgggtgttcttggtcacaagaagattggttgctatgtggggtgtctcggcgagtactgcttctcacgagatgccagagaggggtgcgcaacacagtgacggtttcgagtcggctagccaatatcacgtagacagtgttataaagcacctcaccaatggaaaccgagagctctgccatgtgctgcctaagctcgtgggctaattgcattatgctgagcagaagtaccatgctgcccattcgatatgttgcgtacattgcacgatactgactcctgggaactggaggaactaaataacagacatggggcttccacaggaaatccaaaaagaaccaagaagtgtcccatcttatctgctgcacgacgagactgcccagcacaattgttacatggcgagtcctggcccaccctttcctgactcgtcttatgcttgaagggggtgtcgaggactctagttggtcgaaagacacctacgagaaaactccagtgatgcatggagactctggggccgtgacgagggcatttcgcagctattcagctgctggggcattgctgggatgcttggaatcgtgttgggcagaaa

SEQ ID NO: 718681 - DNA, 381 bp, Homo sapiens
taatttatagctgtagttatctgtagtttcttttctctcggggacagttctgcttctacagaaaaaaatcttttatttctcatgattgtggaaatgatcctggttcctgtggttctggaattaaaaggcagatggatagggaagagatctatccttcagtatgcagattctcatttagtccttattctgggtatggcacatcaccattgcccttctctatgcctgatatctctatactgggtgcctctctggttcagtttcttctacagaataaacttcctgtctctcttaggagtgggggagaggtagttccttgtttacacaagatgagagcaggaatcttgtctctaaataatatttttatttaaacacgatttcagt

SEQ ID NO: 718682 - DNA, 421 bp, Homo sapiens
cacaggctacgttatggagcctcctgtgatctgtctgtgccacaaggcagagttctgcctgtgtgttcagttccaccacttgaggttactcaacagccgtgcggagaaccaggtgatgcacctgcagtgggaagtctaccccagagataactgacctggttggagaatggaaacgtgtccggacagaacggctcaacgacagagaacaaatggtactaactggatgagctggccctggtgaatgtactgccaaggatgatgtgactcactgccaggtgagcatgacgggcaccacggtcacaaaaccatgactgaagttcagccaccgaagagcaggctcaaataccgccgctggtgaggctctatttcagctgacccagcttttttaaacttttagttttgtgggttttttaaatgttaa

SEQ ID NO: 718683 - DNA, 281 bp, Homo sapiens
  misc_feature (222)..(222): n is a, c, g, or t
ggccttgcccagcagccgagcccaggagaaacaagcctaacaaatacagggccggcgccagctgcagagagttctccctgactgccagctacactgaaccacaggaaagagaacgaaactcttccacattcttttctgaagccagacaccaaaacacaacaaagacagcattcgtgcccacagacgcctcacgtgcgaccacagcacagaagccacggtgtnggcagacatttgccaagagccagcacaacgccccaaacggggcccctgcagggagggag

SEQ ID NO: 718684 - DNA, 902 bp, Homo sapiens
gggagccagcagtgggaacctggtagggtccccttccacactgtggaagcttggttcttgcgctcttcacaataaatcttgctgcttctcactcttagtgtccacaccgcctttaagagctgtgacactcactgtgaaggtctgtggcttcactcctgaaatcagcgagaccatgaacccaccaagaggaatgaacaactctggacgcgccacctttaagaactgtaacattcactacgaaggtctgcggattcactcctgaagtcagcgagaccatgaacgcaccggaaggaatgaacagctctggacgtgccacttctaagagctgtaacactcactgtgaaggtctgcggcttcactcctgaatctcagcaagaccagaaaacccaccagacaggaagaacactcgtggacacatctgaacatctgaaggaacaaactctggacaacaccatctttaagaacttgtacacatcagcgcgagggtcatgcggcttcattcttgaagtcagcagaccaagaaccactggaaggaaacacatctagacacatatgggtgacccagatgggactattgcctatcgcaaggcagaatggcggccatcaagctacagatgggcttacgaatggaatcccacatgagctcgagtaaccaatttctatcagaggaccctttggactggcctgctgggcctattcacggcctagagaagaacccctctgggagggacgaccaactaagtggacggggcccgtgcatatggccccggcacagcagggaagacagctcaagctgggcaagcggcaaatcacaagagcacaacgaggcggaccagttagacgggacatgggacaactaccgcacgggcatactgggaaaggcgcaaactgggcgaacaaac

SEQ ID NO: 718685 - DNA, 498 bp, Homo sapiens
ccagtatctatgcctatgatactgggatcgggagaatactgggggttgtccataactgggtggataccagtgcctgataatctgcgttgggacttacataccaatcagaaaataaagggtcctgactgaataaaaccgaaaaactgaatgaagcgggccaagaatcgattgattcccagagactcacaaacactgaggactgttacgagccacaggagcatatccgcgtgagaccaggactgcgagaggaagcagcgaagagaacgaggggaatgcaggcagaatggaacgagaaaagaggacagacgagcaaaggaagacagcaagaaggcaggaagtatagagcggagaaacgagacggaagaccgcaaagcgacagacactacgaacaacaaccaccagaatgagaagggggcagacatgagaagtaaaaacaaacatgaagggacggagcagcacagcaaacaacgccatcgccaggaccaaagaacatgagaa

SEQ ID NO: 718686 - DNA, 281 bp, Homo sapiens
cgttggttcgtgggctggttcaatctcattacctgggttattgggtggtgttttgtctaaacgacttcagagaacgctcttccgacagtctatcctatatattaaactcagaagcacacctagcctaaccttcaaggtcctgcacaactcagccgcaacctagattcataggctcctgttcagacctaaataaagagatcatgctccagtcaaaccagactgatctctgctgtcctcttagcataccaccaaaactgaccctgaccaaaaagcacaaacga

SEQ ID NO: 718687 - DNA, 107 bp, Homo sapiens
tggtgagcttcgttcttccgtgaaggtaatcagatctacaatgaagggccccaggtcaaacacgcctccttccttgtccttggggacctcgccatcaggcccatgcc

SEQ ID NO: 718688 - DNA, 476 bp, Homo sapiens
ggcaaggcggcgcgaagcctgcccctgggcgccaggtgtttcggggtgcgggtctccccgaccggggaaaaggtcacgcaccctggccaggtttatgatgataaagactacaggagaattcggtttgtaggtcgtcagaaaaaggtgaatgaaaactttgccattgatttgatagcagaccagcccgtgagcgaggtggaaactcgggtgatagcgtgcaatggcggcgggggagttcttggcccaccccaaaggggtaaataaccttggccaaagaaccaaaacccggcccatgcggttactgtgggctccagttcagacagcccccccactagagggtgtggcaccccgggggtcccccagcatcctgtgagcatttccgcggggaagctgagcacgtgaagctcgctggttttgtgcgaagggtattcctggtgctgaataaagggtgttgctgtcaaggccaaaaaaaaaaa

SEQ ID NO: 718689 - DNA, 872 bp, Homo sapiens
  misc_feature (37)..(37): n is a, c, g, or t
  misc_feature (92)..(92): n is a, c, g, or t
  misc_feature (97)..(97): n is a, c, g, or t
  misc_feature (116)..(116): n is a, c, g, or t
  misc_feature (148)..(148): n is a, c, g, or t
  misc_feature (165)..(165): n is a, c, g, or t
  misc_feature (178)..(178): n is a, c, g, or t
  misc_feature (188)..(188): n is a, c, g, or t
  misc_feature (195)..(196): n is a, c, g, or t
  misc_feature (217)..(217): n is a, c, g, or t
  misc_feature (230)..(230): n is a, c, g, or t
  misc_feature (250)..(250): n is a, c, g, or t
  misc_feature (252)..(252): n is a, c, g, or t
  misc_feature (255)..(255): n is a, c, g, or t
  misc_feature (263)..(264): n is a, c, g, or t
  misc_feature (344)..(344): n is a, c, g, or t
  misc_feature (351)..(351): n is a, c, g, or t
  misc_feature (370)..(370): n is a, c, g, or t
  misc_feature (381)..(381): n is a, c, g, or t
  misc_feature (384)..(385): n is a, c, g, or t
  misc_feature (401)..(401): n is a, c, g, or t
  misc_feature (405)..(406): n is a, c, g, or t
  misc_feature (416)..(416): n is a, c, g, or t
  misc_feature (426)..(426): n is a, c, g, or t
  misc_feature (433)..(433): n is a, c, g, or t
  misc_feature (436)..(436): n is a, c, g, or t
  misc_feature (472)..(472): n is a, c, g, or t
  misc_feature (546)..(546): n is a, c, g, or t
  misc_feature (552)..(553): n is a, c, g, or t
  misc_feature (562)..(563): n is a, c, g, or t
  misc_feature (569)..(570): n is a, c, g, or t
  misc_feature (572)..(572): n is a, c, g, or t
  misc_feature (579)..(579): n is a, c, g, or t
  misc_feature (614)..(614): n is a, c, g, or t
  misc_feature (629)..(629): n is a, c, g, or t
  misc_feature (631)..(631): n is a, c, g, or t
  misc_feature (635)..(635): n is a, c, g, or t
  misc_feature (679)..(679): n is a, c, g, or t
  misc_feature (838)..(838): n is a, c, g, or t
attaaacatcattcactgagaatttccaaagcactgntgtggtgcctagacctgtgtaccagcgctctggcgggtcgggagaagtctaaggnacggnccctgccctggcgcacggntccttctccctgggaaggcagctccactgganaaaggccactgaccaantccagaccctgangacgacgaangcctcgnngcagaagcctgaaaaaatcangacccactggaanaaggaggaggtgcaggaagnanacnctgcccannccccaggctgagctgtggggaaagctatgacccagtttgctgagagctgcaatgacgaacattggctctgtgcccagacncccaagncggccatggactgggctgncctttcctggnccnnggggaaggaggaaganctcnngcctagcagncccgtctatnccctggngangcagggcctgacttctccctttagagcttgcatcangaggaggctcaggagagagagacttgcatcagaacactccagacagccgatctcccactcagtattcctctccngggggnnccacccagnncctgcnngnccctggntgctacgtggagcagagaccctggagtaatttggnttggggacgtccccncnccangtccaggccagttagtcacccaggctacagcttagggtaggggntggggaggatcccggtcactccttcttactatgcgaacagaggcagaggagggacaggtgcccagccccagtttgggtctgtgctggggctggcagatcccgtgggcatgaagcttccctgccccatgtgacacctcgctacggccccacatgtcttgnttcatccttggggctgggcatctggttggcaagg

SEQ ID NO: 718690 - DNA, 331 bp, Homo sapiens
atttggggcttggctgacgtgtcagagaactagagctaaagaagcctctaaggacatcaggaccaaatcttccaatatgtagatagaaacaaaggtcctggccaggcgcgatggctcacacctgtaaccccagcaccttgggaaggctgaggtaggtggaacacctgaggtcaggagttcgagaccagcatggccagcatggtgaaaccctgtttctactaaaaatacaaaaaaattagctgggcatggtgtggtttaaaacagtggacaaccaaacagggttttcacttgtctgcaacaagatgagaaaaaggccaagccccagctgcgg

SEQ ID NO: 718691 - DNA, 243 bp, Homo sapiens
gtagaccggattaaggcgctattaccctcataggtaaaggattaaattggcaaaagctagtcctgtgaaatagctccgtttatcacttgggaccctactaagttccgtggtctcccattggatatgattaattctggccaatcagaacccatccctaacacatcagatgatagggacttagactagggaagaagaggttttgagcgtttgaatccctcaacaagttatggtaggagagtctag

SEQ ID NO: 718692 - DNA, 194 bp, Homo sapiens
tcagaccggagtaatccaggtcggtttttatttacttcaaattcctccctgtacgaaaggacaaaaaaaataaggcctacttcccaaagccccttcccccgtaaatgatatcatttcaacttagttttatacccccccccccccaaaaacagggtttgttaaaatggcaaagcccggtaatcgcataaaactta

SEQ ID NO: 718693 - DNA, 781 bp, Homo sapiens
gcgggtaggctgccggtcttcaaggtcttgggaaggttcgtcgggccaacagctgagacccgaaagcttcaacagtcagtcggtgaaatccagtttggactctgggacttactcccttaaacctttgttaaaagcttactccctttagcctttcggtggcacagtaaggacaatggtcttaatgtttctgagcatcttagactttatactaaaccctaaaattgtgatagctaccttccaggaggcatgatgaaaggaagactttttaaattttatgagccgcttgagctttcttattcggacagcggcagcttagtctacagggactactttgtccttttagtatttttttttaactaatataaaccagtttaaaattgtttagaataggtagcatttaacccacccaaaaatgaatacctctttggagggtatatttttaagtatattaagtcaaagtgaatgaaaagccaaaaatattttttgggagttggagtctcactccagcctgggcgagagagggagactccatctcaaaaaaaaaaaaaacggcaacaacaacagcaaaaaaacactgattggattccaaccttccttttttaacattttctccagtcccggggagcaagttgcagttcaagggtgataaggttacagggaataactctctgggtgctcagtcgcccgtgtcttgagggtacttttctctacactatagttctcaacttatttggggggaaatacttcagcagaatacaatgggcaaacgagtcttacccct

SEQ ID NO: 718694 - DNA, 181 bp, Homo sapiens
taccggtccgctgactcttccttcacagtcataaagctatctgctttgccatctaatatctaagtagcataggaaatatccggggacatttcaaatattgttccaaccaggggtacatattaaagagtctagtcatagttgtctcctagtagattacctaagggaagaggtcagcgtagta

SEQ ID NO: 718695 - DNA, 157 bp, Homo sapiens
gcgttgctgtcttcttatgcacagctcgtcttccagcactccgagagcaacaggaagccttccacattacctcaaccggcccttgtagatgttctgacttggaaaaccccgggggcgacacgatgcagtacatcctcaacccgatctgcacctggcc

SEQ ID NO: 718696 - DNA, 293 bp, Homo sapiens
  misc_feature (291)..(291): n is a, c, g, or t
gctcgacaactcagctcggcaccaagcagagttcaagtcctggatatctttgttaacctcctctctcgttgatctgtctaatattgacagtggggtgttaaagtctcccattatcattgtgtgggagtctaagtctctttgtaggtctccatggacttgttttatgaatctgggtgctcctgtattgggtgcatatatatttaggatagttagctcttcttgttgaagtgatccctttaccattatgtaatggccttctttgtctcttttgatctttggtcgacgcggccngc

SEQ ID NO: 718697 - DNA, 312 bp, Homo sapiens
agctcatcggagaatccacactggtgagaaagcctataaatgttatcagtgtgacagatccttgtaactgtagttctcacctcattgcacaccggagaactcatactggagagaaaccatacaggtgtaatgtagtgtgggaaagcatttaatgaggagttcatccctctattgtgacacctgagaaaccactactggagaaaagcccgtacaaagtgttatcagttgtgaaacaagcattttgtgaagaattcttacccttattattcatcagagagatgcactacgtgggagagaaacgcgtttatattc

SEQ ID NO: 718698 - DNA, 318 bp, Homo sapiens
tgggttttacagagccatctaggagattctgatgtatgttagagtttgagaaccctctgacccaaggaagcggtggtgtttcaagagtggaaacctccaaaaagaaaatgaataaacatataatattttcatattgccagcttcctaggcaatctgatttctctgggtctctgactcccatgacttggaactcccaaccccttttttctttgcaagtagatacagtgtgatgttacaggggtgcatacacatactgatcccccctatttttttttccttttttttttttttttagattcagagtctcactctgtctca

SEQ ID NO: 718699 - DNA, 732 bp, Homo sapiens
gctgaaggttgggggctgcgggtgatcacaggggagaagcaaatggacaaatgataaaatacagtgttgtgcatcagaggctcacagtttagtaaaagatgatcctactttacatggcaatgacaaaagagatcattgactggtgtgcaaagtgtgtagaagacagaagaggaggctagcaagctctcccctagctccagctaggacagtagacaggccttatcaagggtgacgtgagagatctactagctagagaagaaagggaagaggaacagtattcaggatagatgggggaggcggaaaactgaagactgaggaaaccagttagaagcctatgaattcttgaactgacatgctgacgactatagaatgaatgggatggttttgagataggtcttagaaagaagtggcatggttggtggagaaaaggagggctcagagagcactgcatggtgtctatgctaaggcacatgctatccagtgaggtgtgggacccaggtgggtgagggtgctggactggggtggtgggagcacatgcgatagatgatcatgttgagcatccatatacttctacaggaaatctaggtcagaggaaatctcaagtctggagctcagtgtagaagagggagatagtcagatactctgactctcagatctataagtgtcggtaccaatgtgcgagtgcagtggtagtgctggaaacagaatgaaggagtcggctgaatacaggag

SEQ ID NO: 718700 - DNA, 239 bp, Homo sapiens
gtcggacgtccatgccagtatcacgataggtcttcatactatcactcattcatgtggaattcagttgaattcgcaatcacccacaaaatggacattggaacattacatggcctcaggcaaaatttttctgtttgtagcgcaaaaatgagaaggactagaaataatacacatgttgggagttgttggagagcagaatgtgctgcattcggtctcgtgagagccaactgtgcatgtgaccg

SEQ ID NO: 718701 - DNA, 787 bp, Homo sapiens
  misc_feature (123)..(123): n is a, c, g, or t
tacgaatgactacatacccgcttatcaaagaagtgacagagatatccaatctttgctatacagacaggctgatcatgttaaattctgtacaggcgtaatccgctactgataacctcggggtgnaggttctggagagcctgtgaagatatagcaactcgattactatgctgagtatgtgcagcatcatcacagccactcacagagcagtgttgtcgccgtcccccgtcgagaggtcatttgtagtgtaagatagggctcaaagccactcactggatggtaagacagatactctcaaagattttccgagtatggattctctggaagttggacccttagcaactgagttgttgcgagtaaactagtacaattagatcacgtagtttagatgtataggcagataaaaattaaatgcttgaaagtgatacgagtgcttggaggatggaagaaaatactaaaacatgtgtgcgtcctaagtcgagtagcctctgctggtgctgactctgtcaatatgcattatcggagtatccagcgatgactgttctcagaggagtgttggctcccagatccgcagagatttacatcagggtacattcttctgtagtgcaatcgttaaaaatcccacagattagtgatgatcactttaggaacagaacaaaacaaagtagacattttccctagcccaggggtgtcaggagtccggcgggtggaactccacttggagaactccaagataggttgtcgattcagaccacgtgagctgccctgcaatcgacgtcgtcagcctagg

SEQ ID NO: 718702 - DNA, 300 bp, Homo sapiens
tgaaattttacttatgcaatacaactcaatcctttgtggtgagtcttattgatgctcagattatccactggtgtccaatgagagcctctataagttgacccctgagtccttttgacatcaccccagtagtctttgatagctttcttatcttatatgagactaggtagagaggcttatcttatatatgtcttgccttagattggaatcagtcatttatctaaagagcctgatttctctgagtgtaaatggtatttagagagcacaatctgggcagttcataccgtgtttaagaaaatattt

SEQ ID NO: 718703 - DNA, 183 bp, Homo sapiens
atgtcactggagaggccgcttgacggttgaccacctttaactcggtacactacctacctactaccggctactcatctgttccggacaggcaaggtaggggccatcccggctgaccggggtggcacccaccggggaccaagagggctatgcagtttgggggggtactggctcggcattgcctat

SEQ ID NO: 718704 - DNA, 812 bp, Homo sapiens
  misc_feature (231)..(231): n is a, c, g, or t
ctacgggcgcctctggttacgcgtacgtgcgtgcctgcagagggcggacggtgacccggcggcaccggcaggcctacgtgtgcctgtccaaggcaccgggtggagcagctgcgcaagggaggcaggcagcatgcaaagccccgagaaataccagcagagggtggtccgagtcaaactagctagcgacgaccgtggtgagcttgcagtacctgacgccgctcatcctcaccntcaactgcacacttctgctcaagacgctgggaggctattacctggggccttgggtcccagctcgctctactatcccacgcgacccatcgctcagccagcgctgccacccatcggctctggggtaggacgaagtccagcagactcgcagtcgcggattgcctggggccctgggtggcctgcttaactcccctcgttcctccgtggcgtgcctggccttacctcattctggtcggaacggctgccttagcacaagctagctcagccagccttaatcggcatctacttccaaccagcagcttaggcaggctccatatgctgcctgcagacccctcctaggggcccactgaggatctgttcctgggagcagcgggacactagcctagccccctctgtttgcgcaccccgtgtcacccagctgcaaggtggggccggactccccggcgttcccttcaccacagtgccatgacccagcggcccccccttggacgccgagtttctgcctcagaactgtatctcctgggcccagcagcatgaggtcccgaggccattgtctccgaagcgattaccaggttgagtggacg

SEQ ID NO: 718705 - DNA, 184 bp, Homo sapiens
atcagtgtatgctggcagttgaactagggatgtggtgaatatcttgcaatggatggaagtggagaggtgaaatgcagtgagcatgcagagtggagtgaaatgctcctctacaaagagagagaagagcaaatgtgagaaatgttggaagaaagcagagattagggtaatgtgagagacagtgcag

SEQ ID NO: 718706 - DNA, 602 bp, Homo sapiens
  misc_feature (410)..(410): n is a, c, g, or t
accgtggctacccggaccttatgccgcttggccgaatttttaaaaaagggttaatttatgcccaagaaccggggggcttttcattcctttccggttccttcccctcactttccaggggtctcttctctggttgggcttagtgtcctacatggggttgtgaagcgatggagctcctcactggactcgcctctctcctctcctccccccaggaggaacttgaaaggagggtaaaaagactaacatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctacgctatcttaccatgaaggatgntttgcttattgtatatttgtgtatgtaggggaactattttgtacaatagaggactgtaactactatttaggttgtacagattgaaattcagctgtttcattggctgtctgaggaggtgtggacttttatatatagatctacataaaaactgctacatggcagaaaccacacctaaagaaattttaagaattt

SEQ ID NO: 718707 - DNA, 92 bp, Homo sapiens
taaattcgcggccgcgtcgacttttttttttgtgagttttttacaactcaggtgagttttagctttattggggagggggtgatctaaaacac

SEQ ID NO: 718708 - DNA, 439 bp, Homo sapiens
ccccactacgataacttagctgggcatgatggtgcatgcctgtggttccatgctacttcgcgaggctgagatggggggatcacgtgagcccaggcagtacgaggttacagtgagctaggattgtgccactgcattccagcctgtggtgacacagagaccctgtctctaaaaattataatgttaataaattgtgttaaatatcattctatatatctattactaagaactcataccacattcaatagatcagttctggcaaatgtttatatacgtgatttgcagttgcttttatagatctaacattctttcaactggcattagatattgaagaagcattccgtcctcatttattgactaccactttttttttaacctttactgacatactattttactgatatgcgactctcatatcatcccgtccaccaattgcaagtgt

SEQ ID NO: 718709 - DNA, 1948 bp, Homo sapiens
gtctacgcgtatggtcggctacttacccgattacgcgaatatatgagtgtgcacagagactgacgcatgacgcgactcattgatgtgtcagtcaaacagtaacctgcaattatgattgccagttatctaggcaggctatgtgaaacgtgatactgttacggtgtgctgctatctaatagtcaactagcaccactgcaacgtattaggtgcactcatatgattcgctacagagcgaaagccagtagcgacggtgctatagtactagtgggtctctaatacacataggtgtaatagccacgtactgatacagagtaccgtgcacgatgtctggattcacctgtgagcagtacagacttgaccaaagatggctgatgtcaagcgaaccttaaaggcagacccgaagttatacatcgccaattgcctacatttacatctttaacagtacgggtagtcaagcactagaaaaaaggcgcgtcaacaagcgacagatggtcgcacataatatgtaactaattcccgtcaccgaacatttttacgactatgacaccgccatactacaggtctggccaaacaaatacgcgacatattacataaagacatactcgatccaattatcaaacgaactggagcaaaccacaccatattcctaaattatccaagtaaaattgccccaacattttaaggcaccctaaggaggtgatgagccccagatgaactagaaaaaccacaccgccaccaaattgttcaagcgaaccccacatgtttaagccacacattcgagcgatgtggtgcacacacggcaaccattattatcgaaaagtaaagacattataaattaactctcactactgaacagcagtaaaacacacgctgtgaagagcaccacttgaataacagatatagagcataccgatcaaattaagatatcaaaacctccattcatcgcatatgtagcgttcattagaccaatatctacaaagacaacacgcacaaaagatattattactgacacctttccaataaatacattcactaatataacccccaacactactctccaccctctacatccaactaaccaatataccattataccacatacgcaactacaaccggtagcatccctaacaaatcacactaacctaacgtaacaataccaaaaaaacccacaaatcaccattataaaaaaaacataaacacgattatcatatcaaaaccgactaacttgctatcaaacaaaaaactataatcagaactaccgaaacaacatttctgggaccctttaagactatacccataaagacgtatcatatactttaaaacctattgggaagaggaaccaaaaatatgacaattatagtagacaatcaatgaggacacacagacttagaacgttcacacagatggtgcttgacaacttaatatataaccaacgagtaataaatataatcaatataataacaacatagcggcaacacaaactcaagatatattacaacaaatcaacagaaagtaatgcgagatcaatagatcacaatacaaagcgaaaaatcaacagacgcattagagaacacacacttcaggagcaaatagatgattaacctaaacatccaatacgaatatgctaatataatcataacaacaatcacaagttagaaaaagtagaaacataatgatgtacacattcagacaagaattaatagaaaaatacgaaagaaaacaaataaacatgctactaataaaaaaaaataactacgacaaaagaaaaacaaatacaccagatagcccgaagtaagagaaaaatgagtcaaaaagatcaaacgacaacgatgcaaaatataactaacaaaacaaacgacaaaactcacagaaaaacaacaaagaaaaaaaacaaaaacaattcacaagtacaacgagtataatctagataaccacatcacactaatac

SEQ ID NO: 718710 - DNA, 212 bp, Homo sapiens
attatctgaacagacagtagtagcacagcagcatgaccccatctaaaataatgaagaactcatcccctggttcatccctgcaccacaatctactgacccatctatcaaactgcactggtaccaatgcatcaactaccgtaagacgttcccaattatccagagactctgaaatagagactttactacggaattcctcatacatcttccgcttt

SEQ ID NO: 718711 - DNA, 162 bp, Homo sapiens
  misc_feature (109)..(109): n is a, c, g, or t
gtagattggagtcaatagcttgtggatcagacagacaggtagggaacagtgggagtgcccaggtgaacttggcaggtggggccagaaggaatgcaccccccagcacctntggcagtggaacatctctacccttaccttgcagggcctcttcattctttcctt

SEQ ID NO: 718712 - DNA, 545 bp, Homo sapiens
ctgtggtctttcttggcaagcacaagagttttatcttagattcgctggtctcaagtgatccttgttcgttgatgctatcttgtatgggtgaatgggttccccgtcaaaaggatgttcgaagtcctagtgccctaggtagctcagaatatgatcttatgtaaagttggaagtaaggtgttgcagatggtaattagtataggatgatgtccttataagaagatggtcatgtgacgacagaaacatactgggagaatgccatgtgggtccacggaggcagagataggaggtttggcatgctggaagccaaggaacgccaaaagattgctggcaagagcaccagaatctaggagaggagaggaaggattcaccgacaggtttcagcagggagcacggcctgcgagacaccttgacttcagagcttccaggcttccagaacatgtgagagaataaatctccttcgtgtgtcttgtacatgcggccactcagttggtggtcgtctataatggcacttctatggagctaagttacactatgctcttaaagtg

SEQ ID NO: 718713 - DNA, 172 bp, Homo sapiens
tcgatggccgactccgctataattgcaactcagaaatacattgctacttggctgcctctactctattattgtacaccttgaaggtgagagttaattaagtcctgttgtggggtttggagggctggaatttaattttaggagttttatttaatgtcaggagcggattggccat

SEQ ID NO: 718714 - DNA, 132 bp, Homo sapiens
aagagatgactgtcacctcagggaggagcttagagagggggccagcgtgctggaggcagctgggggggaccagggaaggaggaagggttggagcagttcctggcccaggtccactgttatattggccccact

SEQ ID NO: 718715 - DNA, 764 bp, Homo sapiens
acacacgtgcctacgacccgccgcggcgcctgcgcggtacatcgcgagtcggtgcttagtacgccgtggacctttactctcgcggcgcggaaacccgttgtgagctcggtatcctagtgcacacgctttgcaagcgaggggggccatgagttctgacttccagttccagcgtaacggaggttgaattggattcgcaagcaggtttaccaatttggtggctggggacagttgcaatgtgggtttattctaaaggcttacaaaaaggattttcttgttaaacggattcatcggaagataaaaggtttatgataaaattttaatattcaagaaaggaaaaacccaagggataagtaccagttgtttttgtggaccagtggagggaattcgggaaataaagctgggtacctgcgcggttgttggggcggtcccaaaaaaggttccccatttcttgtgatgggggggttcaccacaagaattataacgaaggagagctgggcgacaatgtgggcgacctcttgattcaatcaaaggaaaaagggaaactttaacgttggcgcacttttttgatggctgaaatcagggttgtcgtgaaagtaccctgagttggtgtaactttagaaattgactaccactttgttttgtttaacctttggtgatcctaaaagtgtggtcttatgggcagctgggcggttcacatttgtgccctggtctgttgcaactcgggctgccctttgttttaagccacacacaacaacaaacaaaca

SEQ ID NO: 718716 - DNA, 91 bp, Homo sapiens
ccctctgggtgttttttttggtcccccaggagggtgggtggagcaggtggactggagtttctctttagggccataaaagttgtcatggtga

SEQ ID NO: 718717 - DNA, 1492 bp, Homo sapiens
  misc_feature (254)..(254): n is a, c, g, or t
  misc_feature (683)..(683): n is a, c, g, or t
  misc_feature (760)..(760): n is a, c, g, or t
gatcatggctgtcagaagtgaccaagggcctcagtccttcctagtctgtgtataactgcgaagtcctcgtactcaggtcagtatctgagagatcactcgtgtacctcctagctgagtctggaatttctacacattgctggttctacggagctgtcgtccagtgactgggtgcatggaatgggcttctgtcgcgtgaccggagagtggcgtgtctgggatgcgctcaatgaaactctgtcgttcgtcgagtatangcgttgttgcacgtcgtttggcaatgtcgcttgaaggtgtgatcgtagaataagctagacatcctcgtgaacgctctaggtgtccgtcgatctgcagaatggcggataatatattgtccccgagggggtatatttacgacccatgtttccgtttcagggagggtcacccatgatgggtctcagggtcctgtggcaaatttctactgtagtcctcattagccctaggtcctctcctcttgtgaccctgtaaagggtcagggtgaatcagatgggggactgagcaagtagctatgactgcagatcatgtaaggaacgggactgacaagaagctcccagatgctggggagaatgaagagctaaaatagatcctaggtgctggatgctttgtcatccatgcgtgcacatatgggtgctggcagagcccccaangactctggcctctcgagttctcctatcttctccattctagatgcttcccttgtatccagtgatgtgctggagctggnctttgccaagcttgtgagagctggttgctacattttcaggatttctacaacgttcggtaaaccacatgccattataacaaaacttaaacgtggactgtctacaatcttaactacatttaaggtaagtgacatttaaaacgaaaaattagtactcccaaattcacttacttaattttgctacctgtcactattactctgtgcttttgaggctatttctacattagtaactcttatggaggacctaggggagacaccgcgcatctcttgcctgattccccactcaatgacatcatgtgagtctttaggtgtgcttaacgtggctgtggggagtgtattgtatcacaaagattagagaggactacacatcaggccttgatttatgttgtggatttgctagacttcagaacatgctggataaaatgtcagtaatgcaaattaaactttaaagtatgtctgggttggtagccaatacatggtgtatagcaccaaaaaatggagggattattcttccagtagttggaccctgtcatccgtctcagctgacgctgctcaaatcatttacgagggttctggccttcctttccttgttactttggtctctcctagtgtgaccaacatttaccgttctgcgactttccctttcggctgggcggtcggctctaggggcctggccactgcccccggggggttttgcccggggccaatttcacttttgcacgttggtgggaatcc

SEQ ID NO: 718718 - DNA, 170 bp, Homo sapiens
acagtcgtgcacgcatatcaaaagtatataagttataatcttcattggctgctgtaagaaatgaaagcttccatagggttccaagagcatgtatttgttctcatatctaagataacctttttcaaaggagtagctggcctcatatcgtacagtactatattcctgtcaga

SEQ ID NO: 718719 - DNA, 222 bp, Homo sapiens
accatatcatgataggatgcttggggctggttatcttctgaaggtggtctcccctctggcctgggggttttggtcgtgggccctgccacatgccttctcttgtcctattctgctttgcctggagtggggttggtttgggtcttgtccccctactctgcttctgaggctgactgtaatactgtacatctgtttctgaccattttttgctgttgttctctgtat

SEQ ID NO: 718720 - DNA, 135 bp, Homo sapiens
tggcccaagatgggtagatggacattattcccagacctactggaatcttctgcatccgcctggcttcgtctggggaagcccagctccttccctagaggaagtatcacttgatagaggacaagagtcagaaacatg

SEQ ID NO: 718721 - DNA, 1172 bp, Homo sapiens
  misc_feature (730)..(730): n is a, c, g, or t
caagtcgacgtcataactgcccgcccctgctcttgggaggttcctcgccccccctggagtggttccccatctattctcgggggggaagacacaacttgttgtgggttatcacgcctttgtcgcgtctttctccacatagggtgccccacgtttgataaaaaacattgtgtgtttgtattctttctggtaaagaagaaaccgcccctggttgcaaccccacgcgtgtttttttaatagcgagcgttctccacgttgtgaggagagaaaggaagtttgtaaaatttggggagaaaaacattgttgggggacacccctttgtgtcctcccccccgaggagggcgcttgcaccccacaaagaggtctcccccgcccccccaatgtctgctgtcgttataatagtggaaagagagtttctcccccgttgtgaagagaagtcctcctctttagtgggagcccctatcacccttctgtgtcgtacacctgggacacgccaccgtgggttcttattgaagcttctcccactctcacgccactctgtgagagagcccccctctggtgtcaacagacgaccacatggtgtgttggagagtcttctgtgagtatattgcgcccccccctctgtgggacgacactcttctcactctctactttctctctcctcacatatgagtcgctcctcttatattgagagagagacgcttctgtgtgtggtgcgcctctccccctctgnggccacacacgcgctcacacctcccggccgcacactgtggtgtgagttcgccccccctcccctctgaggccccactcttgtcccaccgcacggaccctctggcgtctcttcacacaccttgtgcccagcgaaatcttggcgcacaccctcgctgttggagagaacccaccgcgaccgcggtgtgttttgagccaccacaacccgggcacacctacacgcgcgggctatactattcccagagaacccgcagaaggaccggctatccccccaaaacgaagggctaacaatgcccccccgtgggtataccccccgccacccacactttcacagagcggcctatctgagagctttcccactctctgttttcccccctcgggccacatcccacccctgagaatccttaaccccccccccgtcccctaaaggttttttttaaaatgta

SEQ ID NO: 718722 - DNA, 982 bp, Homo sapiens
cgcccccctctcttcttttttttgtcttgcgtcgcgatgaacggattatacaatatgtaagaatactttgactgtgtaagcggtgaagtgcttctatagagaccctcctctttgtataagtagtggctccactactgtgttgctttctagccggcctcgctgtcttggtctcgccgccgcgcggggactcacttctcgtgttcgctcccttaacgacgcccggggtttagttccgtcgggaatccccaaaggtggtcctttcctgagggatgtgtcaagaaagagttctccccgaccgttgaaacccgatgctccctgggagcaattttgaaaaactccggtggtgagtggaaatcaacacgtgacccatgtccaaatagggggaactggaaagaagtcacctgtgcagataaaccgtgaattgctcaccttgcccgccaccatcatttggggaagaatccaccgttggcgtgatggaccgagtggatgaaatgacccagatatagttaaataccaccacatacctgaggaatactagttaaccaccgccgcctggacatccgtatcagcagcgtctgcccgccggagaatattccagcgcccgagccgaggagaacccccgctccctgaggaggacctgtcccaaacatctttccaaaccccccccagccgcctgcccggatggactcgctgctcattgcaggcccagatacacacttactgcccagacatccaggagttcactgccccaaacttaggccagctcttcatggccccggctcttcaagaataccaccacttaagaaaaggaagtttcccagaaaagaagttaaccatgaactcttgaagtcacccccgggccactcttggaagaaatatatttgcatattgaaaagccccgaggatttctttagtgtcattgccgattttggctataaccgtgtctttctagcccataataaaataaaaccaaattattgga

SEQ ID NO: 718723 - DNA, 106 bp, Homo sapiens
  misc_feature (102)..(102): n is a, c, g, or t
catatgcagttggcaggcaacacaggttggggcaccagctacacatcaggttgttgttgcatttgggttaacacacacatcagtcagcagggcatgcatgcntcaa

SEQ ID NO: 718724 - DNA, 389 bp, Homo sapiens
actctagaggatcaacctgctgcccgttacgcgctgatgcagcgagcacctgaagcgcgagagcaaaccatcgccaacctgcagacggacctgagcgacggggtgcggcttatcgcgctgctggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgagaacctgaagctgatcctgggcctcatctggaccctgatcctgcactactccatctccatgcccatgtgggacgaggaggagcatgaggacgccaagaagcagacccccaagca

SEQ ID NO: 718725 - DNA, 133 bp, Homo sapiens
cagtacgcctaccaggatctgtcggtgagctggctggttgctgagggagagcagagaccatgtcttgacatagaagaggtggtggaagagtacgatgagtaggagcaggaggagcagctgttaaggagcagaa

SEQ ID NO: 718726 - DNA, 647 bp, Homo sapiens
gcaacggtactaccctgggttccgggcaggggtggaactgtgattctgcctggactggggatcggatgggggtggaggttcgactttgggaagcagagcacagcagcccaaactttgctcgtaactggcggcggctacagaacttgacttcttgggaacagaacacagcagcctgaacttgacttgttactctttggcagctacaggcacgaacaagaaggccaaacagaagcctccaccaacttgtcctccctgcaggcaacgcatcaaattgaacaactactccacacaaagaagcactcttaactgagcacactgacaaaactccaggctgaatgactcatagtacctggcttcctaacttcataccactgaaaggggcactgacagatggctacggcacgagcacagctcttgcacacttgctaacaccaatccctgccccaatctcccagtagcttgctgctgtggcacggcaacagcagaatctgtgtgtttaacgggacgcagagagggcagtgactcgtgggactttgcgtcggaactcactactgccctgttacagcacgacaagcaacaccaggcataactcagccggtacccacacgagggagcattctagaccagccctaaccagtggtcacgaa

SEQ ID NO: 718727 - DNA, 404 bp, Homo sapiens
ttagggctccactcggggggggacgggtacagaggagcggccggggctctcggctctggtcccgggtgtgtgcagctgcggggggcagagctttagaattcagacgcagggggcctgacttaactctcctgagcctttgaggtcacccggaaaaatccccatttctcagggtggggaagctgaggccgcggccaaggcaccagccagggctgtgcagtgtcccgctccaggcacagcttcgtgcggccagcttgtgtactctggcggattccaactttcccggagaagcccagcacagaggctgcagctatggtttgcgaggagcccacttggttcaggggcacagggttgggcctacagccggagctgcgtggggtgacatgtcgtccctgttcttacaagaa

SEQ ID NO: 718728 - DNA, 703 bp, Homo sapiens
ggagagaactagtctcggttttttttgtttttggataactaactcgtgttttgaaagcagtaaaaggttccacgacccaaataaaccagttctgaggtttccccaagaataattttaacagctccagcttacagtgtttatcaaaatacaaaagaaaaaagtaaaggtggtcttttcgatggcaaatcggacccttgacaggctgagggagagaaagctacatcacacacagaggtggggtgacccccgaggggctgtgggtactaggtggaccgcctgcccggtttgcacgcgctcctgctggtgaggccccaaaacatcctgccaaagtgtctgagcgacacacaattgttggggacgacggacccactctggccacacggaaccgagggacagatggggccctggtcccaataggcttgcctagaaaggtgggtaaggggcggcctgcggcatacatggggtggcctgtgagctcccagccatggccccttggaataacccgggtgggaagcacagcggacaaagcaacagtggcatattggaactgcaaggggtgaacccaacgggaccaagcgactgcgggagaataatccaacggtgacctatgccaaaattgacacggcagtttgatgcgacaaccaaccaccattaatgttccccaaagcaggaccacgatgacgcgtggaagatggtaaatccg

SEQ ID NO: 718729 - DNA, 285 bp, Homo sapiens
acccccccccccccgggggggggggggtggggggccccttaaaaccccccccctttttccccccccttttttttaaaaaatggggggggggggttttccccccggccccccttcccaaatttttccccggggctttccgggaaccccccccccaaaagcccctttttaaaagggggggttttttttttttaaggggggcccccccccggccgggggcctttttttttttttttttttttgggcccgggcccccgggagggcccccttattttttttttgggggga

SEQ ID NO: 718730 - DNA, 795 bp, Homo sapiens
ggtacggtcccgcgtgactgcgcgcggcgctctgggagtacgacatggcgcgcgactgcgggcgctgctgtgtggggccgccgcctgcggctttgctgcgggcgcgggctgcggcgtgccgggaggaaaaccaattctgtgtcctcggaggaccacagcccattgggccccagggaaacccagcctgagcttgcatggccaggacgacttgtcagcacgcagaccgccgaggacaaggaggaaccccttgcactcgattatccaggcaagcacagagagcgtgcagggttccactttccaaaaccatgagtcccaggggcgagacaaaaggaagctttgggccacatttgtttggccccggtcccttgtacctcaggaacaagacgaggttgttaaataccggggaagcttgatctccaacaattgccgagggccgaattgccctttggtaaaaaaaaacagccttgggcgggttcaacaaaaaaactgttgggcgattaggtccctttggaaccgctggggccccacagagaggcccaacctttgtggccccagggaagacaagcttttggcgaacacaatttctcccacttttttgtgccacaaatggaagccccaaaaatttggccctggaaagaaaaacagggggcacccacaatttcaaacccatttcccaagggggattaacctgggagatactccggcggcactgaccaccagggaaaggacggctggcttgttccaaacccttgggggaacgatttgcccaggatcgggggctcaacagccctccct

SEQ ID NO: 718731 - DNA, 867 bp, Homo sapiens
gaagaaagtgtcagagccgctccctggactgtcggaagcggagttgtttgtaaaggcaaatgcagacgcctcctcctcctgtcacttcgggacaagttaacaatcttcagattcgttattaaagcctcgtgtaccctatgtgatctatcaggttcggctttagagtgtggtgaagggtacttttcatggtgcatggaggaaagccaatgcgcaggtaggcgatttaggaagaaaacctttggtttcactgattaaagattcagcatgtaataatttaaatttttaaagaaagagtttcaatcttactaaattctgcttggaactaatgagtcttgttctacaataaatcaaagagtaatattaagaattaagtagctttttaatagaataaaatacagaagtggtttctgaaaagtgctgtggattgtatgtagtgctaaacacttaaattttccttttttcatgttttttacagtaaataatcattaagttcattatgatactatatggatttattataatcttcagttccctataaaatgtagaggattctgttcccatgtaagaatcataattatttataatatactgtactgcatgcctaattatggttaggttatttccttgatgttcaatcatacatttgttctggttaattaaaatagctgcatgtagggaagatgtatcaggactaaaataggtattagacattataacttagtccatagaaagcatagaacaatgtctggggaacaatatagacactcacatagggccctccaaagcctagaacttcactaatggttgttctacattttggtgctaaacaattgagacttagaatcttaatggatccagaaatcatcc

SEQ ID NO: 718732 - DNA, 767 bp, Homo sapiens
tggaggatcccacctcagccttcgtgactagtgaggtgcgcaaactgcccgagttttccctggtgcgcgggttcctgcctttgcagtgccctccacccttcctggtgtctagaccctgccttcctttcccagtgcccttttgtaccctgtccctggaaagcctggctgtcctgccgcgctgattgcccctgctcggacttcttcccagtgaggggcctggggcttcggcttgctcagccagttcctgcgaaccggtccattaggaggcattccgtgccaccggtggaacgtgatcctgtttagccaaaatgcccacggtttgccagacggccaagttgtcaaccaattcccaaatgtgaaaaggcgagcatcatcgatgaaaaccagaatttccattgaattacagaggatcccccccaaaaaggggggataacccgaggggggcaactttctttaacggtcccctttccgagcccaattaattggcgcctctgagctggaaccgggcgatgcaaacacaccgaatctacccgtttcgggacgacttgtaggggcagtcacctaactttacacagacgtccatgttggagcccccattcttctactaaaaacgactcctcgatgctatccacaatgtttggttagtatacctactaactataacggtgaccgagatacaatttgggggaaccaatgtccacaccgctcaaagtgtcccaattctatgggaaaggcccattatagcaaagtcagggaaaacatacacc

SEQ ID NO: 718733 - DNA, 283 bp, Homo sapiens
gaagaaagtgtcagagccgctccctggactgtcggaagcggagttgtttgtaaaggcaaatgcagacgcctcctcctcctgtcacttcgggacaagttaacaatcttcagattcgttattaaagcctcgtgtaccctatgtgatctatcaggttcggctttagagtgtggtgaagggtacttttcatggtgcatggaggaaagccaatgcgcaggtgtaccaacattcgacagagagactggatggatgtaacagccgctgcacccttggggacccacaaact

SEQ ID NO: 718734 - DNA, 963 bp, Homo sapiens
  misc_feature (959)..(959): n is a, c, g, or t
tagagagatgaggtgaaatatcgtaagtgttctctgttcccggaaccgaaatcacctgtggtccatgtgtttgatgaatacaaaaggatatcacagaaggatattgaccagagtataaatctgaaacatctggtagcttcgaagatgctcttgctggcctatagtaaagtgccctgaggaaccacatctgcatatttgctgacaagctctatacatcgatgacgggcttgggcacccgatgataacaccctcatcagagtgatgccttctcgagcagaaatggacatgtggatatccgggcacccttcaagagactctatggacaagtctctgtactcgttcatcacagggtgacaccattcttggagactacaggaacagtactgctttggtcctcctgcgagacggaagatgattaaccctcaacaaatcccagaaggaccacgcgaggcttctcaacacaactttgaattctcccacacctttcattttttctacacttgctattactcatcatctcagaatgcttattcccaattacacacgcctacacgctgcctcctaagacatatagactgtctgtctcattattcacctataatcagtccatcaacgactgccttcacaagctgttacttgcctttcaacagcttataaacatatcactggagattcaccgtgaaataacctctgttttccagctcaccagactcactcaactgggtccaccgccctgactctttacatgtcatatctcttccgggacgcttccaactgcgatgtctacaaccacctgtgcccctaaccaattcaaggggacgccaccatgaaagtaacacggagtaagccccccctaattggccaccccgagccaatatcctcgtgtcaaagactaaatacgcccaacatgcgcgcccactatacacccacccagcatctacgtcccaccccaccatttncccc

SEQ ID NO: 718735 - DNA, 1445 bp, Homo sapiens
agcgggttggttccagcctggagaggccgaaccagcgcgggggtcgaggagacctgagcctgccatactgagtctatggacagttccacagaaagaatcaaattctgctgtagaggacctggttagaccaactatgtgatagtgctaaacggtagcggaaaaacatatttcccatgtattccctcatcaataaacgaacatgaaaattctaacgaaggcagaaaaaaccagaataacgcacaacaaatgacataaacaatgactagtaaacacatttgcacgcattcaaaacaataaacgatgaagacctacgtaaataaacaagggataacatacacacatctaacaaagaagatacacccgatatagatcaaaaacaccataacataaaccgaacacgctgaacaaggcaaaaagaaacaataaacagagcatatacgataaaaaaccctgaaaaacgaataaaacatacaaatacaagaccaacagcagaagaaacgaaacacataaaaacatactcgcaaaaaaaagtcaaactgagaaacaacccaataaaagcaacaaaattagcaataaaaaaaaaagaaaaaaaatatacatacaaaaatgaaagacactaaaacacaaaacaaacataatgatagaagataacataaaaatgaaaattcacacatacacccggaataatatcaatcaataagtatatcagagccggtgacgaaaataaatatagacggcccataatatcacggaaagtggatagcactaaaagaaacaatcccttgaacaattgaaccacagaaccgtagaataaaattaaagaaaaccaacaaggtaagggggaaattcatcactatgttcaaaccaatgccgtccgctaattccgtacaattacaatatccacaggtgcggttcctacaaaacgcctgcacatttctacaatcactctatgtgtaggaaaagccgcaatggaaaactgtattaatttaagcttaacctaatttacccttgaatacagatgaccctccattttcactcactccgaattatgcgccagcgacgtgactataatagcacgtaagccatttgttcatggcgacccgccatatacgataaacaaactcgaatagaatactcaagtccccaacgtctgttcaaggcgatatgttaaaccttctatttagtaccagtattagccgccatactcgcaattgtacatccccatcataatggcagttctccactacaaatataccgtcacagacactgtgacaatatgcccgtgaaatttccctaaccctacgtccagtggtttacactaatgtcactaacttcgcgcatcatctatttatctcctatttgtgcctagtcaactgcatagccatacttcgcctattataaattcgtattttacttgactatatcttcataaggacatttaattg

SEQ ID NO: 718736 - DNA, 258 bp, Homo sapiens
  misc_feature (79)..(79): n is a, c, g, or t
  misc_feature (142)..(142): n is a, c, g, or t
  misc_feature (191)..(191): n is a, c, g, or t
  misc_feature (213)..(213): n is a, c, g, or t
  misc_feature (221)..(221): n is a, c, g, or t
  misc_feature (227)..(227): n is a, c, g, or t
tttgtcgcctttgccgcactctgccgcaaagactgagctttctaaaacataaagtagagttcgatgttattcccctccntaaaaggctttcagaggatctccatggccataggaagaacttcgagattccttagcgatgctnacgagaactcaccaggatcaggcctccttatttctctaatttattttcnaccgacagaatcctcatgtgtnaccttaanattcgnagactcattaaattacttaaattttcctgat

SEQ ID NO: 718737 - DNA, 446 bp, Homo sapiens
  misc_feature (7)..(7): n is a, c, g, or t
  misc_feature (63)..(63): n is a, c, g, or t
  misc_feature (103)..(103): n is a, c, g, or t
  misc_feature (188)..(188): n is a, c, g, or t
  misc_feature (208)..(208): n is a, c, g, or t
  misc_feature (218)..(218): n is a, c, g, or t
  misc_feature (233)..(233): n is a, c, g, or t
  misc_feature (290)..(290): n is a, c, g, or t
  misc_feature (303)..(303): n is a, c, g, or t
  misc_feature (314)..(314): n is a, c, g, or t
  misc_feature (321)..(321): n is a, c, g, or t
  misc_feature (330)..(330): n is a, c, g, or t
  misc_feature (333)..(333): n is a, c, g, or t
  misc_feature (346)..(346): n is a, c, g, or t
  misc_feature (387)..(387): n is a, c, g, or t
  misc_feature (401)..(401): n is a, c, g, or t
ttttggnaacatgtttcacatgggcaagtggttattagagaatgatgcccgtgacacggctanagctatagcacacccacaaatagattcatacttggttgtntaatttgcatgcttgagtatggtgctttctccatgccactagttcatatatgccttttccagagtcagtgcaggatccgtatttntgcatgtctttttttatgtntgctcccttnccaaattttaccctnatttatctgagacagccttcctgtgacaaattctttatgctgcttttgctttcaaanggtcatttctgantattaattttngctgtcntgggttccngcntcacataacagantctgtttgttagttattttaatgtcagttcgctggctgtgngtaaacgtagctanacatatccccatgcttggtatctggactttgggatcggtaacctt

SEQ ID NO: 718738 - DNA, 505 bp, Homo sapiens
gcacgagctggtccccgaggccgacccatcctgggaaccctgtgtgcagctccctgccatgcttgacctttgccctgtgggtggctttgagcgggggagacctgggtctggtggtgggcagggcaggggcggaggtggacttgggtctttgtgacactgcaccaattcccatggattctgccggcacccactgccctcctgagcagagcaaaggcagcagaggcggatgccagggtccggaggtggcatctactcatcagacactttctgtagttttataacaaatttggggcctcatgttagaccccagccagaccaggctcctgtcctggggctcagctccctccaagctgcttcaggttcagtttcctccatgcttacgaaaccgaagggcaacgggcacagtcagggaggcgtcagaggaggcaccggctccactgttcacactgggaccttctgcagacggggctcccagcctcgaccagccccggaacccccagcacgg

SEQ ID NO: 718739 - DNA, 649 bp, Homo sapiens
agactggctcctacatattcgtggactatgcaacacgttctccagcgacgccctgaaggtgacgtgcctcatcacccgcctcacagggacccgccctgtgagatgggtgatcccctacatcaagaaggtagagccccctcctctaactgattaccggcggctttctggcctgacgatgaacgccgagtcttttggatggcgccggacgtgacgaggacttctaggcccgtgcgatgaccctcggccctggcgcggcgcggtcgctcatgcgggaggggtccgcttgtgttactaggccgccgtctttagcatcgccatcgctggcgcccgtccacatacctgtgccgtcctcctctcccgctctgactcctgcctgtatcatccccttgcgctccttgttcccttcccgcgtaggtgcttgcctttgttcccaggaattagcgctccatggctccttgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactact

SEQ ID NO: 718740 - DNA, 255 bp, Homo sapiens
acgctcatttacttacaagaagttacttatctcattattatgctatctttctttctttgataactgtttgtatatcttcatgatactttgcttctttttttgttgttatactctaagtttaagggtgcatgtgcacagggtgcaggtttgttgcatatgtatacatgtgccatgttggtgtgctgcgcccattaactcgtcatttacattgggtatatctcctaatgctatccctccctcctcccccaaccccac

SEQ ID NO: 718741 - DNA, 139 bp, Homo sapiens
tacgaggacttatcggggcattctggactctccctgtatgagggcacttcaccaggacctgaccctcatggggaaggtgaggaccactgaggcccccctccacaccctgccaagggccttggttggtgtctgtaatctc

SEQ ID NO: 718742 - DNA, 824 bp, Homo sapiens
  misc_feature (13)..(13): n is a, c, g, or t
  misc_feature (148)..(148): n is a, c, g, or t
  misc_feature (173)..(173): n is a, c, g, or t
  misc_feature (194)..(194): n is a, c, g, or t
  misc_feature (211)..(211): n is a, c, g, or t
  misc_feature (247)..(247): n is a, c, g, or t
  misc_feature (270)..(270): n is a, c, g, or t
  misc_feature (290)..(290): n is a, c, g, or t
  misc_feature (365)..(365): n is a, c, g, or t
  misc_feature (379)..(379): n is a, c, g, or t
  misc_feature (418)..(418): n is a, c, g, or t
  misc_feature (428)..(428): n is a, c, g, or t
  misc_feature (430)..(430): n is a, c, g, or t
  misc_feature (434)..(434): n is a, c, g, or t
  misc_feature (443)..(443): n is a, c, g, or t
  misc_feature (453)..(453): n is a, c, g, or t
  misc_feature (484)..(484): n is a, c, g, or t
  misc_feature (494)..(494): n is a, c, g, or t
  misc_feature (570)..(570): n is a, c, g, or t
  misc_feature (648)..(648): n is a, c, g, or t
  misc_feature (715)..(715): n is a, c, g, or t
  misc_feature (800)..(800): n is a, c, g, or t
atgtttgccaaancaaccagcgcaattttcttgagaagaagttgatgctgatgagtgacctagattgcgagtatcaaatctcgaatgactactgataagtatacagctatctaaagtctggtgacaaaaaagaagagattctggtgcnggcagagacccaagtaccagttttnatccctcacccttggcgatgnactcatagaagaccaanttccgagctccacgtgagtcgtggagtcggactttntgaaatacgagggcaagtttgcnaaccacgtgagtggaacccnggagcactcgcactcgcggcgaaggtcaagactgaacctcggggggcagcagccgcgtagagagccagtcttcanttaggaaccctgancgaagcaggaggtggatttgcagcagctcatcagagacnctgccgaganancaanaaatctganaaacactgtncatccagcagcgtgctggcagggaaggaatnaggtcctgtncgttttgacacagaagatcacaacgatgcagaagtgtgtgatctctgagcacatgcaggtcgaggagaagtgtggnggcatcgtgggcatccagaccaagacggtgcaggtgtcagcgacggaggatgggaatgtcaccaaggactccaacgtngtgctggagatcccagctgccaccaccattgcctacggtgtcattgagttatacgtgaaactggacngccagttcgagttctgccttctccgagggaagcaaggtggcttcgagaacaagaagagaattgactctgtctacctggacccctngtctttcgagagtttgcaatcaaa

SEQ ID NO: 718743 - DNA, 146 bp, Homo sapiens
tcgattagaggatcccatttaatgtttagagacttataaaaaaatctaataggtttttgtgtgtctctagaataacatatttaaaaaaacaatttacaaataatgtaattgaaagtgataagagtcattgcccccgtgtgttaacg

SEQ ID NO: 718744 - DNA, 170 bp, Homo sapiens
tgtgggtgaccgtggtctttgggcacaatcattggaattccttggagccactgggattcataggctttgtatccaactagcatccaggcctgaggctgctgacgttcgacaccaggtccagtagagagtgcccttttgtatcttaagccaggctcaacccacaagccacg

SEQ ID NO: 718745 - DNA, 214 bp, Homo sapiens
aaaggaaaaaatggggggaaggaaaagtaaaaaaaaaaatcccccttcccggcccaaggggtttttgcccagtttttttaaaaagaattttccccagggatgggttcctgttcaccaaatggggcccgggaaaactgaaaaccttttgcttaaaggggcctttttgcccgctgatggggggcccccggaagcccataaattttttaattgttta

SEQ ID NO: 718746 - DNA, 523 bp, Homo sapiens
  misc_feature (186)..(186): n is a, c, g, or t
ggtgggtggggtgggtttccccgctcttttgttgtgcaaagggttttgtgcgcaccgcccttttgtggggggttccttttgtcccccacacgcttccccaggggccggtgtgggggcggagggatatggccttcccgggtgtttcccctttttacccccaattttttgggggtgggggaaggggtntttgcccccccgggccccccccccaaaagggtttttttttgggggggggtttttttccccccccgggcccggggtggggggaaaccccccccccccttcaggggggttgggggggggttgcccccccccccggggaaaattagggtttttttcaaaaggccccccttttttttacccgggggaattttgtttttgggcttggttaaaaaaaaattaaagggtgggtctggggcccccccccccctgggggggtttttcccccccccctttttttgggttaagcccctttttccgtttttgggtttgcccccccttaaaaaaattttttcccccccca

SEQ ID NO: 718747 - DNA, 149 bp, Homo sapiens
acatgcccttggtatctaagacatctaaatcacggctaggcactaccatgcctgtaatctcagcactttgggagggcaaggtgagaggactgcttgagctcaggaattcaagaccagcctaggcaacatagggagaatctgtctctact

SEQ ID NO: 718748 - DNA, 205 bp, Homo sapiens
  misc_feature (110)..(110): n is a, c, g, or t
tggctagcaggtcatggtgggcttgatgactcagtggtcaggggtcgcttgccaggtggtcacggggtccggactcggtgctggtgtccatattgtgcttggatacaggncatctctggagagagaggagaccccaggcagggaaaggagagtcagtgtgacaagcctatagccttgtctcaaagtatttgggcccccgagcagc

SEQ ID NO: 718749 - DNA, 837 bp, Homo sapiens
  misc_feature (403)..(403): n is a, c, g, or t
gaccacgcgtcgctctttccccggctggttcccggcgcggatgtgaggggttctctcctctacgcggaatccgtcggaaccatggcttccctttccctcgcacctgttaatatcttcaaggctggagctgatgaagagagggccgagacagctcgcctgtcgtcgtttatcggtgccatcgccatggagacttggtgaagagcacttgggaccgaaggcatggacaaaattctcctaagcagtggacgagacgccgctctgatggtgaccaacgacggtgctaccattctcaagaacattggtgtggacaaccccgcagcaaaggttctagttgatatgtcaagggttcaagatgatgaagttggtgatggcactacctctgttactgtcttagccgcagagntgctccgggaagcagaatctttaattgcaaaaaagatacatccacagaccatcatctcaggttggagagaagccacaaaggcagcaagagaggccctgctgagctccgctgtggatcatggttctgatgaagccagattctggcaggacttaatgaacattgcaggaacgacattgtcctcaaagtccttatcaccaaaaggaccatttactaaactggcgtgaagcggtctcagactgaaggtctggcaactggagggatcatgtctcagaactagtggagttgggagatctattagaagaaggtgttggtaaaattgggtaattacccaggattggatggaattttttggatctgggggtgccaaagatttggccggaagggtccccagtgggataaagttaggaaaggaggggtttcggaaagtttaagga

SEQ ID NO: 718750 - DNA, 1320 bp, Homo sapiens
tggttaaaacattctctatttttaatttccaattttataatacgattacagggaaggatggcttatggaaacaaatactatttggtgttcagtacatggtctttaaatggatagacttataagtatggtaaacaatctatactaataaaagggttcccaaacgctggcctggtaaagaaatcagggcaaattataaccataaggcaataaaccatctcacaaggccttaccaagaacaggctcaccatagccgcaccagaatgggcaataaggctataaaccaaaaaaaaaaaaaaaaaaaagaaaaacaaagaagggggcgcgcgccggcaccaagaagaaatctccccaggaggggcgcgccacaagatcaccgcgaccacccacagattctctgtggtcacaaggaggggaccaccaataaggcgggacgcgagaatataaaaaccgcacacgaggaccgtgggcacgagagatataacaaaacaaaggggagaggaaaccgggcgacaacaacgcgcgtgagcaaacatgcgagaacacatctgagaagagaagagaaaccaaaaacaacaagcgaggcgcgaggcgaccgacacaaaagagggcgaaaccaacaacaacacccacccacaaacaaacaaaatacaaaaccgcccaagagcaggaaaaaaaaacaccacaaacctcctcaaaaagaggaaaaaaaagggggcaaaacacacaagaaaggcaaaatcaacaacagccgacgacaacaaaaaagaaccgacaacaacagcgacgaaacgacaccacacaacacaacaactagtactccaccacgggggaacccaagaagaaagacacaccccgaccgacaacacggaacagagccgctaaagacccaccaacaccgaacgaaccggcagccacacacccaacgacaaaacgaagcaaagaaagcaagaagaccagacaccacagcaaccacgacaacgagcgagaacgcacacaacagaaaacaagcaacagacaaggcaaaacaacgagagaaggcgagaagggaaaagcagaagcggagcggggagaggacgagaaggcagaaagaggaaaggggaggagagagagggagaaagacacagacaacaggagaggagacgggcgagtgaagaaagagacgagaggaaagagaggggagaggcgagggacacagggggtagcgtggaacgaaaatcaagaggggagggggaagagagcgggaaaaaacggaagaagaaacaaggcgaagaaaagagacgcagaagaaggagaacgaagagagagagaaaagaggagaga

SEQ ID NO: 718751 - DNA, 499 bp, Homo sapiens
taagggttggaggggggaatgcgggaaaatggtaacggggtatggagacatatcatataagttaagtgctgaggggtggaggtgggtaggaaagttttcccatagggagggtgtatgaagtgtgggcctccgcgatagcgcgggaacactgcgcggaaggaaaagagagggaggaagcaagaaaggtgaatggtgaggaaagagggatggagcatgaaaatgaagagacgcctgactcacctacgggcccacgggggagggacaggagtagaaaagactggactggagggagtgcacgggatgtttcgaaatacccacagaagacgacacgaaaagaacgcgaaacgaaaggtactggcactagcacgagccaaacaaggggaaaagttcacaacataaaaaacaacacagagggcccgccgggaaccaatattcacccctcccaatgccgggttcgcaggaatcataaagggtggcaaaccctgcggaggtaaagggg

SEQ ID NO: 718752 - DNA, 163 bp, Homo sapiens
acagtcagaagaccctaacagccacctaaaaacattgataagaatagttctgtaccttacatcagtttttcagatgagaggagagtcccctgtatggtatggttttaaacgaagtctccaccaaaatattggattggatgctattgaaacttctaaaactagg

SEQ ID NO: 718753 - DNA, 317 bp, Homo sapiens
gcggtagattctagaggaccccccggtaatgtagatactgtgcctggaaatgtagatactgtgcaggtcgaagtgcacatgatgcaaccatagcgccactgcagcctccactcctgggctcagcagtcatcctacctcgcctcccaagttactgggactatagtgcatgcaccatcacaccctagctaattttactttttagtagagacaaggtctcgctgtgttgcccaggctggtctcaaattcctgagcccgagtgatcctcccgcctctgcctcccgaggtgctgggattacaggcgtgtagccactatcaca

SEQ ID NO: 718754 - DNA, 557 bp, Homo sapiens
gcctgtaatcccagctctcagggaggctaagaggcgggaggatagcttgagcccaggagttcgagacctgcctgggcaatatagcgagaccccgttctccagaaaaaggaaaaaaaaaaaaaaaacaaaagacgaaaaaaaaaaaaaaaaaaaaaaaaaaaatgtgtgtgggcgcgcgccgccgcgggccccgcgcgagaaaagcttttaaaacccatcgcggtgtggggggcgggggcccccgaggagaggtaaggtgagaacgaggggcccaaagaggtggtgtccccagagagggaacaccggggccacagagacaaagagggggcgggatttcctccccacaaataataaaaagacccgcggggggcgaaaccgagaggggcgtgtttgtggaggacaaaactccacaaagaggaggagctgtctgcaggaggagggacaatatacaaggggggagagtatatatataacaagaggggggggagcccaacaagagggagagcccgcgaaagctatcaaaaatttaaacccccccgcagcacgggggtgggcca

SEQ ID NO: 718755 - DNA, 410 bp, Homo sapiens
  misc_feature (194)..(194): n is a, c, g, or t
  misc_feature (200)..(200): n is a, c, g, or t
  misc_feature (215)..(215): n is a, c, g, or t
  misc_feature (226)..(226): n is a, c, g, or t
  misc_feature (242)..(242): n is a, c, g, or t
gatccctgaatatgctgttcacgggagtataagccttaccggatgtcccggcagatcgcgcagaattcacgtttccgcgttatcaggatacactacgtctcgtcatgcttcgaatacgggattatcaccctctatgattgttctttccagaacattcttctcacaatctaagtacgacagcgtggtcctacaanccctgntaagcgttgccacanagcaggtttgngctataccccgttcgntcgccactactaggggaatcattatttattttctcttcctaaaggtactaagatgtttcagttccctatcgttcgcctcactacttttgtagtgataacaggtcttcaacctactgggttgtcccattcggaaatccttggatcaaaggttatttgcacctacccaag

SEQ ID NO: 718756 - DNA, 1475 bp, Homo sapiens
gatgtcttatctcagacttcgaccagaagggggacataatacagaggagccaggcagggccagaggaataggtgagattacccagcagagccccagtgagagagacctggtagtttcgaacactcagtatattgctgtgcttggagttatgacaaagtacatgaagaagactctcagggtatgggtgcacctcagcgtgagatcgcaaggtagaagttgatcgtgatagcgagaaggcgacatgtactggctgaattgactgacgcgttgctacagtgcaaaagacatgacaaggacgctctggcctagaagtaccatcgatgtgatgacaccatgaagcgattaccaagatcacacatttttcatcgtatccttccacacaagcaaagcagccaacataggactggcatgtttgatcaggcactgtatggggcatatgtcatggagagaaccacaggcaggtctcgtgagcaggtaccagctgtgaacaaggcgcttatctgaggaggagcggctccccagggcacgagcgtggaaccccttgtccctgggagaagacgccttcctgtacgcgtgcacctgaagcggtcggaacactttattaacctcttgaggtatgcgcgggctgcacgccgttagatgcacgctcgttcctcggacacgtgcccagagattagagggcttagccatgcccatggcggtagttctccttcgatattgcgcatacgcgtaactagattggtggggaatgggaaatccttcggaaggcacacaaatgcaacatatgtttgtgcgtgggaaaccttccaaagcccccaaatggttgagttcaggccccccaagttgtgcagagtaaactgtgggacacgaacgagcccccccgtgtgttaggccttcgtggatatgccccccgaagggatggcccggtattacaaagggccacacacatctttttcgcatggttcccacacacggggtgagcgaggggatcgccttttccaacgatccaggtcccagagacgatacgcgactaaagtggacaacgcaaagatgggtcccacagtcacgcaaagagagacaagtctgcggcacacgggcaatagctgtgttagaacgcccctaacgaagcgattggatgtggcccctacgtggaaccacttgcttttcacatcgtacccatccgctaccgagtatcaaaaacgcaacacttttaaagcgccttaactacgcaaataacagttataccggggaggatacccaatttaaaacacaatggagcaagttatcgtgaggacacggtcacctttctgtggccctccatgggttcctgtgtggaattttgggccccggaaaagggacaggcacttttgagcaatgtggacacacaatgaggaggtcagcgagaaattacaacacacaggagcccacgacggcaggaggaaaacgccacaatatgggcaaaaggcgcgaaaaag

SEQ ID NO: 718757 - DNA, 323 bp, Homo sapiens
  misc_feature (107)..(107): n is a, c, g, or t
  misc_feature (113)..(113): n is a, c, g, or t
  misc_feature (128)..(128): n is a, c, g, or t
  misc_feature (139)..(139): n is a, c, g, or t
  misc_feature (155)..(155): n is a, c, g, or t
aggagtagtgataagccaggaatacggtatactcaggctctatgattgatccggtgcgatgcaagattcacctacgcaatctaatttcaccagcgtggtcctacaanccctgntaagcgttgccacanagcaggtttgngctataccccgttcgntcgccactactaggggaatcattatttattttctcttcctaaaggtactaagatgtttcagttccctatcgttcgcctcactacttttgtagtgataacaggtcttcaacctactgggttgtcccattcggaaatccttggatcaaaggttatttgcacctacccaag

SEQ ID NO: 718758 - DNA, 314 bp, Homo sapiens
gtagcacaacctagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaactattgttcacacaataattgttcattattgttctcaacttggggctctccccaacctggggacccttcctta

SEQ ID NO: 718759 - DNA, 332 bp, Homo sapiens
gattggagggaaaaaaaaaaaacccctcccggatggtatttttcatcctggttttccccttggggctggtatggccaaattttaccggataggaaattttaaaatggccccctttttttttggttcagccaggtatggaaaaagccattaattatggggatggtaaaggagggctttaaaaaaaggtttttatcccaaggtggttttggaaatttaaaaggctccccttattttttggaaagggccgcatactcctttggggataattctactggtccgatgttttaaaatattcccaaaacttcctttaaaaaaatattttttttttagga

SEQ ID NO: 718760 - DNA, 172 bp, Homo sapiens
aatgatgggatccaaaggctctgatcgatcgccgagcgattggtccgcgaccggtatcagcgcgacccctcagacgcgtgtgagcattacagcctagaggtaccggtcgtggagggtatcccgtagagttatcctgcggactttcacgcgggctctgatgcgtctggtgaga

SEQ ID NO: 718761 - DNA, 426 bp, Homo sapiens
gcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttcacggctgttgcccttccatctcctcctttctttccctcttctcctatgcccgctttctccccctcactaatcttcgtctacttctccctccccctttctccccctccttctttctcacttactgcagttacttttgacccatgtgcaaggattgtacacgctgatgagaatcatgcactttttctcctctgt

SEQ ID NO: 718762 - DNA, 117 bp, Homo sapiens
caggatccccccggtaacactagatggctattgaggagtatcctgaggcatgggggtcaggagttgaggtcttggtgagtgttttattggggttagcgatggaggtacggattggtg

SEQ ID NO: 718763 - DNA, 187 bp, Homo sapiens
ccacgctacagccactgtaatcagtcattagattactgacttattcctacaatcctaaaatatcaagaggtggacaaggtttaagtcaaacccgaggaagtcttcaccctatcactctatctataacagaagggagctggcatagaagttaggataggcttactgcatcacgcagctcaaaggtaag

SEQ ID NO: 718764 - DNA, 152 bp, Homo sapiens
ggtttgccgccagaacacaggtgtcgtgaaaactacccctaaaaggcaaaatggggaagggaaagactcatatcaacattgtcggcattggacaaggagattcgggcaagttcaccactccttggcatcttatctattaattcgcgtgtgca

SEQ ID NO: 718765 - DNA, 563 bp, Homo sapiens
ccccttaattttgtgttcttcggggggggtcttttcggggcctttcggagggggttttttattcggcggcgccccgcgccaccctttttttggggggggtaccggggccccccggttggcctgttggtggggttctccctccccccgttttttaaatcccccgggccccccggggggcgtgctcccattagggtaggggggaaaaaaacccttttggctttggccatttgaaagttttcccccccccccctttaaggggaatatgccccccgggcccccttttttgggggggtggggggcccccccaaaaagggggccttggttttgggcccttttttttaaaacgcccttttcccatttccctggggccttggggggaagtttttttagccccccccccccccccccccccaaggttttttgggctttgggccccagaaaaaacccgggggttttttttttttggttttttttttttccccctttcggggcccaaaggcccccttttgtttgggggggggggggggccccccaaaattttttttttttaaaagggggggcca

SEQ ID NO: 718766 - DNA, 199 bp, Homo sapiens
cacgagagctctcttatcgcctctgtgagccacactgtgtgtgtgggtcagtcaagtgcctgataggaagggtgatatgagcccaatgagactcaagaatattatcacgtctggacacaaagggcgagaactcaattggaacaattccgcatgccggcaaggaaagaccttctggcttgcgaaatatagcttaccgggt

SEQ ID NO: 718767 - DNA, 331 bp, Homo sapiens
cctagcggtccatagtacttgctgagtactcttaaaactaggcgggtatggtataatacgcctcacactcattctcaacccccgtgaaaaaaaaaattaagcttacccctttcttggttactattccttattgaggcttaattttaacaagctccatctggcctaacgaaaaacaaggacttaaattcggcccatggcttactcttcactcagccaacattagcccttcgtagtaacagccatcctcatccaaaccccctgaagcttcacgggcgcagtcattctcattacttgcccacgggcttacatcctcaattactattctgcctag

SEQ ID NO: 718768 - DNA, 143 bp, Homo sapiens
cgcggtctgtatgcatgggccacgctccatggaatcaactgcattcaatcaagctggatggaatccactgcatcaatcgggatgcatttaccacgctgcgtgtaatatactgcattcaatcacgctgcatggaattcactgca

SEQ ID NO: 718769 - DNA, 899 bp, Homo sapiens
  misc_feature (899)..(899): n is a, c, g, or t
ctgctgttggccatggctgggcctgggcctgggctccgccgttcccgtgtgtgctggccgaggactgacctcggctgcatcatctgccagtgggctgctggactggcccgccacgctgccctgcgtgccacagcttctgccgccactgcctggatggccctgtggggctgcccgctgacgccctgccgctgtggcctgccccacttgcctgccatgtggctgcctgctgcatgcatgcctgcagctgctgtgaagaacactgctactgcatgtgacctgtgccgacaatgtacctgcctgctgccagcactgctgatgatacacggcgtggctcctgacccttgcccatctagccccgtgcccggagctccagtcccctctccagctgctggcctgcggatggcccctggctgccttgccctgaaccttgcagctggcgtagggacggcctggtgccctgcagtcgtccccttgtgctcccgcactgtgggcttgccctgacggaccgttgagcccctttccgccagtgttgtggctcgatacccccctattcctacaggcccgttctcacttttcaccgttcctattaacgtcacgtctaaacacgtccgaagtacccgactccttcgagaaggcaactattgcgaacagtccactaaacagtaatgaacgacagctaccacaaaaaaccaaagttccccagtcttcccgacaacgcttgctcaactatacgccctggcacaacaagctatcggcccatactacaccacacctacctatccgccaaagccggagtctacagagacctcatttcatacgtgaagccttcagaacaaccatggtcggtcgcaccggaacaacaacaagagatccaccgcaccatggcccacggaccctgn

SEQ ID NO: 718770 - DNA, 126 bp, Homo sapiens
gggagactgaggttgaaggatcccatgagcccaggagtttggaggcttttagcgatggagtgagccattatcacaccactgcactacagcatgggtgcagagcgagaccccgtgtccattgaaaaa

SEQ ID NO: 718771 - DNA, 930 bp, Homo sapiens
gtatcaccaaacccttgccggctcttattggcatgaaacactcctcccgctgcctgctcctgagtgaggaaaatggctggagaacgctggcctgagagcaccgaggtgaacagccccccctcccagccccccaccctgtgtccctgctaatcccgttgctaatgcgtcctactcatgtgtccacctcatgcccagcgtgcaccatggacggtggcataagatgtccaaggctgctgaaccgcagagcgtagatgaccgtcgcagaggattatcagcgttcgagcgtcgctatgcccactattgggaatccactgcggaacatgctcgacggacgtccacgcgctcgctagcgacacgacctccaccagtagcaaccgagacgaccatcccaagcagtaagcacagacaaaaaccacagaccagcgggtagggtccagaacgagacaaacaagaggcgatcagccctcggacaatcgatcggagcgaaagataggagtaaccaggaaggagcaagtcagcggatccgacagtacggatagcaagcccgaggccaccaataggagcaacagagagcagaccaaaccgagacccaggcgcaagtgaccagggggccacatcccgaagcagatggacgctccccccagctcaatctgacgcgatgggcaacgcgtgaaccgaaccgagacacgcacaggacaagtcacaaaatcacgacagggtgccccagagacgcgccaagccgcctgcgagaacggcgacaacagccaatcgcacgaggcaaacgcgccgaaagacagctagagcgaacgccggggctcaaaccacgcgagcgcagccgagaacggcacatgcaccggaacgaacggcagcacgagacacgagcagccacggggcagaccagaaggcggcagagaaagagaatacacaatc

SEQ ID NO: 718772 - DNA, 493 bp, Homo sapiens
gacaaggtgcatttattcaaccagcaggtatttttggaccgtaaatgacattggcttctcctgaaagataataagaggatgtagaagagacgtcattgaggaaaacgaatatttcccagcttgtattaacatgtgaacacaaactttaagtcagaatttgccaggggaatgaataatttcatgcttgactaatatcacagtttgtcttcgatctgtttttatgctacactgcaatattatttctatatttaatctattaaagaccctttaagtgcatttatatttcttctaaattgatgatagtaagttaaggtaacaggattgtgtagaatgtttgtgtctttcgggtctgtattgttatgaaatgccaaattgtatcttaagcgcacaatctttgaatatgcataagctatatctgaagagtcttcatttctgaaacaagatggttcagctgaccagtttaataaaaggttttaattgtgaaaaaaaaaaa

SEQ ID NO: 718773 - DNA, 192 bp, Homo sapiens
tccaacatctcattaccccttccaacatctcatcgctcctttcaacatctcatggctccttccaacatctcatcgccccttccaacatctcatcccaggttcaagcagttctcccaccttggcctcgcaagtagctgggatgagatgttggaaggagccttccaacatctcatcgcgacctcagatcagacg

SEQ ID NO: 718774 - DNA, 231 bp, Homo sapiens
tagactgagataactagactactagtgttagaagttcgcaagaaatttatacaaaagcatgccacaactatagcagaagcaaaagtcacactactcttcaccgagtgtaggtttgactttaccataaagatctttagtgttttcagttcacaaatgtgattcaagcactgataagggcctgcaggatttaggctgataagggagaggggatccgtgcacgttaacgattac

SEQ ID NO: 718775 - DNA, 912 bp, Homo sapiens
gatcctcttccccaagcttcttgcctggtcggtgtccgctcatcgcccaaggtcccagtccgtagagccccaacgcctgccggctaccttctcccagtagccttagtgctttaggtaggaacgcgcatgctagagaaagaagagtgactgcccatctatgtgcagaagagtactcgcgggtccgatgttctcccttttcctctaatgtgatgcgcgtgatgacggaagaagtggtgtggccaaacactgcagggttcggcatggtctcctggccttcttgagctcagccatggggcaatgtgcccccagaggctaacagtagcaccattgctgcactgccagctgaacgtatcacatggcatcccgcggtgccccattcgaagggtccaggcttgcactcaccacgtgtcaagcgccacgtggtcataccgcgtgcacttccacggcaccactttcctggcgcacacgcaggcccctcgcccatggcagcttggcctagatgcacttccccctcaacgtccttcgactagtgccctccgcacacagactttgccccggcctcatctgcgtggcacgcaccaccagtcacaacctatgcagcgccccacttcttccacctcaacaccaagctgtaggccagtcccagtggtccgcttgtgaacactgctggacgtcgacaggggccatacaacaggcaggctactgctgccagggggctcgtgaactagtgcatgctaccacatggacacccgggcaactagccttggctgggcagccatggcacaagtgaagaagaaggcagtgggcaaaatgggtttatctcaaggcagcagccagagcccaggagcagaggacccagttgttaaaaggcgctgggagagatggcagcttacgcccgagagcgagctcgaa

SEQ ID NO: 718776 - DNA, 375 bp, Homo sapiens
agtcactgaggcatccttcccaggggctagtgctcaggcggcttccccagctcgtggaaaccgtttatatgttgttttctgtgtgcccgatggtgtttattacacctacttaaaagatatctccaatcctttactaatatatagtttaacgcattgttgttaacgccattgtaattgcttaacattttaagagaaaacatcaacacttataacaggagcatgaggcaggtatagatactaggcttctaaaacatgacagaagttgagatgaaacttcttcatggagcagaaaccgtatttaaaagttgcgagaaaggactacatgagccccgcatactacccagacaggcactgctgttagactttgtacgtgcc

SEQ ID NO: 718777 - DNA, 640 bp, Homo sapiens
tgggaccccaacggcaattgccttattttagtatatattcttactgatcgggatgcatgagctgagcataaaatttgcattgatattacccaccgatctatgcaagaaaaacagtaagaaaaatgtgtcaatgtcaccaccaagggtttgcaccctgatcaaaacgagtgtgaaaagaataataccacatgcacttatggactgtcttggaggccttctggggattattggtgagatatgtcttatcagctgcctctcttcagaaatgaactgtgatggtggacacagctatgtgaggaattacttacagaaaccaacctttgcattaagtgagctttatcctgctctgataaatctctgggaagcaggaaaagataaaagtacatcactgtttgtccaagcgactgatataggtttaccaacaaatatgtcctaaaaaccaccaaggaaacctactccaaaaatgaacaaaaaaaaaaaaaagcgaaagactgcagttgtgctaaaaacaaaacaaaacaaacaatcaaacaaaaaagtcaaaaaagattactttcgagagagaagtttaagctttaccaatgctgctcctgaccaatggaaatatgtacaacttcagcattttaaggaaactggcttc

SEQ ID NO: 718778 - DNA, 449 bp, Homo sapiens
ccccgccgtaccagttgcggccggctgcaacagagcctggactcgaacccagaatcctagtggcacagcaatgcaatgccttagaccactgcaccactcaggaggcctcaggcagatatatatatttttttcaaatcccttatctacattatttattgcctgccacacacttgtaattctgaaaagtgaaagcatgtctgtaagaagggatgccctggtagtagttgtaggtttttatacagtaaccaagaccaatctgtgagttcatttgaccattggaaaaagagctactgtgtaaatactgcaatgtgagttggattgaattcgtcttaatttctaaggtgatgatggcacttttcttcccaacacaataccgcaataaatgtgagtccacatttattttgcgtcccatgggggattcgaatttacaccgcaactggtacggcggg

SEQ ID NO: 718779 - DNA, 859 bp, Homo sapiens
  misc_feature (2)..(2): n is a, c, g, or t
  misc_feature (191)..(191): n is a, c, g, or t
  misc_feature (205)..(205): n is a, c, g, or t
  misc_feature (209)..(209): n is a, c, g, or t
  misc_feature (214)..(214): n is a, c, g, or t
  misc_feature (265)..(265): n is a, c, g, or t
  misc_feature (282)..(282): n is a, c, g, or t
  misc_feature (302)..(302): n is a, c, g, or t
  misc_feature (311)..(311): n is a, c, g, or t
  misc_feature (328)..(328): n is a, c, g, or t
  misc_feature (339)..(340): n is a, c, g, or t
  misc_feature (345)..(345): n is a, c, g, or t
  misc_feature (358)..(358): n is a, c, g, or t
  misc_feature (360)..(360): n is a, c, g, or t
  misc_feature (433)..(433): n is a, c, g, or t
  misc_feature (453)..(453): n is a, c, g, or t
  misc_feature (482)..(482): n is a, c, g, or t
  misc_feature (492)..(492): n is a, c, g, or t
  misc_feature (509)..(509): n is a, c, g, or t
  misc_feature (526)..(527): n is a, c, g, or t
  misc_feature (535)..(536): n is a, c, g, or t
  misc_feature (550)..(550): n is a, c, g, or t
  misc_feature (565)..(565): n is a, c, g, or t
  misc_feature (568)..(568): n is a, c, g, or t
  misc_feature (576)..(576): n is a, c, g, or t
  misc_feature (593)..(593): n is a, c, g, or t
  misc_feature (605)..(605): n is a, c, g, or t
  misc_feature (607)..(607): n is a, c, g, or t
  misc_feature (648)..(648): n is a, c, g, or t
  misc_feature (672)..(672): n is a, c, g, or t
  misc_feature (699)..(699): n is a, c, g, or t
  misc_feature (725)..(725): n is a, c, g, or t
  misc_feature (749)..(749): n is a, c, g, or t
  misc_feature (759)..(759): n is a, c, g, or t
  misc_feature (771)..(771): n is a, c, g, or t
  misc_feature (773)..(773): n is a, c, g, or t
  misc_feature (778)..(778): n is a, c, g, or t
  misc_feature (780)..(780): n is a, c, g, or t
  misc_feature (782)..(790): n is a, c, g, or t
  misc_feature (797)..(797): n is a, c, g, or t
  misc_feature (799)..(799): n is a, c, g, or t
  misc_feature (825)..(825): n is a, c, g, or t
tntgggcaggctggtgggattgttcagtctccttttgtagcctgtgcaaacctttaagaattccagcttgatgcaaatattttacgtgtctcacatgggcacaaggcgaattgtctctcatctctgcccagggattaaaatgacgagccccttcccttgaggtactttgctcaagtgtaagttcctttggntatgtgtcgtaagnggtngtttnttgttgtgattttaaataccttttatgtttcaggtacctacaaatctttanttcaccatatttatgtntgtgtaatgggagaagattntgcacgtgntcagtcctccatgttgntggaattgganntctgngcctttatctgtnantgtggtttgaaaggttttgtctgcccaatttcaggcaagagtgaggtgagcaggcgcttgtgagtggtctctntttttttttttttttgagangaagtcttgatcttgtgccccaggctggngtacaatggngtgatctcacctcactncaacttccacctccggnnttcaagtnnttttcctgcctcancctcctaagtagctnggnttacaggnggctgccaccacgcctngctaacttttgnanttttcagtagagatggggtttcatcatgttgtccaggctgntctcgaactcctgaattcaggtgntccacccgcttcggcctcccaaagtgntgggattacaggcatgaaccatagtncctggccttgtgggttttctcttncttctgaaancccactaaattntnttttngntnnnnnnnnnctgagtncnggagattcgggctggggaaaaaaaanaggggggaaatgggggggggggggaaattgggga

SEQ ID NO: 718780 - DNA, 970 bp, Homo sapiens
ggttgactattctctacaaaccacaaagacatgtgaacacgatacctattatgccggcgcatgagctggagtcctaggcacagctctaagcctccttattcgagccgagctgggccgagccaggcaatctctctaggtaacgaccgacatctacaaggtgatcgtcacagcccatgcattgtaataatcttcttcatagtaatacgcatcataatcggaggctttggcaactgactagttcccctaataatcggtgcccccgaatatggcagttgccccgcataaacaaacataagcttctgacctcttagctccctctctcctactcctgctcgcatctgctatagtggaggccggagcaggaacaggttgaacagtctaccctcccttagcagggaactactcccacaccgtggagcctccgtagagctaactcatcttctccttagagctagcaggtgtctcgctcgtatcttaggggccatcagtttcatcagaagcaattatcaatataaaacccctgggataacccaagtacaaacgcccctctgcgtctgatccgtcctaatcacagagtcctattctcctatctctcccagtcctagctggtggatcactatatactacagaccgaaactcaaaccaacttcttcgacccgcggaggaggagaacccattctataccaaacaacctaatctgatattgcggcacctgaaggtatatcttatctagcaggcgtcggaatactcccatatgtactactactcggaaaaaagaccagggtactaggatgggcgagcagaaacaagggtcacagggaacggtcagggacccaaatcacgaggaacacggaagcaagcggatcactcggacacacacgctcccccggcaacaacagcgaccagaaaacacagcgacagcgcacacacacacacaggggcgagaaaaacacacgcagagatgacacaa

SEQ ID NO: 718781 - DNA, 148 bp, Homo sapiens
ggttgctgtgtcataacttcaagatgcaggaggctcaggtgatctgttgtgaggagagcacctctaggcagacctgcaggggaataacatactgggccgttctgacgctgttggccagcagtatacacacggacatgtgatgaaattc

SEQ ID NO: 718782 - DNA, 762 bp, Homo sapiens
  misc_feature (548)..(548): n is a, c, g, or t
tggcccccccgaccttgcccccccttttttggggcccccacccctggggttctaaacaccccccccggggaatggaagggaagggggtgcccccccggggaaggagaaccctttggggggagaagagacggtgtggcgctggtgtgagaaaaagaagcataggcccccgcgggcccaggcgcttgtgggcccccgaaaactggtcttcttgtagacacttcgacagttagactctgggccataaaggcgctgtcgacaaatgtcctgtagacctggagaccacaccttcgggtgtgagaaatctgtgtgtctccccccacaaatgttttctgggggcgctccactctagggggcgcgcattgagaaagggcgcacgcgcgcctccgtctgtgtgccacatggggggggtttgtgcacacagagagagaggccgagagccgccactctctctctttctcttagagcgacaccgtctgtgtatcacatcgtctgtgacaaacacaccgccgctatattgtgttggggaggtctccctctaccgtgatttnggaaacccccccgcccgggcacaagcaggtgtgggggtctttccctctccaagaggagggctgttgtgtaaaagaagtgtgctttgcgccccgcgacaatataggggctatctactctcggcgacgggggggcgccccccgagatcaacgggcccccgccctcttcctctcgcgcgccacaacaccctcttgagaccccatcctggccaaatgg

SEQ ID NO: 718783 - DNA, 365 bp, Homo sapiens
ggaaaacctgggacagcatactattcattctctgctacaagttccaggaggagaccactccatgactctgcagcgcttgatcccttgcaagcaaaaaaagtcagaaaggtgcctcctggtttgccttcatctgaatttggggatggtgcatatacagaagaaggcaaaccaggaggcaccatccccaaattcagatgatttcaaccgtgaatctcctagttatccatctcctaagccaccaaccaggatgttcgctagcactttctttatgcaagatgggacccacaattcttctgacctttggagttcatcaaatgggatgagccagcctggttttggtggaattttggggacctccactttcc

SEQ ID NO: 718784 - DNA, 172 bp, Homo sapiens
  misc_feature (32)..(32): n is a, c, g, or t
gcgcagctcgcatcgagctcggtccaggggcngccttttgtttcgatcagaccctcggcactgctccttaccaccgggcaaattttatgcatcccatgaagcccagatacacaaaattccaccccatgatcaagacactccgggctccacctacagaactgggtgctaaacg

SEQ ID NO: 718785 - DNA, 435 bp, Homo sapiens
gatgctgctgaggtgactctaaggatctgtgtcatcccccttcgtcaggaggagtgtgtgcctgtctgaactctgtcagaagtggactgtactgggacgttatgcttgagaactacagtaacttgttgtctcactggatttggcgtcaggctattgaaataagagtttaccttaccgaaaaaaacattcctgaaataagggcttcccaaaggaattcagatagaagaagtaaattccttgtggcggaactggattattttcagtgtacgcttgaaagaacaaagggataccaagggaggtatggtcatcagattatcctcaattatggtcaaaaggaactggtaataaagaagggaccccttcttagaaaagattcagagacctcctaagggagaattccttttgattgaatgacttgtgggacggcctttccac

SEQ ID NO: 718786 - DNA, 233 bp, Homo sapiens
cccccccccccccccctggtgcttttttggggggggggccatttttttcctgggttccctttgcccccccccccccccctggtaaagtaagcctcccaccgttttgaccccccccggaggtcttcccccccccccccccgaatggaaaatgtggggccttttattttaaatgggggccccggggggtttttttaacccggggggattttttggggaaaaaaaatttcttttta

SEQ ID NO: 718787 - DNA, 413 bp, Homo sapiens
gtgggtgacttgggcagtacctaacatctctgggcctccctgtcttcttctggagagatataatagcttctacctagaggatccatatttcccgcccaaagtggacttgcaggtctcgcagtggattgtcggcgaacagcatgtgaggcctggtcaagcagcaacccgctccctcggcttggcccgcagcccacgttcaccactgagttgtagaggtgggcacgcccctaactgccctggaaggacttggagatgaggtcgtcgtggttggccaggtgagcgccgcagtgggcacagctataatctccgggggacaatccatcccaggtaaggcctgaaaacgtccttgtggatgatattaaacccggaataggctttgcccggggtaaccgaggctcgaaattccgaaatca

SEQ ID NO: 718788 - DNA, 118 bp, Homo sapiens
ttggtttagcttcctagcttagtctttgattgccaggtagagttgatagtacaaaaaaaaaaatattttggtatggtcttctataactagtatatcagtgaggaacatgaaagtgtca

SEQ ID NO: 718789 - DNA, 155 bp, Homo sapiens
tgaggaggatcttatacatcatcactacacagcttcctaagagtgatggcctagacctctcctacttgtgctgagctcagagcaattgagctctttgcaaatgcaagtcatatttgcacaaccaagaaagaatgttttgtggcaagactacagac

SEQ ID NO: 718790 - DNA, 273 bp, Homo sapiens
agacaggtggccagctcgtctttaacaattccattgtgccgggagcagtggtgtatgcctgtaatcccaaccgctcaggaggcagaggcaggatcgcttgagcctgggagttcaaatccagccggggcaatatagcgagaccttgtctcttgaaaaaacagaaaagagaattccagtgccttcttcgacctctttttttcccccttcagtgggtttttcccaagtgatttaaggatggaatcaaagctaagcagctcttggctggttccgctg

SEQ ID NO: 718791 - DNA, 449 bp, Homo sapiens
tctaagtgcacaaagaactgttcctcatagtataagcagatagtttgcatacgaaatataatcggccctgtcggcaatttcacagctatcttataaatcagcgttagggtaaccgccatatccatgagcagtaggttcgctgccactgccgattgaccaacgtatgatctagtatcatagttgccagagcgggctcaactgtacgtatctaacagtacaatgacatggcttcttagattgggcacacctgactgaagtaattccagataaatctgaaagcatatgccatagtcgtgtagcactaggtcttatgcgctcagtaatataagatcttcattctactacaggcatcaggtaaattgcgcctgaatacactttagacataattaggtacaatagtgtaaccgatttgtaaatagaggtatggtagcctctaagatagtaaaaat

SEQ ID NO: 718792 - DNA, 256 bp, Homo sapiens
  misc_feature (4)..(4): n is a, c, g, or t
gggnggggggaattttgggaaaaaaaaaaaaaattgttttttgggagggggggtggaggaaaaagttccaaaagcaacaatttcctttttgcaaccttgccaaaattttaaaagggggcccggttttttttaaaaaggaaaaaaaaaacccccagcccggttagccctttgccttttttaaagtttttaaaagggggggggtttttggggggtttccccaccttaaccaaaaaaaaaaaaaaaattttggtttgga

SEQ ID NO: 718793 - DNA, 209 bp, Homo sapiens
  misc_feature (142)..(142): n is a, c, g, or t
tagccggccaggatgccatctctctgctctttctgttttttcttgaggcaaacactgacagtctctctgagctcctgcatcctgcctcataaatggtaaataatgcacgtgaaagcactgcataaactttagatccccatantaagactagctcttattattattttccaagacactgcttccccaactctgtcactacagtttatatg

SEQ ID NO: 718794 - DNA, 621 bp, Homo sapiens
  misc_feature (507)..(507): n is a, c, g, or t
  misc_feature (552)..(552): n is a, c, g, or t
  misc_feature (570)..(570): n is a, c, g, or t
  misc_feature (582)..(582): n is a, c, g, or t
  misc_feature (621)..(621): n is a, c, g, or t
gtggcctctggtatacctgctggctggatgggcttggactgtggtactgagagcagcaagaaatatgccgaggctgtgggtcgagctaagcagattgtttggaatggtcctgttggggtatttgaatgggaagcctttgccaggggaaccaagtcactcatggatgaggtggtgaaagccacttctaggggttgcatcactatcataggtggtggagacactgccacttgctgtgccaaatggaacacagaggataaagtcagccatgtgagcactgggggcggtgcaagtctagagctcctggaaggtaaagtccttcctggggtggatgctctcagcaatgtttagtattttctttcctgcctttggttcctgtgctcctaagtcaacctagtgttttccacatctccatttggtgttaacgccagattcagctagtggctgagatgtggcaccaggaacccttaaacagttgcacagcatctcagctcgtctttactgcatcangatttgtctgtgttcttcaagatccatttaaatccctagtgactnaaccattgtgcattgtanaggcgctattanatctgcctgagaaaggaagtgactttaaagctgactctn

SEQ ID NO: 718795 - DNA, 1686 bp, Homo sapiens
  misc_feature (252)..(252): n is a, c, g, or t
gtgactcatgacatgcctccgccgggtgggctatgggcccatcgactacaatacggaacttgctgcgttgaggactgtcgggctacctagtggtgctggccatatgtgattggaacctctgtattctactgggtcactgtgaggcataaatgatattggaaccgtgtatgcgctagtgcggccgtacaatatcgatggattcgttcgaggctcgcatcagcgactgtttgccacttgttaccgatgggtcangacaccgaccggaggaccttgctgcatgcgttcgtgaagagaccgtgggtagtgagtgaagcgcccaagtccactccatgtagacggaatcgatgacactcggtacttgagtagatgcgtcgaggcggaagatcttgatgtttaccaaacgaaattgtcgcgcttaggggttgccccctcaccattagattcggggggcagacttgttagcgggagacatagcggtccaccccaacaaggatgggaagggtcgttcgttccaatgacccaaaggtgcaacgggagtcttacgatagttagggtaaccacggttaggggcccttgatgcccccttcgctggggttcacaccttgggaatttcgcacttggacacctccttttcacacgcaaagttgagaggaaacggagtaaaattaataggatcgcattacttgggtcaaagaataccctttgagcaataaagaacaaaaagacacaccattttacctacctaggagaagtatatggacatacagggaacagacctcccaagttttgggcaaggaagccgcattaaaacattttggtgaacaattacttggtagtagcccactatggaccatttggttcaattcagggggcgcagaaagagcaacgagaacagagttggttccaatttgggtgagcgcccaataggcagtgtttggagcccagaggcaagcacaggtatactttgaagacagcacggaacgctttaagcaaggagattagcgatcagcagaaaccaaaacgattgcgtttagttccccaccagtagcattgcacgcgcagttggacttcgaagcacattggtttgaacgaaagctggcaacagcacttggggatagcccccccaaggcgagtatcacatcagaaacagggtcacttcaacggtcaacgtcaatcacggagcgcgagcgggcatcgttcccctagagtgcacatagttaccagagaccgaagcatgagcacacgcgcgatagtctggtggagcaccaaccacatccaactagaccgtatacaatccttcaaggcagtcgagcggcagcggaagacagatgtgttgcgaattccacagccacttagttgtggcgacctattgccttgcacgaggtgcaccacattgagacgcatggcgcgaactttccgggcagccgttagcaaattcggtgtacgtcagtgtacatcacacacaaatacacagccttgcaacgtaggaataaggagaaccgcagtcggacatatttatccaacgtaggtatttgcgacagcagcccacattgcatagtcccactgaacagatataacagatagttattcacgcacgctggcttgtcgtcacaacaattccacccagcatataaagacgcggcaccacccttgtctatgcgtacactgagatcgcgcaatacccct

SEQ ID NO: 718796 - DNA, 1336 bp, Homo sapiens
ccagatccttcagcgtctgcatctcgtgcgtcgccccagcgtacctgtcgccctggctctcctgcctgctctccctggggtgttctggggcactctgcgtcccacatgtctgtgtccgtgcttcacgcttccccatgaccttgagtagctcgctactgtgcacatgtgttctcaggcaggcacttgtgacttgaccttccactgtgactttcgactcgagctgcggcctgactgcacgcacaactccttctggacatggcttattgaaacgcgctctcgcgccacaagactgcagcgcacgagcagtccgtgcactcctgctttgaccaattccctgcaagctacactgcttcaagcagcccagtgacaactcctcttgccaagccattctctaacgaacttcctgctctctcgcgcacgcggaattcgttccttgcgactcgaacccttgacacattcaccgaaccttcagcatgggacacacacttcccgacacacacacttcaactctggctgcgccctccttggaacttgcacaaacccattctttcgcgccctttcaactgcaactgcctataactgaccaccttgacacaccacttggcccctatgcaccagagcggaacgcccatggggcaatccactcgacttgcgaacaaccaccacgttaaccttggactctaatgcaaacgacctttcacctactggcccatctccaaaacgcggaacccaaccccgtttgcaccaccggcacacgaccccttggccgcgcaaaggccccccagcgttccaacagacctcccacaagtgctatctcaccttcgcaaacgcgtgaaactgccaacaaccttacattgcggtccctttcaaacacgcgccccccattgcggcgcacacgccaacatttgaaaaccacggactgggctgcctgggagctcgtggcgagcgaacccccaaacccgcgtttctagccaaagggggggccgacttacaccctcctttgtacaccccccaaacgcgaccctgtctggcacacgctgtgcaatactaagggaccgacccatggtggggctcttattccccccttctcccccgtttatctccaccgtcagtgccccccctcgacacccgcccacaggccaaccaggcaaagcccccccccccggtggagaccgcgtgggccccccactgggggcaccacacccctctccgggccacccttgcccacccgaccggccccccctctccacaaaaaccgcccataaccagccgcaccatcccccaccaccggcccgaacattggggcccctctccccagctggcggccccacctgtc

SEQ ID NO: 718797 - DNA, 957 bp, Homo sapiens
  misc_feature (441)..(442): n is a, c, g, or t
  misc_feature (476)..(476): n is a, c, g, or t
  misc_feature (480)..(480): n is a, c, g, or t
  misc_feature (485)..(485): n is a, c, g, or t
  misc_feature (488)..(488): n is a, c, g, or t
  misc_feature (491)..(491): n is a, c, g, or t
  misc_feature (506)..(506): n is a, c, g, or t
  misc_feature (510)..(510): n is a, c, g, or t
  misc_feature (515)..(515): n is a, c, g, or t
  misc_feature (518)..(519): n is a, c, g, or t
  misc_feature (543)..(543): n is a, c, g, or t
  misc_feature (572)..(572): n is a, c, g, or t
  misc_feature (640)..(640): n is a, c, g, or t
aagagttagatagtaatggtggtgaactttccaaaatcagacatgtcctttattgacactctcttaaattgtcactagaagaatggagcacaagagccaactagcgacagctatggacttattgtgcggttgtgatgcatagtggcattacaattagtagtgggcattacactgcttctgtggccagtcactgaccttaacagatttacgaactagataagaggaaatctgtggttgaccaagatgtgtgaaatagggtaagccagaagccattgagtgcggaggaagcaaggggtgtggttgagaattataatgatgacagaagtgtcgattagagttggtggaaatacacagccaagtaaagttttgaacaaaaaaaatgtagaagctatggacttcttggaggacaaaagagcaaagcagattatgagctatagaacnnaagcctctaatcctgataaggttgctagtacagngttngctgnaanaantagaaattctgagantagngatantanngggacccatgaatctgatagaaanaaggaatccagtgaccaaacaggcattantattagtggatttgagaacaaatttcatacgtagtgcaaagcttaaaggagtatgaggggaagtggtngctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacatggtaaagttgattacatcaaagaatctttagcttatctttgtgaagctactggatattattggtctctctaggtttttacataaatagtgaaatttgaattactgaaaacatgttaatttttagaatcattgttctcagtagagactagtgag

SEQ ID NO: 718798 - DNA, 623 bp, Homo sapiens
aatcgtttaattcataagtttgctgcaaagtatcgagttccctttgcattctacccatagatttacgtaacttatcgcccagagtcctaaccagcggttctacctcttcaatcaaatctaattttgatctttcaacatcatattcgggaactaaacggaaaacccttttggtttgcaacattgtcgatgcaaggttcgtgcttggctcatttgcacattttaaagactccacagaatccttcaatactgaaactgttccctccaacgcaaggacgctctgttccaaagcatctgtcatggttattttgcctatccttcaattcgtacacagatatatgcgtctgtgatctgtttattattcattttcattgttgctaactactacgccctgtgaaaacaaactttataatcgccaataataaatacataatgaaagtaaatcgcaatccggaccccacggatagtcaccagtctcaccaactggaaattagaaggaaggaagacaactgtaaattcttggcatggtagaactggaaaaaagaagacggccccctccgcaactgcaacattctccctatgttagggatcaatcaaattcgcagggacccccaaagacgccagaa

SEQ ID NO: 718799 - DNA, 150 bp, Homo sapiens
  misc_feature (26)..(26): n is a, c, g, or t
  misc_feature (117)..(117): n is a, c, g, or t
acagatagaatcgagctggtacccgntggtgtgtcatgcaggttgaagatattttttatgtttttcaacttactgtaaataaaaatatatcaatgcttagtgtcaagaaggaaacantgtataccagtggggggagggggggggggggtg

SEQ ID NO: 718800 - DNA, 206 bp, Homo sapiens
agtgttcttcatgaggaaaacccgatagtgttgtatgagtgcattcagatcatccttgacttctttatatctgagtctcccatcaaaggacgtgcacagcctttatgatcccaagtttttacgactgaaatcctagtgattataggtaggttttacaagtgagtgtttgactgacctgtcgcggcaccgccccggtgtggatttcc

SEQ ID NO: 718801 - DNA, 440 bp, Homo sapiens
  misc_feature (78)..(78): n is a, c, g, or t
gtcagaacacacacagcattgattgattaagttctctgccttgtatgagcgtggtttgtggcactccaaaacaattanagtagtaacatcaaggattacagatcaccataacagatacaatgacaatgaaaacgtttgaaatattgctagaattaccaaaatgtgctgttggaaaagaggcatggaaagacctgcagagttgccaaaaccttcagcctataataaacacaatgtctaaaaaacccaagtaagagaagcactgtaagctgaagtgtgcctctatctttgggcacatgtgtgagaaattcttagaagtaggaagtgttagatcaaagaatattgatgttttaaatctcagtccacaatcaaatatgtacgctctccaaagagaccacaccaattattcctccagcctgggccatagagcgagactctgtctc

SEQ ID NO: 718802 - DNA, 101 bp, Homo sapiens
  misc_feature (51)..(51): n is a, c, g, or t
gaggatccttaggtggtctggggtgagagaggagcactgtggagaggcagnatagtgtgggagggtctgggttcaggttttcatggcagcatttgcccttt

SEQ ID NO: 718803 - DNA, 180 bp, Homo sapiens
atcttcccaccataacctggatgctccttaagccatattatccaaatcctttctctttggtgcatcctctcctgcaagtctcgtcccatctttaagattaataactggaactggcctttctgtatcaggcattccttgcagttgagtataggctcagtgctggctttcatccctgtggca

SEQ ID NO: 718804 - DNA, 201 bp, Homo sapiens
  misc_feature (64)..(64): n is a, c, g, or t
gcatagttggtgttgacgaccgcagcgccaacttgagggtcttttagggatgctgctgtttgtnagccatcaactggggtgatcttcaaatgctttggatttgaaataatgtcctttggtgtggcttgagtcgtatctttgagcttgataagaccagcatcggccaacaaatggagaccacgggtttcgtttgttggatcg

SEQ ID NO: 718805 - DNA, 360 bp, Homo sapiens
tgagatggagtctcgctctgttgcccaggctggagtgcagtggtgcgatctcagctcactgcatcctctgcctcccgggttcaagcaattctctgcctcagcctcccaagtagttgggattacaggcacctgccaccatgcctggctaattttttgtatttttagtagagacaggggtttcactatgttggctaggctggtcttgaactcctgacctcgtgatccacccgccttggcctcccaaagtgctgggattacaggcatgagccaccgcacctgggccttccctgcttcctctctagaatccaattaggggatgtttgttaactaattcatattgattaaaacagttgaacaaac

SEQ ID NO: 718806 - DNA, 209 bp, Homo sapiens
cggtacctgttctccccgttggaatatcacgatccctgtttttttttttggtaatggtgtctcattggtgttccccagggcgggattgcagtgggcttaattcacagctctcattgcagcctttgacctccgtggcttcatggcaatctccccttttccttcagccttctccatgtacctgggagactacaatcgcgctgtgccaccac

SEQ ID NO: 718807 - DNA, 822 bp, Homo sapiens
attccttctatggctgcaagtatgcatcagtgcttcccacttacctgatttggtctgtcggttggtcccatatggaaaccctgcgtgtctgttggcataatagtttacaaatggtctgctgcagtcctatccaacatttattgaaccaaacaaaaataatttacttctgccctgaagtaatatagcagattgaagttgttcattctgctggctttgattctctccagtgtggcactcattctgtcagcctctttcatagtgtgcataatcgattcttatcattctaacatggtgactctctgcccttgggcccatttattatcgcacagatggggagaacctatctgctgtggatcctctgtggaccacagcgttcctgcgccctttctgccctcctgatccagtcccacttctgatagtactcagttactgtatccagccactggctatttatactcctcccttttgccttaagcactgtgtctgagccacacttgcttgtttctttttcttggactactttaaattttggactccttctgggtttgcgatgaccagggaatgtgcaaacgctgtccatgtacagacaaacacggtttcaagtgatgaggaggacaaaacacttgccttttcaaaactttttacccgattctcttacgattttcacagaactctgtgaatggtctgggtatcttaatcaaacagggaaggtaacgattggtctaccactttcctcatttggggtcctgaaaggggggaccccgttcttactagaaccacttctctttatgccacgtttaaatccccccctggaatttggca

SEQ ID NO: 718808 - DNA, 325 bp, Homo sapiens
gccagtcatctttgcctgttacgctcagcgcgctcacagagtgcaacttgcgggggtcatccaccaccaagaactttcgcacgcagggcctccatgacttcacgtgcccttgtgcgtacagcacatgcggtttcttgtacagcatccttgggcaggtaaaacgaagtgcggcgcctgacacttgtgccccgtcctgggccccgccgggcatcctgcaaggagggtggcttcttgctggagggcacagagacagggcgcaccagcttcagctgaaccttgatgaagcctgtgtaagaaccgtccttgttcaagctcatgaagagat

SEQ ID NO: 718809 - DNA, 623 bp, Homo sapiens
ggatcaggttggggggcagccccccagtccctttctgtccccgctcagttttccaaaagacactgacatgtaattcttctctatggtaagggttcccacttagtgtgcttccgatgaattaaattcctaagtcatttccgaaaaaacaaacaaaagacgcacaaacaaaaccaatcgtctgtgggcgcggcggcctgtggcacataaaatatgtttccccaaaacccccattgtggtgtgggcggcccgccgcccccgattactcgtccacttcgcctttgtgcccagtgacccttgtctaccgcacaagccgcgcagctcggtgtgaccacaaacatcaatcgagggtatggctacttctcccacaccagagcaaaaagaagaggccccacgcggcgctccgggagtacaccaacgacctcttgctactgtgtcatcatcagagacagaccgacctcgtatattcctacacagacatatctagccacttcatcatcctgcgacaagcctactcctcctacgtcccacgtctcggtgcaacatctccactcatcacgcggctggagtagcgcataatcctccccactcacgcctcgtccgctacccccagatacaacaattcc

SEQ ID NO: 718810 - DNA, 478 bp, Homo sapiens
aagaattcggcacgaggaaggaattgagaagatcccgttggtaccgcagtttccaaggatttgtctagtgcgttttttggatgtggaatgaacaagcgtccaatataggagacgggattcctcctgcccttaaaccctgttgcggggtcaaccgacgtgggtgggattttgctggcggcgaggggagaaggtgacatgtgtgaacccatgatcggaagtctggactgaattcttagatgcgaggtggaaaatgagcgtgggaggggaatcttgagggatgaagtatgaccttcccatctcataccaggcaggagggttatgatgaaggtatggttttgctggtatttcactgtggctaagggcagtcccacaggtacagtcaaagatagagtccttaagtcatgctgtacaatgcttcttgtagtccgctgttacctccttatatgaatatgatgtaaataattctcctcattcctta

SEQ ID NO: 718811 - DNA, 143 bp, Homo sapiens
aatcagctatacacccttactacacaatcaaagacgcactcggcttaagttctcttcctatctctcgcttaatgacattaaacactattactcaccgagacctcctagagcgacccagacgaattataccctagaccaacccc

SEQ ID NO: 718812 - DNA, 508 bp, Homo sapiens
  misc_feature (89)..(89): n is a, c, g, or t
tgtggggctgtgcactggcacgatcaaaatggtggccccttcccgatttgagcgcttggcccaggcaccccagctcctcaaaatttaanaggaggtgggcagcaagggttagttttccggcaggaacttcaaaaaccccttggccaagtaaactgtgggcaggcaagccctttggtcccctgttgggtacccaaacccccccccttgggttaggtcagggaggttgagggccccgaccaacccttgcaggggtccctgttagttagggccccccccccgtggggtttggcccgcttccttagaattttttcaaaagcccagctccctggggccctgttggcagctctagctttgccgtgggggaattgggcccagtccttgttttttttccccccctttcccccaagggtttaaagtcatgtgagcctcgggttatttccgggggggccccagggtagatccccgggggttttggggtcaaaataaaaagcccccgtggcccctggga

SEQ ID NO: 718813 - DNA, 870 bp, Homo sapiens
cgtgtggccgggtgcgtgctggtatagccgtgggagcgtgaggggtgtcctgttgggccgccgctcggtgttaggcgccgcctgtgcgggcggtgggggttggtcgggacggtgcctcctgttgggggcttctgtgttgttgcgcggcgtgtgtccttggggggccgaatgtgttgtcagttggcgcggtgtggggttgggccgatcggtttgctcctggtggcgcgatgtgggactggtggtggtggtgtgtgaggtgactcggggggtggagccgcgggtggtggtcggtcgtggggtgcattgggccaaggatgttggacgggggcgcgcgatggtgcagggaggtgcgtgttgtgaacccacgggggggggtagtgttctgactgggtgagccagttggtttctctgcaggatggtggttgtattgaaggcagcgtcgagtttgggggccaccacggtggagatacaccccgcggcgggttgtctcgctgagtgacggcgcgcgactggatgagtgtggtcggccgtgggaccgcagagatgcggcctggtggggtagagcgactaggaagtcccgcctcctggggggggggtccccactccaggctgcggcgggaatgagtttggaagaggccgggtgcctagaagggacgagcagtctgttgttgaagtggttgtaatgttgggacgggcaggcagattatattactggtttgctatgggaccactagcacttctcaaagattacctcttttttgcagtggcaatagccccctgtgggacctcccttacagtttttagtcgtgaaatatgtgacccccgagcttggagcaaaaccagttttttcatttagaccccaacattgac

SEQ ID NO: 718814 - DNA, 207 bp, Homo sapiens
aggtgaggcaggagaatacttgaatccgggaggcggaggttgcagtaagctgagatcatgccattacactccagtccggcaagaggagtgacactccatctcacaaaataacagaatcaagctttcattgccagcctgggcccaggacacagcggtgaatcattctggcttccagatctctgtgcaggggagcagcagggaaagaca

SEQ ID NO: 718815 - DNA, 1549 bp, Homo sapiens
  misc_feature (361)..(361): n is a, c, g, or t
  misc_feature (710)..(710): n is a, c, g, or t
tgcgtctgtttagtcactccctcttgtaggtacttgtgttgtgtcaccacctccgcgtctttcctctatctagtgttgttcctgtcagtcgacatttgttcctctttcttcgtcatcaacacaccacaccaacctgtggttgttgaagtcacacaagtccccccgctgtggccacaaacaggggtttatttctccactcttggggcccacacctcacgtttttggggttgattttctctgcttggcgtagatgggaagcctcttctcatcttggtgcccgcatcaccaccggtggtgccacacgtgcccgtcaatttttgatccgttgtggccctactcccctccaatggaatgatacatnccttttgtggttgtagtgttggctcccacccaccctttccccccgggggggtgataatacttctgttggtggtctcctctttggtaagtttgggtccaccacaccctgggggtgatcatctccttcttcccactgtagaaccatatgtcttagttgtgcccccctgtggcgccgttcttttatacgtctgggtccggcgtcgtttgccccaacaaaagcgcctttctttttgtgggggcaaccataaggtggtttctaattgccccccgttgggagctcgttgttgtcacccgtggggtataagacctcttccaaccttggcggcccattttggccccccttattcccncgggtgtgtgctccgccccccaacagatgtcgcgctacaaaacagaattgttgtctcacgattggtggtttgtggtaccaccacttggaaccactctcgccccgcgttttttttttagagatatatcaccctgtggtcctccctcaaaatttatttggtagtgtcaccacattctcatcaggatatagagtttgtgtttgtataacacacaggagcgctctctcggggaggggccccccacactaatctaatagagggcgaaaatctctctgtgggcgtttcacacaccctgtgagacccacccacagagtgggggtctctctctctctctgtgatactttttctactcacggccgatacacactccactctcctctctcacacacctcttttggacgacctctctgcggcgtctctgcgcacttttggcgccctctcacacctgagaccacactctttgtgtcacaagtgtgcactctgttctctcgcgtgattgagacacacccgagatttggcgtaacacagcacaacagggtgtggttggagcctccactggcgccacacactggcgcctcccacacaggaggtataagaaccccctcggagccacccacagccccaccgcacaagaggcacaccaagaggggaaagaagaagagagccctcacactgctggggaagtccctgccaccacactcacgtcccccacccaccacctgaattctcccctccctcaccacgttgccacatgtagagccccttgaaagaaggggaaggggcctaagggagagccgcaccttgtcatgtaccatccaattaagtaccctgtggtcaaccca

SEQ ID NO: 718816 - DNA, 844 bp, Homo sapiens
  misc_feature (5)..(5): n is a, c, g, or t
  misc_feature (68)..(68): n is a, c, g, or t
  misc_feature (90)..(90): n is a, c, g, or t
  misc_feature (104)..(104): n is a, c, g, or t
  misc_feature (115)..(115): n is a, c, g, or t
  misc_feature (118)..(118): n is a, c, g, or t
  misc_feature (128)..(128): n is a, c, g, or t
  misc_feature (130)..(130): n is a, c, g, or t
  misc_feature (145)..(145): n is a, c, g, or t
  misc_feature (158)..(158): n is a, c, g, or t
  misc_feature (167)..(167): n is a, c, g, or t
  misc_feature (182)..(182): n is a, c, g, or t
  misc_feature (237)..(237): n is a, c, g, or t
  misc_feature (250)..(250): n is a, c, g, or t
  misc_feature (253)..(253): n is a, c, g, or t
  misc_feature (260)..(261): n is a, c, g, or t
  misc_feature (266)..(266): n is a, c, g, or t
  misc_feature (299)..(299): n is a, c, g, or t
  misc_feature (305)..(305): n is a, c, g, or t
  misc_feature (310)..(310): n is a, c, g, or t
  misc_feature (338)..(338): n is a, c, g, or t
  misc_feature (341)..(341): n is a, c, g, or t
  misc_feature (420)..(420): n is a, c, g, or t
  misc_feature (451)..(452): n is a, c, g, or t
  misc_feature (528)..(528): n is a, c, g, or t
  misc_feature (532)..(532): n is a, c, g, or t
  misc_feature (560)..(560): n is a, c, g, or t
  misc_feature (578)..(578): n is a, c, g, or t
  misc_feature (611)..(611): n is a, c, g, or t
  misc_feature (628)..(628): n is a, c, g, or t
  misc_feature (646)..(647): n is a, c, g, or t
  misc_feature (672)..(672): n is a, c, g, or t
  misc_feature (693)..(693): n is a, c, g, or t
  misc_feature (724)..(724): n is a, c, g, or t
  misc_feature (772)..(772): n is a, c, g, or t
  misc_feature (838)..(838): n is a, c, g, or t
ttggnagggctattttctggatactgtaaaaaaaaaaaagaaagaacacacacacacacacacacacnctcatagcagagctgctctgcncggctctaaggccnctttggggganggncagtgccagnangcactgaccggtggnatgggtgggcccngcccctccncaggcagccagctcngccatggccctgtccaaggggtccacagaccagtaatcatcatcccagccaaggngccagccctcganggngggtggnncaganccttggttcaccacggtgatgggcgtccgccgntcccgnttggntgggtccgtctcgatgtacctgcttagnagnagtcaaggcttctgtcttttcttgcttcttgcagaatcctcttccaacccagacaaagacctggtcccaggtgtccagnagcatgaggtcatccgtggcgcaggtcttcnngcatgagctcaccaggaacctcttcgtgtcgagcgaaacgctccaatcttgttgggggcaggcaaagaggcgaggngggntggggcatccatcttcttgttccttcanccgtgggggatgtgcggnaggcagccttcccgcccagggcctcccagaagncatctggctcgctgccntctgccacctgcacaggnngggcccgcagcaccctgagcagctnctgggcccccgtcttctctgnctttctggctcctgtacccacccacaggtangcggctgagggggttttcagaacaaaggcatcgttggagttcagtgcnccagccttaggcaatacctcaacagcccgggtgggctccagcgctgttggcgcggacctggaagangcgggt

SEQ ID NO: 718817 - DNA, 1357 bp, Homo sapiens
gtcaggagagatagcggttacggtagagcggtgtttgtttgtgtgtcgctgatctgccgtgtgctgatggcggtgctggtggtggttggtctccgtagcgaggtcatggttcagtcggctcgttggcgccacccctccttttggtcgtctgcctagagggcacgtgcctcgcttcgcggcattatgtctggctgcaggtggtggtgttttctacccgattgtgtgtccttcgtctccgtcgttcctgttcggttgtttgtgcggttctcccacaggcttgtcgtcccccctgtagggtttgtttctcgtgagtcggggtgggctgatgtggggcgacaattgctctgcggtggggggttgtcgggggggcgcaggcgcatgttgctcgcgttctcctgttattttccgcggcggtgttttcctccccacactgtggttgtctgtgtgccgccgcccctgtttgggtcttctgtgggaggcgccgcctttttttacagacgggtgtccatcggatggtgtttggttctcggccaccacgggtgtgttggggttagacgagaggtgtgatgacctgagaggccacaggggggggcacagcatttcttctggcgatgttttcgtaagtctcgttggctcgtgtttttgtcttgctgttgttggaggccggacgcctgttgtcccccgcgtgtttgtattatttctctccccgaggggtgtgtgccgcatgcacctgcctgcccaacacttttttatgtgtgccccccccccccccctcggttctccgggtgtcgccacacccccgctggcgttggtttactggtggttcaccgagttctcggggacaccaccttgtgagaatcggttctgcccccctctgtgtggcacttttgcgcgcccctcccgctcctctgggggccccaaagcccacagatttttgtggttgccccgctgttttctctcttttgtttctcatccccctgcgcccccaagctttttttggtggggttaatatccccctgggcgcacttgttttttgtggagagtgtgtagaaattctccggaattttttcacaataaggtccgagagtgttcccagagagtcagccacccctctttataaggttgtatattaaacccttagagcgtgtggttatccacgcgcccccccagcgttaaagagaggcgtccccccagaaacccctgttccacgtgccccccgtgtttccccaccggttttaaaatgtatccaggggcccctctaaagaaacctttggttccccccacagagaaaatatattttcacacactcgcaaacaatcttaaatatatataataggagaaaaaaacaacttcccca

SEQ ID NO: 718818 - DNA, 920 bp, Homo sapiens
ggcctggagtccgacgtggaagttgctggctgactgggcttgcagaggaaaccgcctcggagctgcagccgaaggccaaggaatcactgaagatcggcgagggaggacagggggttcatcatgggtggctttttctcaagtatattttccagtctgtttggaactcgggaaatgagaatttctaatttcgggattcgatggagcaggaaaaaccacaattttgtacagatccacaagtgcgcgagaagttgttactactatacctaccatcggatctcatgtagagacggtgacgtacaaaaaccttaaattccaagtctgggattcaggaggacacgacaagtatcaggccatactggagatgtcactattcaaaacacagatgcacgtcatctatgtaggtagacagttgtgaccgagaccgaatcggcatttccacaatcagagtacactggccatgtctggcggaacgaagagctgacgaacagccatctagtggcgtctgccaacattacacaggacatggaaccggccctgacttcctcagcagatgggcacatccacttgggtcacctgcttgccggacccgacacagtgggcgcgatatccaacacgttcgcagaccaaagggaccgggacctgcatgaggccaatgggacatgggtagctgcacccatcaccacagcagacgcaactcagccaatgctcttccccgcacatgcagaccagtaccgtccccttggaaacgcacggacgaacaacacagtcgacgcctgacaggctaggcgccccaccggccacggaaacgaacgcggacgcccaacacgagcaacgggcccaccgcacgggggacaccacgccacaccgccgccaaacccaccaccacgccaccccgagagagcagacccgaaacgcaaagt

SEQ ID NO: 718819 - DNA, 1099 bp, Homo sapiens
  misc_feature (252)..(252): n is a, c, g, or t
  misc_feature (1061)..(1061): n is a, c, g, or t
agcgggaatttatcagatcgatgtaaatcagatctttgctacaagctacctatccaggcctattgtgttgaaatgtctcaaagtcagtgatctagaacgagatgaatcaagataaagatatgaaagtttaaggtgcaaagaaagagtaaaagaaatgaaccatcaactccgaatggaaggacatatgacgctcaagggatgatgagatactgtataggagggtggattaataaaggaaattgataaaagggnagaattaggaatattgagaatgaaggatacaaacaagaacaatcatgggacctaacttgatagtgaccgaaatatcttaaatataggacatagtaattgattggaacacatggatagtacggagatatcttaataaaacatatccaagacgaatgtttgacagaggtgcttaagatggcaagatgtgatccctagagggctttacattacaggaaaacaaatagagcagtttcaatgatggaagggcagtatgtcctcagataaatggaagtcgcctgcacgaatctggtagtaaaaccaattgagtttaggggaaacaaggtgggtaatgcatgtgataattacgccggcaaacaggggcacgattagcaacaataggtcacactgccgaaaaccaagattcattaaccattctatataagcgtaaatgcatgtagattctcgtgggaactgatctagaaggtgcggcgggtacgagacctaaacacagcactaatggaacggttgtctacatggatgaagatttaagttgcagggtaaagcttgatttgataagaccaagtgttggcttgcaagaaaagtgccttctttttggaaagaccacactcgtacacatgtgatttgtggagcctcattcgacttgctggaacagtgatagatttggattggcgattcttaagtggtaaacaaacaccttttctcggaaacggagttttaacggatttattggcgttcacaaagaattgcggtcacatgagatgcgccccacttcgtttggaagttgggcgtcattccacgcgtaactgggntaatttcgggtgaacttgagggaagatttcttcacggg

SEQ ID NO: 718820 - DNA, 283 bp, Homo sapiens
aagggagtgttatagggtgccagtatgtctgggagtcttcctgtggacaggagaaggcttgtaggggtggattcattttacaacaccttatatataacaagacccttcttctcagttctccagatggagacagaagcccgtgtgtgtgaccgaatgggttaaatcatgcttgttgaatgatgaaggaggagccgttgtgcctctaagtgtatcttcattcatcaagttaaattttggcctcaaaagactaatctctgacccagcaagcaacattctgcagggg

SEQ ID NO: 718821 - DNA, 216 bp, Homo sapiens
cgtcgacccgtgacagcacctgctacaccaggattggcaggttaacggttaacgactgcggactaacagcgactgaaaggctttgctggtggtttcattgtccgttttctttctcttctctctttctttctttctttctttctttctttctttctttctttccttctttccttctttctttctttctttctttcttccttctttttttgtcgacgc

SEQ ID NO: 718822 - DNA, 843 bp, Homo sapiens
gtgctcgcttcggcagcacatatactaaaattggaacgaatacacgagacagattagcatggccccttagaaagatagaacaaaattgataaaacaaaaaagcctttttctggcacggctgtgtgccccttctgaagaaatccttttaagacaatcaatgttcgtttcgggtcaccgcgtggggccactagccaggtgcaaaggggacatttgcggttcataagtgtgacttcgccaataagagaagaaacctccgggctccatgtgcacctacggggtcccttgtgggcaatttctctctcccacccagaatctagacaaagagaccgcccccgtggggtgaccgaaccccagagagccgttttctgtgtgaacacaagaggtctcgcgcaaagatgtgcggagtctcctgtgaagagcctcaattatcacatggggagacctcattattccacacagggaaagtctccccaagggggggagcaagcttactccagaatatatttgtccaaatatgttataagccccccccgcggcacccgtgggtggagatacagcccaccaacacagcatagtcggaaaaactacaccagagcaagcagccgcacccacgatacaaagaaaaaacaaaaacgacacaaaatatgaatagaataatctcatacaatcgaacgggtgacatgcaaaatgcaacacgacgaatgacacacaataacatgacgcaagaaagaaacgtgtgagatcaatacaatcaactggacagatcagagactaacccacacaaaaataagtaaagaaacacatagactgaacagacgcccgcacgacaaaccagatcgtagc

SEQ ID NO: 718823 - DNA, 111 bp, Homo sapiens
ggtctttgttctgttttggggggggtagtttttaatcagtaaacccagcaaatatcatgattttttcctggttagaaaaataaataaagggtatttttttatttccctcca

SEQ ID NO: 718824 - DNA, 109 bp, Homo sapiens
cgcgcttacgactagccgacagctcctgagcagtatgcaccgcaccaagactgcgcctgttgagagcatcccactccctttcccctcttccctgtcgggctagtcgggg

SEQ ID NO: 718825 - DNA, 328 bp, Homo sapiens
tgtttctcctgtgtgtcatcactcttctgatatactgtcacatccctgatagattttattacatgtcttaatcatagcatcttaataactgatcttatgtatttaaatctagacgcttctttgaagactactttgataatgaaacgtttcatgtatatggacttttttgcgttaattatcaacatgatcaatattctccaaataacttctgtaatgaaagacattttggtgagagtgaatgtaaacctataactctaacattgacgatcctcctgcagctgtgataggattatggcttaaatattttgaatttctgtttaaaaatcaa

SEQ ID NO: 718826 - DNA, 256 bp, Homo sapiens
  misc_feature (129)..(129): n is a, c, g, or t
  misc_feature (185)..(185): n is a, c, g, or t
tcagcacgtttcccagcattagccttacaatgacaaaggcaaatgcagaagtgtgcgaacttccaggacaggtccggagatggctgttccagagaagagctagggtggatggcaggaagcggcactggngatggaacctccagtccatatgtggcacctcttttacatcttcatcgtaagccctnccaggagtttgaaatgcaaaagttttagaaatataaaccaggttttacttagtaatattcattaatgacct

SEQ ID NO: 718827 - DNA, 222 bp, Homo sapiens
cttcatggacttatagtgatctaccgtctcatcctcctgagtaggtgtgactagcgtcatacactcgcaggcctagttagttatgtatatctcctagcggagatggctgttactctctgtcgtccgggctggtcttgaactctgggggtcatgcaatctgccagcatgggcctcccagaaagttaggatggcaactcgaaagccccaagcgggggatcctct

SEQ ID NO: 718828 - DNA, 337 bp, Homo sapiens
ggaatctacaattggctctatcatgaagggtgaggacgataaatagctgatggacgcctcgagcaaggagatataatagaaacgaggtaaacaaagatcaactattgagaacattagtaatgacaactacagtccggagtactgcagagagacttgagcacaagaccggggaccatcaccctagactgtagccacagtgctgggacccaagtcccacgtggttgcttcacatttgcccaggcagcgagcccatccggccccttgaccctgcgggctgagtctcccacactgcagccataagtcttggcttccatgcatgtcaggcagcaagcccatt

SEQ ID NO: 718829 - DNA, 1158 bp, Homo sapiens
  misc_feature (168)..(168): n is a, c, g, or t
  misc_feature (237)..(237): n is a, c, g, or t
  misc_feature (574)..(574): n is a, c, g, or t
  misc_feature (673)..(673): n is a, c, g, or t
  misc_feature (780)..(780): n is a, c, g, or t
  misc_feature (807)..(807): n is a, c, g, or t
  misc_feature (839)..(839): n is a, c, g, or t
  misc_feature (995)..(995): n is a, c, g, or t
  misc_feature (1002)..(1002): n is a, c, g, or t
  misc_feature (1028)..(1028): n is a, c, g, or t
  misc_feature (1109)..(1109): n is a, c, g, or t
ggcaagccgcgccatctgtgcggaggccactcctggttatttccgtcccatctaaggcccgcgaaccctcagcggtgcgtgtgtacgagagtgagggagtcgaaaggccggcgaaaccgagagagtcaggggcgccaacgcaatcttgaggatatttgaagacgaaanactccatggtcagcagcggtatacactccgaacctctaccttcatttctatactgtaagctgtgacctntacgggctgagatgtttcgcacaactataaccaatcaatcaaatgataattcagcaagtgcacgaagacgaccgcagaacaacacaatatacattatatactagctaactcacgtcaaagtagctcatcaggtctcacccgccccatccctccctcggcccgctccgcgccccccgccgtccacacgctcgcgagtagcgcatcccccctaaattgtctcatcctttccgctggatccgcatagaagattactttttagtattttatttataattatttcttgcagtattgtcacatgttgggtttactcctctatctctctcctgtctgtactatnttgtgctggtaatacttgcattctgactacttatccaacagagacacagcattctgtgcgaaccctccgtctctcgcatcattcgcaccatcgttcgcncgccaccctccacactacgacccgctcatacagactcatgtttccaacaccttgtccgtgtactgctcacgactacgtactgactcgcacgatctgtctcttctccngtctctctctcatgactcatcgcactntcactctatgttacacctatctgatatctacntacgcgagcgttagtccatcatgctcgcgctagtaataccgcggtaacattattgttgtagatccactagtatttatctctattcatcaattggtctgtctgtcacatcggcgcacgtagtcctctttagcgacatcgcgttcatgagtacgtgtngtttgtntatagtcaacgctatagttcctgttnttcgtcacagatatgtgtaccgtcctcgatcgacgcgatgctcacgtgtctgcggtcgttcagagacacttatatctatcntatcctatgtattcttctctcgcttcgttactgttcgtatgttatatat

SEQ ID NO: 718830 - DNA, 222 bp, Homo sapiens
gctgctattacaggcatgagccatcatgcccggcgagcggggatattgtctgtacagattcctagcactgtcgaaaacctatagctgcattggatcaagagtgtgcagatgttactgcagtccttgccgagtcatgtctcgaaacccatcgtgcctggggagtggcagtccttccaggccaggctgtccaggaatgccctgcacctcaggctctggccacaa

SEQ ID NO: 718831 - DNA, 505 bp, Homo sapiens
atggagcctgtccagtttgaagatggacagaagatcgtggtgcaaggagagccgggggatgagttcttcatcattttagagggcacagctgctgtgctgcagcgtcggtcagaaaacgaagaatttgttgaagtgggacgactggggccttctgattattttggtgaaattgccctgctgatgaatcgtcctcgggctgccactgtggttgcccggggccctttgaagtgcgttaagttggaccggcctcggtttgaacgcgtccttggcccgtgctcagacatcctcaagcggaacatccagcagtacaacagcttcgtgtccctgtccgtctgacccgcgcctcctgtgcctcctccccagtccatgcttcactcacgcagactgctttctctccctagccgcagcgcccagtggccactgcttcacagcttcttgtctctttatactaaaagttgctttattgcaccatttttcattgggagcgttattaaatgctcattca

SEQ ID NO: 718832 - DNA, 203 bp, Homo sapiens
tcgtcgagtaaaacagaatggtccttctgatctaacacaatgataatatcgcctggctccagtcctgggcctctgctcttatggagacaggtttcaccgtgttggctgggctggtctccagctcctgaccgcgagtgatctgccagcctcagcctcccgaggtgccgggattgcagacggagtctcgctcactcagtgctcaa

SEQ ID NO: 718833 - DNA, 907 bp, Homo sapiens
  misc_feature (172)..(172): n is a, c, g, or t
ggcgcagtgtggggacggtctgggtgtcggaaagcaagcctacgtggctcactattacgtataatcctttgctttgcaatgatgcctgaggaagtgcaccagtggagaggaggaggttggcagactatgtatgccgtattcaggcagaaagttgcccaaggtcattgctgcnctcactcagtcgacataccgtgtcgtatgtccaagccaaagagagaattgtaccatgtcgtggaggttgactcgtcataactgctgtcgtgaatggcctgcgacagaagatttcgctatgagagcctgacagacccattcgacacgttgagacagtggtgaaatgacgctgaaaattgacatcatcgcaccaaggcctcaggaacgtaccctgacttcggtagacagcaggcattggcatgagcaaaggctgatctcataagtaatttgggaaccgattgccaagtcgtggtactcaaagcattgcatggaggctcttcaggctaggtgcagacatctccagtgattgggcagtgtggtgtcggcttttattctggctactgtggtggcagagacacagtgggcgtgatcacaaagagacaacgagtgactgaacagtatgcttgaggagtcttctgcgtggagggtcccttcagctgtgcgtgctgaccatggtgagcccatggacagagggtacgcaaagagatacctccagtcttaagagaaagatcgagacagagtacctaagaagagcaggcgggtcgcccagaccgtcagtgcaacgaacagcataccgcaagtgcctcaggctaacccgcatacaccctgtacctgggacgaagggccacccaaacaacggagaatacgagacgatgagggcacgcggagacagaacagcacaggaacacacagggaa

SEQ ID NO: 718834 - DNA, 447 bp, Homo sapiens
  misc_feature (72)..(72): n is a, c, g, or t
acgagatattcaatagctatccttaaatttaatctatttgttccaaaagaaatctaggtgctagcctgctanatgtagcccagtattttaaaaatcagcttccagcccatatggtggttcatgcttgtaataccagcagttgaagaggctgaaatgagaggattccttgagcccaggagttcaaaagcaacctgggcaacataacaagacccagtctctatcaaaagttaaaaaaaaaaaagtgggcatggtgatgtgcacctgttgtcctagctatttgggaggccaaggtggaaggattgcttgagcttggtaggctgaggctgcagtgagcatcgattgcaccactgcattctagcctggacaacaaagcaagaccttatctcataaatatattataataaaattagaaaaaaataaaaaaaatggtctcggagcccttaacgt

SEQ ID NO: 718835 - DNA, 376 bp, Homo sapiens
ctttttattagctcttagtaagattacacatgcaagcatccccgttccagtgggttccccctttaaatccccccgatcaaaagggacaagcatcaagcacgcagcaatgcagctcaaaacgtttagcctagccccccccccccgggaaacagcagtgattaccctttagcaataaacgaaagtttaattaagctatactacccccagggttggtcaatttggggccagcccccggggtcacccgattaacccaagtcaatagaagccggggtaaagagtgttttagttccccccctccccaataaagttaaaactcccctgagttgtaaaaaactccagttgacccaaaatagactacgaaagtggctttaacata

SEQ ID NO: 718836 - DNA, 263 bp, Homo sapiens
accccccttttttttttaaaaaaaaaaatttttggcggggggttttttttaattaaaaaaaaaccccccccccccccctttaagggggggtttttgggggttattttttaaaacccttttccccccccaaaagaagtttttttttgggtttttttttttttgcccccccggggggggggggggggggggggggccaaaaccttaaaccttttttttttttggccccccccagtttttttttttaaaaaccaaatttcccccca

SEQ ID NO: 718837 - DNA, 135 bp, Homo sapiens
ctcatttacagctgacactgaccagaactgtaacttgtgctcagcataggcatacaggaacttcacaaagtatctggcccaggtctgggggcagacgtctccgggctgttccttgagtgaccccttcccttcacc

SEQ ID NO: 718838 - DNA, 314 bp, Homo sapiens
  misc_feature (38)..(38): n is a, c, g, or t
  misc_feature (81)..(81): n is a, c, g, or t
  misc_feature (83)..(83): n is a, c, g, or t
  misc_feature (107)..(107): n is a, c, g, or t
  misc_feature (127)..(127): n is a, c, g, or t
  misc_feature (135)..(136): n is a, c, g, or t
  misc_feature (167)..(167): n is a, c, g, or t
cccatgtagctgatttgggctcctaagctcacggggangtggacatcgtttctattagctgcgtcctgccccctcaacaancngatggctccttgcgggcaggcccncaagggcgcgtcatgggccnccacacanncctggaacacacaagtgccccacacctgganacagcctggaggagcttgtgaggcatgagggcgcgggagccacactctcaggtgcctgttttccacatgtccccatgcagcccgggcttccaaccacatcttaaaaaataaaaagacgaggaggagaagaaactttggtcctaaaaa

SEQ ID NO: 718839 - DNA, 307 bp, Homo sapiens
ccttcctggtatctttatctttcatgatggtacctttacaactttgccatacttggaaaatatccggtacaagtcattgtttgtcacgggaaaaaggcaagatggatacatacactgtggtctataaatgagagccaatccaccactcatttcttcaagtgggatgggcctgggagaccagaagagtgcgagccctcgggtcagatggggctcaaacccgactcttcgtagccgctcgcaggggcctaggggatcacgagtcctgagaggggtcaggcgcggaagagcagattgaagaggtcagcgt

SEQ ID NO: 718840 - DNA, 451 bp, Homo sapiens
gacagctgttactgaaagatcctgaggtctcccaaacggatctgactggttgaagccacgacttctgctaacatctgcctatgtacggaagaccgtattatgttgactatcgatttgcataagacttgactattattgccctcattgtgcagctctcgccggatctgtactgaaaccctccggttagactcagtgcggtgacatgttgtgatgttagactgagggccaagctcctggtactgagctcgctgaagtgcataaagactgcatcgagttaatgtattggcttgatgacatccaacattgatcgaccgcctatttggtgccaccgggtatctccgaagcatgttgactttgagagctaacgactcccaggaagacccactcacacgaagtatccatggtctctagaatttatactttctggaatactgtcatagtcttacagcgg

SEQ ID NO: 718841 - DNA, 331 bp, Homo sapiens
cgtgaatttaaaatttgctgtgatgtttcgggcatgtcattgtcattgattacatcttatcatgtgagactgggtctgagagcagacaactggtctgaccaaaatttattaggcaggaatttcctcgttcctaataagcctgggagcactctgggaaactggggcttatttcattcccacagctgcgaccatcaaatacagctgccctgaagcagtcctttcagaggcctaccctcatggatgcattctctttctcatggatgttccttgctgataaaaataattcagtgatgtttctcccatttgcttttgacagaagagaaatttggct

SEQ ID NO: 718842 - DNA, 439 bp, Homo sapiens
tggtaagcatatggaaaagagaaactctgtgtttgtatttgttcactccaggtgatacttaagcattaaaatgaagtaaacttgtatttgcaggtaaacactaatgcttgtgatataacctaaatatatattctcagtagggatccaccttcatagttttctactaagagacagttatgtcaccatttcctgaaggcttaaacagtcatctgactgaacttatctgagttgtgttctattattagttcatgtgttcccagatagtaaattcttactgtaaaacattatttcattggtgagtacacattaatttaactccatcaagatcaaacaatctgattgtcattgggctatttttttttttaatttaagttatagggtacatatgtaactaacctgcacaatgtacacatgtaccctaaaacttaaagtataataa

SEQ ID NO: 718843 - DNA, 129 bp, Homo sapiens
ctaattggttcttcgatgacgtgggttaaggatccggcgttgctgtgagctgtggtgtaggactcagatgcggcttggatcccatgttgctgtggctctggcataggccgtcatcgaagaaccaattag

SEQ ID NO: 718844 - DNA, 1484 bp, Homo sapiens
tggactggtcctaaatggttaattaacgtcatgacttttacaaacttatactttattttcagcggtaacgggggacctggagagttatgtgcgcctttcttccaagcgtgcccggcgagagccaccaaataggtggtgggtggaacttgggtggcccttttccaaggccagggactttttcggccgtgcaaagtgttcagcccacgcattctcccgtggtgctgtggtggagcgtggttggggtgatctccacgtgggtgtgttcaggatttctcttcgtgataatagcctttagtggacatgtggactcacagtgacggattaacctctcaaaaaatttgggtatgtggtggacactctctcacacaaccccgagtttagagacatattcgaggacactctcttagagagagcccccaaagagtgtgggcgttcccaaacttcgcgctccttctgtgcaaacggacatgtgaggggcttccgagagccaaaacttttaggcgtgggtttaacacacccaggaactgggaccagagggctttagcgcgggataccgttttgcgcaccccccttatagagaaaacgtgggggagcgtgtattctccggggccaccacaacggggtgtagaaaccaccagaaactcccttaactatttattaagcgaggtaaacccttttgggcgtctggcgcctttggttaccgcccccaagctcggagccagccgcctttcaactcagaggccagggtgcgtggggagccagagagaaacgcccccctttagtttggacagacacgcaagaagactgcttgggaggagaacttttggccacaccatatgtcggatgcaccctttccaagagaagaaaacacgcccgcattgactactcaacaacatggggatttctttattctaccaaaattagcctcccggtgggaagtgctaccaaggataatttagcaccaccaattcctggtgggctataacccctagtatattagcacaggctctgtgaacccagaacagtacgtcacctttctcaaaattttaaactctctctagggggcccagtgatacatccgaggacggtggtacactccgcgagtacatagggtgtccccggtcatggccacccatattgacggggaaaacaggggccactgctcccttttcgcgcaaaaagaagattatgtggccaggagagagattacgcacgccagcacaattcacaaaacgggccgtggtgcccacactaggacgggaaaacgacgctgtatgagagacgacagacgaccacacaaaaaaatatcggcgacacactgaacaagagcacctagagaccacattgcaaccaccgatagcgaagcgagagccataccgagagacgacacagaggacattcagtcaccaaagcacattcccgacaaaaaacaaacgtacgcggcaacacccacgtaatgttaccacgtcgggacagcatagcag

SEQ ID NO: 718845 - DNA, 292 bp, Homo sapiens
  misc_feature (57)..(57): n is a, c, g, or t
  misc_feature (172)..(172): n is a, c, g, or t
  misc_feature (254)..(254): n is a, c, g, or t
ccgaagagcgaggagtgctgatgtacaagggcaggagaagatggatgtcacagctcnagaagcgagaacaaatttgcccttctatctttttgttctattcaggtcctcaatgaattggatgatgtccatgcacattagggagggctgcctcttcattactcggtctaccaantcaaatgctaatctcttccggaaacatccccacagacacacccagaaataatgttttcccatctatctcagtaccccatganccagtcaagtgaacatataaaattggctgtcacatctc

SEQ ID NO: 718846 - DNA, 413 bp, Homo sapiens
ctcaacgctttatacttcaggaaattgttgacgatctcttcatccaattatattctacagtacgtgaggcggtatctgaatattattcattgaaaatgtatgcagttcactgtccctcttgactagaaggtgagctcatggatggcaggtactacatttgtgacatgtgctcttgggagcccagaaggcagaatagggattcacaaggaataggtgccagtcaatacatttccaatgacggacctcggagtccagcaaactgctacatctgaggcatgtttgtggcacagatagtgtttgggtactgggagtcgccaggcttatgttccaggctccatgaagcagtcgattcatttggagatcctgtcagattctggctacgaccaggagatccgtgagcaaatccctggaag

SEQ ID NO: 718847 - DNA, 526 bp, Homo sapiens
atgtgacaacggtctgcgatccctcacgagtacgaccttcaatgttggatgaaaccttttattggcacaggcattccttgttcacttgacgaggtgaagctgtaattgttcaaaacacgagtaaaagctggtttctcctcagactattttccttggtggtagtagcgctcagtgggtcagaaacaactcctgaccacttggtttccttttgagccgcgtcattaggcaggccatctgtcaaacactagcacaggtctcccgctgtaccggtggctcacccaaatgataagcagagtgcacgaaaaaaataaaacttctattaaagcaatcatgctgagcacaagctcagcgaggttgtgacattgcgcaactcgatagcatgcagggcgccttgggggactggcgttctccaaagggcatcccaacaccatctctcctctgatttcagtgacaaatgtggcacgctacttgcttggaggtactgggggcactgatgcgggcccttcatcctgtatagaaactccgc

SEQ ID NO: 718848 - DNA, 306 bp, Homo sapiens
agcaggcccgcaaggccgaaagaggtgcaggcctgggcgcagcaaaggagcgggaagtgctgcagctgcaggaagaggtgaaaaacttcatcacccgagagaacctggaggcacgggtggaagcagcattggactccggaagactacaactggccatcaccagagaggggctggtggtcaggccacaacgcagggactcctagggcccagtaaggacagtgccgccagacccatgtatgtatcatgcgagattgccctacctggataagcagtgtttgctatagagttcaccttatcagccagctc

SEQ ID NO: 718849 - DNA, 326 bp, Homo sapiens
aaaacccctcccccccggtttttcccggggggaatttttccaaccgggttcctttttttaaaaaaccccccaaaaatccaagaagggcccggggttttgtaaaccgggcccccaaaggttttttgggaaaaaggttccaaaaaataataaaaccctgggggggagggggggggtttttttttccccccagggtaggcccccggcttttaaaaaaccctgggttgggggatttgccggtcttttccgggggaaaaatttttaccgggatttggctaccttgaaagggtgccaaaaagggggttccgccccccccggttttggtttta

SEQ ID NO: 718850 - DNA, 761 bp, Homo sapiens
  misc_feature (724)..(724): n is a, c, g, or t
  misc_feature (731)..(731): n is a, c, g, or t
  misc_feature (736)..(736): n is a, c, g, or t
  misc_feature (747)..(747): n is a, c, g, or t
tctgaggaagacaaaaaaacaccgaccagcatcgagaactggttccgctgcatggacctgaacggggacggcgccctgtccatgttcgagctcgagaacttctacgaggagcagtgccgaaggctggacagaatggccatcgaggccctgccattccagaactgcctctgccagatgctggacctggtcaagccgagaactgaagggaagatcacgctgcaggacatgaagcgctgcaagctggccaacgtcttcttcgacaccttcttcaacatcgagaagtacatagacaacgagaagaaagagcagatctccctgatcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttaattcacagaagcctttttnatttgcngcttntgggtttcgtnggcttgaacttgcc

SEQ ID NO: 718851 - DNA, 879 bp, Homo sapiens
  misc_feature (518)..(519): n is a, c, g, or t
  misc_feature (842)..(842): n is a, c, g, or t
  misc_feature (849)..(849): n is a, c, g, or t
  misc_feature (854)..(854): n is a, c, g, or t
  misc_feature (865)..(865): n is a, c, g, or t
gtcccacaggatctctgagagtctgtgtggtccgtggccgcgctgggttccccggagcagcgccgacgtcactgccgagaccttaagggaaggcgcgcgtccagtcctcgcactgctgcgtgttctggtcagaacggaagtggtagcctccactgggagcttctgtgctttgggagaatgtgtctaaactgtggtcctgttcgttctccagtcctgtgtggacaccacgaccagttgtaaacacaggtcccgtgcagctcgctttggggaagaggcgcgcccgcccaggtcctctgtgtgtagctcacgcccggggctccgtcccgtcctgggtgggttttcacctgcaccggggcccctcccccgggagcattcgtggagccggcgtcctcagccaggagcgcgttgctggctcagcggctggagctcaaggtcggctcaggggactgtctcgtgctggaggttggcggccgagcagcctgtgtttcccggaaaacggccaggcctgtccgcgctgnnggccacgtcttcgccatcccctcgttgcaggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttaattcacagaagcctttttnatttgcngcttntgggtttcgtnggcttgaacttgcc

SEQ ID NO: 718852 - DNA, 359 bp, Homo sapiens
agacagagaggagacagctacatgccacgaacatgcccacagactgccctggcatctcctgctcacactgaccaagaatgccgcgtgcaaggcatactgaggtgaaaggacaattgaatgacaggtgggcaaagggagaacttccccttctaggtgcgaggaaagtcacaaatttaaaaatgttgcttccagcccagatcctaaatgctagttctcagcagctgcgtggcttaccgttcgccatttccaccaccgacagctgccagcaccgctacagatcacagagatgtgaacagacaatggaaagcactcttagccttgcagtggtctacattttttaggaaccaagttatgttata

SEQ ID NO: 718853 - DNA, 336 bp, Homo sapiens
  misc_feature (43)..(44): n is a, c, g, or t
  misc_feature (70)..(70): n is a, c, g, or t
  misc_feature (72)..(73): n is a, c, g, or t
  misc_feature (100)..(100): n is a, c, g, or t
  misc_feature (128)..(128): n is a, c, g, or t
  misc_feature (131)..(131): n is a, c, g, or t
  misc_feature (190)..(191): n is a, c, g, or t
  misc_feature (219)..(219): n is a, c, g, or t
  misc_feature (239)..(239): n is a, c, g, or t
  misc_feature (243)..(243): n is a, c, g, or t
  misc_feature (333)..(333): n is a, c, g, or t
ggcggacggggactggcaggatttctatgagttccaagagccnncccggagcctcctggaccaggaaaantnnaacggaaaccccgagcctggggcggangcgggggccggggcgggtgggggcgccnacngtttcccggccctggcctgcagcttggaggagaagctgagcctgttcttccgcccctcnnatccgggcgccgagcccccgaggacggncgtgcggcccatcacggagngcanctcctgcagggggacgaaatttggaatgccctgacaaataattattttaattttattcctttatactttaattcaactcaaactattacnttt

SEQ ID NO: 718854 - DNA, 304 bp, Homo sapiens
atgttgattcacattccggtgttttattgcaatactatggtctaactgaggcttcgttctacactgtattgtttggtgttgccagagctattggtgtgttaccccaattaatcatcgatagggctgttggtgctccaatcgaaaggccaaaatcattctccaccgttaaatacaaggagttggtaaagaaaatcgaaagtaagaactaaggaaaatttgatttttgattcagggtatgcgactattcaaacacgtattttcatatacgaatgagtagtttataatttatataaatatatattac

SEQ ID NO: 718855 - DNA, 307 bp, Homo sapiens
agcactgccccgctagtttgccagtcccctgagagacgaggccaataaaagttgttttccctcctttctcgaggtgggggcggggtgggaaactagagtgcttggagttggacctgagccccgtttgcagggtccgaactgggttcttcttgtatggtatgggtactaagaaattttcaggttttaggattgtcacgtcacccccatctacccacatttgaaatgttatctgtcgattctcttcacattgcagggaatcgtgctccgggagtataagtcataggatagttttggacacttacagaca

SEQ ID NO: 718856 - DNA, 169 bp, Homo sapiens
tggacagcacagaggaggtggacagcactggacagcacagaggaggtggacagctggaccgcacaaggaggagcgtgagcgcggcatcaccatcgacatctccctctggaagttcgagaccacctctgtgcctcctctgtgctgtacagaggaggcagcacagaggagg

SEQ ID NO: 718857 - DNA, 389 bp, Homo sapiens
ctcagaccacagagtgtcttacacctgaatcctgttcgcagactacaagcaatgttggcttcccaatcgatgcctcctgtgtatccttcagttgacattgatgcacatactgagagcaatcatgacacagcattaacacttagctttgtgccaggttggtcatagagaccttgttatcttgtctcattgccacgggttagccaaatatgaaccacagaagacacaaaaggttttcacacctcttatcctggcaagcaccagcagggcatgttggagttgtttgagatccttctctgagaaagggggagatgatagaggcgcagtctgaccgatctaagggtactccgctcttcatgtgcagtatgctggtggacgtcacaggtggtaga

SEQ ID NO: 718858 - DNA, 566 bp, Homo sapiens
agtaagtcgtgagtagtgtcaagctggatgtagaattgtcctaaggcagttgaccccaccttccaacatgttttcactttatttgcccctccctacatttgggttaggttccatttggatttgcagcaataatgactttatttctctcttggtcaggatttggcacataaaatccttttattatagaactagctattttagttacatagtaatgtaactaatggagagatttatagagaattttgtttttgctgtcatatatgtccattttggagacagatatgatagaactagaaattaagttgcatttctgcaagtgccatttgaatgaacttcaagtatcttcttaattattaaattttctgatgaaggcattgtaacaaatatatagtattattaaatctaattaatatttggaaatattaataaataggtattttatttactgtaaaaagtcaaacttcattatgtagataaatcttattcttttcattctttcccctgtttacatcctttttacaaagcttagtcaccaattaaagctttcctatcaaaatcaaaaaaaa

SEQ ID NO: 718859 - DNA, 451 bp, Homo sapiens
gggagagaggttgcagtgaactgagattgggtcactgcactccagcctgagtaacagagcgagactctgcttcaaaaataaaataaaataaaaatataaaaattagccaggcatggccgggcgcggtggctcacgcctgtaatcccagcactttgggaggccaaggcgagtggatcacaaggtcaggagatcaaaatcatcctggctaacacggtgaaacaccgtctccactaaaaaaaaaaaaaaaaaaaaaacaataagcggggcaggggggggggcaccggtagtcccagttaccccagaggcggaggcgggacatgggcggtgaaccggggaggcagagcttgcagggagtcaagatcgcgccatggcactcaagccggggcgatagagcaagactccatcgggtggtgggtccgagctcgtccccgggccgggggtcctggggcgg

SEQ ID NO: 718860 - DNA, 120 bp, Homo sapiens
acccggtgctccttgccttactgctgctaattctggtgctactagcctctttaggtgttcagtcgacacagcttctggaggcttttcttgtgtttgaggatggctggcagtacctcctca

SEQ ID NO: 718861 - DNA, 348 bp, Homo sapiens
  misc_feature (11)..(11): n is a, c, g, or t
  misc_feature (61)..(61): n is a, c, g, or t
  misc_feature (131)..(131): n is a, c, g, or t
  misc_feature (133)..(133): n is a, c, g, or t
  misc_feature (140)..(140): n is a, c, g, or t
  misc_feature (142)..(142): n is a, c, g, or t
  misc_feature (150)..(150): n is a, c, g, or t
  misc_feature (217)..(217): n is a, c, g, or t
  misc_feature (287)..(287): n is a, c, g, or t
  misc_feature (337)..(337): n is a, c, g, or t
caaaagggcanaggaggacgaggacgaactgggaatcgtagggggctcccatgaaaccttnccccccagacccagacttgggccattgctctgacatggacacagcccaggacaagctgctcagacctgcntnccctggntnggggtganggaaccagcactgtgcggagaccagcttcaaggagcggaaggctgcctgaggccacacagctggggnggggacttctgtctgcctgtgctccatggggggacggctccacccagcctgcgccactgtgtcttctctnaagaggctccagagaaaatggacaccaatcaataaagaactgagcagaancaaaaaaaaaa

SEQ ID NO: 718862 - DNA, 938 bp, Homo sapiens
gactagtgtatgctacgcgagtatgaatattcatctcaattcgtgatccatcaaatcatattggcttgtatagagaggaatgcgaaatgcttgaattatgactgcgttagcgtgagatttaatatatagtataggttgatcggtaatagttatgatgtaatgagcttatggtcgtctattacccgagttatgatagtctttatccagtaaggtaggaaatacgcaagtatctctcatctgtcagcagcttttactatgcgtgatctttgttaactcctcatattaatcaaaaattctcttacggaagacatagtattagaattttgcatcaagaatattgcaggggtatgggtggtctagagtatttatgagcattgaaagtcatacccgttctcgagtaattgttagtgggcaaggctacaagaatcctttgaaattcgacgtttaattttacttcaagtgggattgaagggacagaaatctacagtggatgggggggaagagaagttcactgatagtaaattttagcggggatgagaggagaatttgggtggagtggccttggggtttgggagtaggggggtctcgccatgaaacccggaccatagcgggacttagcgtgtgggtacagatatttcttgaccccgactggagatgaggtctctgtagcacggtaaattgccccctggttaattggactccaagaaaggtactcgcgtccacccgaggactgttcatgggtgacaataggcgcttttaaggccccatgggggaactctgtgaagaaaggaccatccgtgtatcgcatatgttcccgtttgggaccccactgtgggtctatactcagtgttgggatgtcgaagttgtttccgtttcgggtaccccttgcgtgaaatgaaggagctcagcactggaagtcgtcccttgcggaacgaaag

SEQ ID NO: 718863 - DNA, 150 bp, Homo sapiens
atgcggacccctctctggtagttataaggaaactgtttattgacttacttataatttttttttgagacaggttcttgctctgtcgcccaggctgaagtaccatggtgcaatcttgtgctcaccgcaacctccacctccagggctcaagct

SEQ ID NO: 718864 - DNA, 339 bp, Homo sapiens
  misc_feature (25)..(25): n is a, c, g, or t
  misc_feature (29)..(29): n is a, c, g, or t
  misc_feature (70)..(70): n is a, c, g, or t
  misc_feature (102)..(105): n is a, c, g, or t
  misc_feature (111)..(111): n is a, c, g, or t
  misc_feature (125)..(125): n is a, c, g, or t
  misc_feature (138)..(138): n is a, c, g, or t
  misc_feature (148)..(148): n is a, c, g, or t
  misc_feature (150)..(150): n is a, c, g, or t
  misc_feature (155)..(155): n is a, c, g, or t
  misc_feature (159)..(160): n is a, c, g, or t
  misc_feature (167)..(167): n is a, c, g, or t
  misc_feature (186)..(186): n is a, c, g, or t
  misc_feature (190)..(190): n is a, c, g, or t
  misc_feature (238)..(238): n is a, c, g, or t
  misc_feature (262)..(262): n is a, c, g, or t
  misc_feature (329)..(329): n is a, c, g, or t
atattatccctgtatattgcatgantganagatttcccatatttccatcagagtaataaatatacttgcnttaattcttaagcataagtaaacatgatatannnntatatnctgaattacttgtnaagaatgcatttnaagctatttnanatgtntttnnatttgtnagacattacttattaaganattngttattatgcttactgttctaatctggtggtaaaggtattcttaagantttgcaggtactacagattttcanaactgaatgagagaaaattgtataaccatcctgctgttcctttagtgcaatacaataaaactctganattaagactc

SEQ ID NO: 718865 - DNA, 126 bp, Homo sapiens
actgggtctgtagcttgatgggtctcgagtgtgtgatgctggatctggactatgtggtcgcagatacttctaaagataatgactcgtcgcagaagataaattccttcttcggcagcacagaccaca

SEQ ID NO: 718866 - DNA, 244 bp, Homo sapiens
ttcccccccaaccccccctggggcctcaagagggtggtacctaaaaaagttttccctccccccccccgctagcctggtcagtggtcagcaaattggaaaaggatccgatgggggggtaaatgttagacccaatgttttgattaaacccgtttggggtttagctttgtatttaaacaaggaaataaacttgaaaattttttgtcttcataaaaatgaaacaaatttaaatattttttgcccggca

SEQ ID NO: 718867 - DNA, 346 bp, Homo sapiens
  misc_feature (32)..(32): n is a, c, g, or t
  misc_feature (56)..(57): n is a, c, g, or t
  misc_feature (71)..(71): n is a, c, g, or t
  misc_feature (86)..(87): n is a, c, g, or t
  misc_feature (91)..(91): n is a, c, g, or t
  misc_feature (95)..(95): n is a, c, g, or t
  misc_feature (194)..(194): n is a, c, g, or t
  misc_feature (197)..(197): n is a, c, g, or t
  misc_feature (206)..(206): n is a, c, g, or t
  misc_feature (256)..(256): n is a, c, g, or t
  misc_feature (270)..(270): n is a, c, g, or t
  misc_feature (319)..(319): n is a, c, g, or t
  misc_feature (325)..(325): n is a, c, g, or t
  misc_feature (330)..(330): n is a, c, g, or t
  misc_feature (336)..(336): n is a, c, g, or t
aaatatttagatgtaccctgttaacagccagncattttgatttacttatggaatcnngtgaataaaaggcnacataatttgggggnngtantctnatatctaataaaaacagtttgagtggttgaagacatctgcatgaaattgcacctaggtgcattacttgatataactctcccctaaaactgttgtaattncantttttcccntttcttggcacccctttagaaatgtactgaagtctcatttttcacccatntcagccatgggacntttttcataatattaatgtaaagatgtttgtgttactgtttataaattncaattntaaanaaattnctagttttcc

SEQ ID NO: 718868 - DNA, 200 bp, Homo sapiens
gtcggcagagagcattgaagacacctagatggcaatttaaatttttgcttcagtacgggcgggaaaccctataacgtgttaagtatatttttgcccatatggggtctcactgatattgtccaggcgggactcaaagtccggagctcaagcaatcctcgcacgtgggtctccagagcatcgggagacaaggtagagccgag

SEQ ID NO: 718869 - DNA, 568 bp, Homo sapiens
gtgtgctgttctagaggttccgaggatacggtctgcgcgttgtgatttggcaggtaccctgtatgggtggtggctgggctgcggggaaggctgtagattcttcagtgaggcccgaggtggtgctgtcctcagtgaacagtgttgtgtgagttgaggctggccggctgtgaacagttgtcggctcttcaccacgaactgaggtcgtggtgctgcgaggggacactgtgatttcagttgagcctgggctgctgctgtagacggtggtagattcctcactgaggcctggcgtggtggtgctggcaggtgacactgttgagtgagtggaacctggttggctacgggaggtggtggattcttcaccgacgcctaggcttgtcatactggcaggtgagagtgtagtggttggtgatctggggctgctgtagacggtggtagatgcctcactgaggcctggtgttgtggtactgccaggtcacgttgttatttcagttgagcctggactgatgcgtgaggttgtagattctccacgacctgaggttgtggagtgagcagatccgctatacagggt

SEQ ID NO: 718870 - DNA, 931 bp, Homo sapiens
tctctctccttccctgcagcaagtggccggtttccagctgcctactttctgcccggatctctggctcctcatctctccggtctccgcagactaaagcccctcgggaatatgcagcagccattgcctggtgcacacgctgagccccggagccccgtccgcccccgccctacctttgccgccgtgcggaccagggatccctgtggcataccgtgcatacgggggccggcaaagtggtggagcccggaaaccgagcgctgtggacgcgccttggaggccgaacaagggccaaggtacgtcaagaagccttgcacttggccaacaccctgccatggagcctgtgcagccccttgcttgtccaaacagccgctcttcagccctgagatctcgccgcacatgggctacacggccacaagccagcacgagcccttgcctgggcccctggccagaccggcccccagtctgggacctgggacatcctcagaacgcctcaatcagactttgttgtcgacaggcccctgtggttccccagtgcctgatggcacatgcccggacacactcctgtggacctggcgccctaatgagagagccggagccggatcacatccccacaaaaggaaaaacacattcctgagagaaccgcacaagccacaaaatacacatccatgagagccccagaccagagagtggcaacaacgctcaccaagaaacccccacatgagcccccaaaccacacagacccagaggcaccccggagaccaccctaagccccccaaaatacaacccaccgagggcacccacagagccccggcagcagaccactccccaagaccccacacaaacacccacgggacgaacaccacaagagggaaatcgagacacaacacgccaatccccaaaagcgtacgggaaaaatacgaacaacacaaaaaac

SEQ ID NO: 718871 - DNA, 182 bp, Homo sapiens
gtatagtgatggagatggtgatggagatggtgatggtgatggagacggtgatgatatggtgatggagatggtgatggtgatggagatggtgatggagatggagatggtgatggatatggagatggtgatggtgatgggatggtgatggtgatggtgatggtgacgcaactggtacggcgggc

SEQ ID NO: 718872 - DNA, 545 bp, Homo sapiens
  misc_feature (10)..(10): n is a, c, g, or t
tgagattggntgactttcttaacccagatttttaaatgtgacagaatgctggttaggtgaggctggataaagggctacgacagtggtcaaaccggaggagggtaccggatgggcatgatgggtgctacacatgtagtaccaggccaagagtccagcagctagggccacaccagtggacaggatgaactgcaggctgggctttctcagcacagccatagctgttcggaagggacagctgctgccctccagggcacctttgtcttgttcagcagcgtagaaagggcatttacgcatgtctcctttcccatcgtgtacagggaacccatcctccaaggtctctctggccagtgtggagaccggctggtccagttcattgaatatctgcatggtatactcaaaaagctttgtggccttctacacgatcctctctttggacttatgatcaggtcagggcggtattctggcccgtagaggtgcttgaactgtgggcattggccacattttaaacaaggagaactgggccccttccctgtgttgggaagtcg

SEQ ID NO: 718873 - DNA, 962 bp, Homo sapiens
aagtccttttaaaaaagtggatcaggaatcctgttatgggccttgattgttccagacattagaagtaaatatatttgatgaaggaaatcttgaaaaaatactgactagataaaaattgtaagccaagctttctgactgaaaaatgctacctagccacagatcattgctgttatttggttcattgcatgagtgtgtatgtgtgtgtatatatgtatacacatatatatgtgtgtgtgtgtgtatgtgtacacacacatatatgtgggttttggggggtatggataagatggtgctatgaaaataatttgtctcttgttttaattaatgaagcttctgtcatgccaagtagtctttagggagaagtcagaatcttttcattaaaagtcatagggaaacagaagttgtacgggtgctgcttgccaaggacagactagaaaagacactgaggcagttactagtgctgacacactggcccaacggagagagaatgtatgggaaggaatatgtcttacttacggtgactttgtggttcttaatctgcatgttttgagttgtctgcagcgcctgccgttgctgtgcacaacaaggagctccttgctgataaaccagtgatatttcttgatgtgtcacttcgaagtaacatttctttctgggtatttccggtgttggggccagatagatgggtccctcagaatactaacttatgcctgcactggtcgagattgctttcacccgacttcccaaggaaaagtccattacctgaacttgccggagacatgattgggccagacacgttttagaacctctaacgtcaggtcacacatggccctcatgtgtaatttgtatcattctcaccacgggtatctaacgtggagaattgcaagtacaacacccgtaccctcacaacatacactacctttatcaaaacacaacacgagacataaaatacacttctaccaaaa

SEQ ID NO: 718874 - DNA, 161 bp, Homo sapiens
ttagaggatcccgggagcagaacacaagccggccaccatgacactctcggatgggcatcctcggctggatctggtaggccagaactggtgccctgagcctcaccctcctcaggaatatttcctttctcttccgggtctcacgtgaaaccggggtgctccta

SEQ ID NO: 718875 - DNA, 347 bp, Homo sapiens
gtcatccgtacaggcgtggtggtgggcactataatcacagctacccgggaggttgaggcaggagaatcacttgaacttgtggggcggaggtcgcagtgagccaagattgcaccacttcactccagcctgggcgagaaagtgaactctgtctcaaaaaaaaaaaaaaaaaaaaattggaccaaaaaacccaatttgattcttttggcaatgaggcgaagtatacaatatatttattttaaaaaaccagctctatgtttcctgaaaacaaggacacccctaggagaactgtgttgaagaaaaggacaacacaacgtataaaagtgacacgtgcctatattttctccacg

SEQ ID NO: 718876 - DNA, 205 bp, Homo sapiens
ttcaagcgtatacccaaatgctgaaatactagtgaggggtcgggtgtggtgacgcttgcctgaaatcccagcactttggaggccaaggcggacggatcacttaaggccagcatggtgaaagccatccctactaaaaatataaaaattagcagggcgtggaggtgcatgcctgtagtcccagttacttgggtactacgctttggca

SEQ ID NO: 718877 - DNA, 133 bp, Homo sapiens
atcccacctaacattggactcgaccttacttcaacatcgcagacgacgatctacggcggcaggcaacgatgtgcaccggcactcgtcgctcagatacccctgggggttgtgagatggacttcgattcacgcga

SEQ ID NO: 718878 - DNA, 204 bp, Homo sapiens
gtcggtcctcggtctacttgttctccaaacaaaacagaacaaaaacaaaaagtagccaggtgtggtggtgtatacctatagtcccagctacacaggaggttgaggtgggaggatcccctgaccccaggtggttgaggctgcatgcagtcagctgtgatcacaccactgtactccagcctggataacagaatgaaaccccataac

SEQ ID NO: 718879 - DNA, 441 bp, Homo sapiens
agatacagaatcaacctaagtgcccatcagtaacagattggataaagaaaatatggtacacatacaccatggaatagtatgcagccataagaaacaatgagatcatgtctcaggaacatggatagagctggaggctattatccttagcaaactaattcaggaacagaaaaccaaataccacaggttctcagttgtgagtgggagctaaatgatgagaactcatgaacacaatgaagggaacagacactagggtctacttgagggtggaagatgggaagagggagaggagcagaaaaagtacctattggtgatgaagtactctgtacaacaaacccgtgacaagagtttccctatataacaaaccttcacatatacccctgaacctaaaagtttttttaattgtaaataaatggatcattaaaaaaaattttaataataaaa

SEQ ID NO: 718880 - DNA, 115 bp, Homo sapiens
cgccaacagtttaactcaagctcatactcaacccccagtgttggtcaatttacgtgcccagccacctgctggtcacacgcattaaccccacagtcaatcagacagccggctgtaa

SEQ ID NO: 718881 - DNA, 325 bp, Homo sapiens
ccggaggacggggccgagggggcccccccccggttccctgcaagggagttccggggcccttttaagggtttgtgggggttctcccccaggtttaaagaccctttggggttccccccttcccgtgggcttaggttgaccctgccttaaaattaaatttttggggggggggtcctttcctcccctccttaaggggagggaagggggtcctttaccccttggggggtggggtgggtttcttgggttgggggagagttttggaaggggggggaaatggccaggggtttttttttgttaccccctgccaattaaaagaatggggccttga

SEQ ID NO: 718882 - DNA, 148 bp, Homo sapiens
gtattgggctgtcgtgccgatgtggaagacactacaggaagtggagctacagatagctaaagatagatgactgacattgacctctattggatactgatgactgaggacggaaagtgacagaagcaaacgaggctaacgggaagcaacg

SEQ ID NO: 718883 - DNA, 129 bp, Homo sapiens
tcagccggtccaatctgctcgatctccaggcacaataataaactccaaatggctgaaagacttaaatataagacaggacaccatcaaactcctagaagaaaacataggcaaaacactctctgacatcaa

SEQ ID NO: 718884 - DNA, 395 bp, Homo sapiens
ccctctgctgtctggggcacatctttgtccagagtcatccagttggcttcttcaatgacccacttgtcaaagccgggctcgtgccgccggttccagcgctccttaagtgcatacttcagcttcttgtcactggcatccacacttgtcacattgaagccttcttccaccagcataatgaagtccaccccagtgccacaggttacgtcaagcaccctctgacacccgtgctggcgcaacagcccaaccagccatcccttgtactcgccggtgcgcctccggtgtgtctccaatatacagttgccacacgcgcgccgcctccgtgtgcgcgttgtggtccgagagcccttcggccgccacccacagagagcgggtccggtacactctgtccaacatcc

SEQ ID NO: 718885 - DNA, 1502 bp, Homo sapiens
  misc_feature (757)..(757): n is a, c, g, or t
  misc_feature (796)..(796): n is a, c, g, or t
tcaccggtgcccactaagggttgaccgaaggcgcctctggggggcccacaatatttccgcgccacacgaggcgcccccacgaagagtgccgcagcaatggggagaaaaggatcaggcctctaacgggggaaaagacaaaaagagtgggcctcccgcggccccccacgagattgttccgtgtgaaaagagaaaccccacggagagaccttaaaggaaaaaaagtgggggagacacccccccgcgtgttggtgaggagaaaaagggccctttataagaaaatttttgggcggcaactttggggaccaacggggaccatattctcctagcgcccccttcacaaatggggggtcctcccttctccccccgccgccttttttgttgtggaaaaatggggcgccccccccgctttattatttcacgggtgtgtccacaccgcgccctggaggggtccccattgcccttcttatttataggccgcgcctgtagacaaaggtgccgcgtcccctcgtccggagttgtataacccccggtgttcaacacccacaccggggccccttgggggagacccggcgccgccagagcgacgcgcttatctctctctcaagcgtgtgcgttttataaagcttttggccgcccccacccaaagggtgccccaggagctccatggagtgtgccctaatacgcccaaagagagagaagtagaaccccaacggagagaacccctgttgttgggcccccccgggcgcccccgagaganaaagaaataagcgctcttctctctggcgcacaaacaagnggggaaaccttgtcccctcaccggcatatagaggaccccacccgctcgttgtccttttcgcagagcccaccgcagagagttatgacacacacgcgctgtcaacacacaccgctctttggttgtggagagagactcacacagagataagtgctccacagcactctgggtgtggtgtgagattggcacacacccgacaccgtgtgagatctccacatctgagagctctgggtgtgttctcttcttgtgccctgccccctgtgtgttctgttaaaaaattgtgggggtctcccgttatcctgcacattatctcacacagtggagaaaggcccacagaactcgggaacgcttctatagtgcccaccacaggagaagacacctcgcaccccacctcgtttgccgctcttacacaccacaggtgagaactccggagaagaccccacaaggcgcctcttgggctataagtctctggtggaaagctaattctacggaccacattacccatggcacgatacgcatgagatccgcccgctcacactggggtggccatagttcctgggttcctcaagattctgtgggctcgctattcccccaggctcgcaaaaggcccaagggtaaagaacttgccccttaactgggtttaatagtaccctgttgagattttctgtaccattaaaataattgaaataatcacccattttcccttcca

SEQ ID NO: 718886 - DNA, 875 bp, Homo sapiens
  misc_feature (16)..(16): n is a, c, g, or t
  misc_feature (113)..(113): n is a, c, g, or t
  misc_feature (141)..(141): n is a, c, g, or t
  misc_feature (157)..(157): n is a, c, g, or t
  misc_feature (169)..(169): n is a, c, g, or t
  misc_feature (176)..(176): n is a, c, g, or t
  misc_feature (180)..(180): n is a, c, g, or t
  misc_feature (207)..(207): n is a, c, g, or t
  misc_feature (219)..(219): n is a, c, g, or t
  misc_feature (230)..(230): n is a, c, g, or t
  misc_feature (241)..(241): n is a, c, g, or t
  misc_feature (264)..(264): n is a, c, g, or t
  misc_feature (280)..(281): n is a, c, g, or t
  misc_feature (283)..(283): n is a, c, g, or t
  misc_feature (286)..(286): n is a, c, g, or t
  misc_feature (291)..(291): n is a, c, g, or t
  misc_feature (295)..(295): n is a, c, g, or t
  misc_feature (309)..(309): n is a, c, g, or t
  misc_feature (317)..(317): n is a, c, g, or t
  misc_feature (383)..(383): n is a, c, g, or t
  misc_feature (399)..(399): n is a, c, g, or t
  misc_feature (410)..(410): n is a, c, g, or t
  misc_feature (435)..(435): n is a, c, g, or t
  misc_feature (438)..(438): n is a, c, g, or t
  misc_feature (471)..(471): n is a, c, g, or t
  misc_feature (473)..(473): n is a, c, g, or t
  misc_feature (476)..(476): n is a, c, g, or t
  misc_feature (530)..(530): n is a, c, g, or t
  misc_feature (536)..(536): n is a, c, g, or t
  misc_feature (656)..(656): n is a, c, g, or t
  misc_feature (679)..(679): n is a, c, g, or t
  misc_feature (689)..(689): n is a, c, g, or t
  misc_feature (774)..(774): n is a, c, g, or t
  misc_feature (872)..(872): n is a, c, g, or t
ggaaaataagaatggngaaagaaaaaagaagaaaaaaaaaaaaaaaaaaaggaaaaaagaacacacatacttacaaactctcctgagccaagtatgtgcaagaattaataagngggaccccttacccccatccactcatgngggtctggaaaaagtngtgccttttagntttttanagtntaagtatgctctcggcatctaatgagntttttaaaagcnagtttaaagtnttcattaaaantcgtatagagcagagggttgatnagagaattcaaataanngngcnacgtnaganagtggggcatttcngaggacanggtgtagatgctcagacccacaatcaactctttgatgaaaaatgggagccaggataaaatgaatgnacccagaataaaaacnaggatgggtgntgccttccgttccctggtgctaganatntgctgacgttctcctgggtgatctagatcattntnggngggggggatcctgatggaggcatggaacttttcaaactctgtggtagggtctgnggtggngaagtcagatacacagaaagtttgtgtaagtttacaatttggaaaagaattctggctatctgtgcttctgttgcttaagtgccgacttgatccccttttctggtaaaggctcttgggcgngtggtaaatctggtaatagagantcagtatcanagtcaaggggatataaaacgcacccagcgtggagtaaatggtgtagataacatggtcgtgctggatggtgcactgactggggggngggcttaggcggcggtggcttctccagaacagagggggcatggagatgaaaatggagatggtccagacggtaaggatcatcagcgcggccctcttggncgt

SEQ ID NO: 718887 - DNA, 920 bp, Homo sapiens
  misc_feature (530)..(530): n is a, c, g, or t
  misc_feature (571)..(571): n is a, c, g, or t
  misc_feature (666)..(666): n is a, c, g, or t
  misc_feature (720)..(720): n is a, c, g, or t
gcaggtgtagtcctggcactctgatatgtatacaaaccagaagcccagccatccctccggtattggggtgggtcagaaaaagtctcacctcaatttgccgactagtgtcgactctgcttgccataaggaatggtcatccttaacctgcgtgccagatttagactcgtctttaggcaaaacctacaggcgcccccccctcaccccagtatctacatgaatcatagttcttcaagggatggggccaggaatctgcatttcctaatgcgctccctgggcaacgcttcagatgcgttgaagttggggaccacggtgcctgggccagagtcagcagcagctgcgctcgagtaaactgcatgggagtaatcgttcactcgtgagcagcatgcgaggaggctgacatgcaacgcctccacatgcaggtccatatacaccttggcctccatcgtcactggctgtctacatctagggccccaaaactccattcctgagccatgtgaactcatagacaccttcagggtgtggggtacagnctccttcccatcttatcccagaaggcctctcccttcttgtncagcccttcatgctacacctggctggcctctcacccctatttctagagcctcagaggacccatccaccattcattcattcattcattcattcatncacttcatcaacataaatcataacttgcatgcatgtgccaggcacaggggatanccttagagacaatctcctcctagggctcatggcctagtggaggagacagattaaaacttaataataaaaaaggagcagtggctcatgcctgtaatcgggagccgagccgggtggatcacctgaggtcaggagttcgagaccagcctggccaacgtgatgaaaccccatctctactaaaatacaaaaactagctgggcatg

SEQ ID NO: 718888 - DNA, 485 bp, Homo sapiens
  misc_feature (22)..(22): n is a, c, g, or t
gagatggcggtagctttgggangactagggcttttagggaaggatggtgttttgggtaggctaggtgttttagggttattggggctccttggttagattggtagagaaggatggtagggtttgtcaggagtaagaggattgtctggtatcaaaggtgaaaaaggggacattggtattggcattgtaggagaaaatggtttttccggccccccaggtctttaaggtccttcaggctatggcaagatgggtgtaataggatcaatgggctagtaaggtatccttggtatccttgggcccccgggtcccatgggccagccaggcaaggttggccactgtaatccctttgaatggtttggggccatgccgatggagcagcagtacccacccatgaaaaccatgaaggggccttttgggtgaaattccccacctgcctttggatgaaagactccgttgggaataaatggccaaagcttataggactttga

SEQ ID NO: 718889 - DNA, 152 bp, Homo sapiens
aagagaaataaaaggaacctccgtgaggggggtccacccacattcattttatgaatggctcacctcccctacctcaaaaggcttgagggaggtacggctaccattacagggttccttattacatcggccacgtgcctgaaggtgtgggcacc

SEQ ID NO: 718890 - DNA, 676 bp, Homo sapiens
  misc_feature (27)..(27): n is a, c, g, or t
  misc_feature (142)..(142): n is a, c, g, or t
  misc_feature (170)..(170): n is a, c, g, or t
cccatctgtttatcttttaaaagatancccatcagcgacagccacaaaattccgttgcaaggttgaagagattaaccagtccgttgccccgtttcaccattgcccaggtgtttaattcttcatctgatgaaggctacttccntaaattttctcccgtgtaaccaaagtgnatgcaccggtgcagggaatgttgaccattgtgattattcagagtggattggcactgatgaccattagcccgtcgctaaccagtcagttcaacgtgctggttaacctggccgtggtgaccaatatcattccgtatattctgtcaatggcggcattagtcattattcagaaggtcgctaatgtgcccccctcaaaagcgaaagttgcaaactttgttgcttttgttggcgcgatgtatagcttttatgcgctgtactcatccggggaagaagccatgctgtacggttccatcgtgaccttccttggttggacactgtatggtctggtatcaccacgctttgaactgaaaaataaacacggttaataaaacaaagtaaaaaagggcgattgaatgatcgccctttctgtttgttggcaaatagttcgttatttatgccgcatccggcagatgtagggtctaaacgcgatcgaacacagcaactatttgcgtaattatatggggcatctg

SEQ ID NO: 718891 - DNA, 302 bp, Homo sapiens
tgtgaggtaagggctgaggttcgtttttcctcctaccaatacgcagttttcctagcactaatttttttttcacaccccttgaaaaagaatttcatcccaacacccagaccaaaccacaacacagccctaacacttcccaaaaacttcactttttagacttcaaccctcactcccctcgactttctcaaacacccaaccctaaaaaccccacacttttctccccactctcagggaaccaaaacccccccccccccccctcgtccaactaagacccaacgcacccaaagcctctctaaacctga

SEQ ID NO: 718892 - DNA, 311 bp, Homo sapiens
cagcgtagaccttgctagcatttgccagcattccgtcttccagcagggatttaatggctcgaggctcgggttccacccccgatttgtggaaaagttaaactccagggcccttttgagaccgaaaacggggcttttcccttttttagggccccaaattaacacttttcaaatttcccaaaaaatttagggttttttaaaaatccccttaacttgggcctttaaatttcccgtttaacttgggggccaaaaaataaagggggaatattttaagggggaacccttttttggacaatttgggaccaattttttgg

SEQ ID NO: 718893 - DNA, 183 bp, Homo sapiens
ttgcggcagtctcagcaaggatggacatgaggcatttgtgtgatccacaggtgctgagtagccagcaacttccttcttgaaagtggaacagcgttgaaggtctgtttaaagaaataatcctaatttagttccagaagcatatcccgtaggagcagttgctactaggcccgtgacttgggcctg

SEQ ID NO: 718894 - DNA, 593 bp, Homo sapiens
tgagacagagtctcactctcgtcacccaggctggagtgcagtggtgcgatcccagctcactgcaacctctacctcctcggtccaagcaattcttgtgcttcagcctcccgagtagctgggactacgggtgcctgctgcctacctcaagtgatccacccacctgggcctcctaaagtgctgggattacaggtgagccaccgcaactggccttttttttttagagccagggtctcactatgttgcccaaggtggtctcaactcctggcctcaagtgatcttcctgcctcaatcccccagagtggtgggattacacgtgtgagccactgcacctggctggcatctattttttatttaaagcgttcagctacactgatcaagaggaaagccaaaacccttcaaagaaagcagggtcagtcggaaagcctgatgtggttaaagactggcgttgctggacattcagaaccaggtgtgggaaaccatgcaccaactgcaaagtgttccagagcattcagtgtgaagctggagcaagtattcccaattcattgctgtaggcaaatcacagaatccaacagagatgatattacatatgaaga

SEQ ID NO: 718895 - DNA, 598 bp, Homo sapiens
gttcgaaggagtgttgagcgggctaagaagtatatccttggaaatcctctgaccccaggagtcactcaaggacctcagaattgataaggaacaatatgataaaatacttgcacctcattgagagtggcaagaaagtaaggggccagaatcgtggcaatgtggatggaggcccgcgggggaagtaaaggcgtactttgtccagcccacagatgttctctaatgtgtcacagatgattatgcgcattgccaaagaggagattggggcaccagatgcaggaaatcatgaaggttctcaaatctttgaaatgacgtgatcgataacagagcaagacaatactttctatggcttatcagcaggagtgtttaccaaagacattgataaagccataacaatctcctctgctctgcaggcacggaacagtgtgggtgacattagtctatggcgtggtaagtgcccatgtgcccctttggtggattcatacgatgtctcaacaatggaaggagaactgggcagagtacggtttccatgaatattgcagaggtcaaaacagtcacagtgacaatctctcacaagaactcataaggaagaatacgagag

SEQ ID NO: 718896 - DNA, 675 bp, Homo sapiens
  misc_feature (411)..(411): n is a, c, g, or t
  misc_feature (661)..(661): n is a, c, g, or t
ctacagccctgactttgagaaactgaagccagaatacttggaggaactctctacaatgatgcagcacttctcacagatcctggggaagaggccatggtttgttggagacaagatcacctttgtagatttcctcgcctatgatgtccttgacctccaccgtatatttgagcccaactgcttggacgccttcccaaatctgaaggacttcatctcccgctttgagggcttggagaagatctctgcctacatgaagtccagccgcttccttcccctctgtacacaagggtggctgtctggggcaacaagtaatgccttgaaggccacgaggtgggagtgaggagcccatactcagactgctgtccaggctgtgcagcgcagctggactcttgattccaacacctgcctcctcgntcctttctcctggttatatccatctttacccccaagactttattgggcctcttcactttccctaaacccctgtgccatgcaggcccttttgaggctcagatacccacttttctttatgaacaatccccttccaacactatcctttcctgtacttaaggcaggctgaactttctttctgttagagggtggatctgcgttgaaggggctacctcgggcccttcctgtggagagttcctgagctgttccccgngttgcatgacgctt

SEQ ID NO: 718897 - DNA, 197 bp, Homo sapiens
catataaacgatattaggagtgtcacgcacggctacacacgtagtcgacgcgaacttgtacagggaggcatgcaccgcagatggtgaatacacgtcgaccaggctccagcttaacgatatttcggcggtcagcacggtagctcacgtgtcgacggaacttgtccagggaaggcatgcaccgacagtggtgaatacac

SEQ ID NO: 718898 - DNA, 596 bp, Homo sapiens
tccccagctatgatcatcgcaggctcctgtattattttcctatttctgctgtaacaaatgctacaagcttagtgatttaaagcaacacaaatacagcatcttacagttctacagactcaacaggggtctcactggctaaaatacaggtgttggcagagctgtgttccttctgggggtttttgggtgaatctatttccttcccttttctggcttctggaggccacctgcattgcttggttcatggccctgtgtgactctgacttctacttccattttgttgttgttgttgttacctctcccactctgactcacctatctcccactttcagttagtaaggcccttgtgattacactgggctcatttagatgatgcaggataatctccccatttcgagatcttaatcacatctacgaaatcccttttggtcatataaggtaacaatatccacaggttctgggaattaggacatggacaccttttgtgggggggcatgattctgcctgtcatagctcctggaggggaaagtagaattcgtttttattgcctgggttttcataggaaatcgatttgttgctgaaatccctcaaggactatt

SEQ ID NO: 718899 - DNA, 124 bp, Homo sapiens
agtctgaattaaacatttcaccactctttgagtacttgactacgagtacagagagagcatgagttgttatgtgctagtaatgatctggattattacacagaaattgtctctcaagaccaggtgg

SEQ ID NO: 718900 - DNA, 203 bp, Homo sapiens
gctgcacctcttatccctgctactcataatgctgaggcaggataattgctcaagtcctgggagttctaatagctgttgtgagctatgattagctccactgcactccagcctgagtgacagagcaagaccctgtctcttaaaaataaaataacaacactatgtaaatctatttctcaagactgtttgatacattataagagtaa

SEQ ID NO: 718901 - DNA, 554 bp, Homo sapiens
  misc_feature (10)..(10): n is a, c, g, or t
  misc_feature (22)..(22): n is a, c, g, or t
  misc_feature (63)..(63): n is a, c, g, or t
  misc_feature (114)..(114): n is a, c, g, or t
gggatacttnagtcatgccccncaataaaatgtttccggttaaggcccaagttccatatgtgncggtgttctcataagattataatagaatttaaaattcctattcctaagtgncattcatagttgccataccatcacagcccaatgtgttactcacatgtgcgtgatgatgctggtataaacaaatctattgtgctgccagtcatatgaaagtatagcacatacaattgtgtatggtacataatgctaatcatgataataaagattatgttattggttgacatacttactatcctatatttgttattttagaatgtaccacttctacttataaaaataagttaactataaaacaacctcaggcaggtccttcatgagatattccagatgaaggcattattacagagatgatagctccatgtatgttattgcccctaaagacttctcgtggagcaggatgtgaatgtggaggacagtgatactgaacctgaccctgtatatgcgtggattaatgtgtgtgtttgtgtctttttaacaaaacagcttaaaaagca

SEQ ID NO: 718902 - DNA, 577 bp, Homo sapiens
tgcagagggttagaaagtaactatggggtacggggcttagtaccggcgtgatgaaaaaaatctgtacgacaaggaccccgtgatgcaagtttcccttcacatgtaccccaaacctaaaataacagttaaaaaaaaagtttactggagccaagtggagaggacagccaccgggaagactcagacccaggtcacctgggatatgagctcggttaggccttggacagaagcaggttttccaaagcaataagagggacagggagtgggctgatacagcggttggtcaggaattcccatgggttagacaaataagatggattagggatggactatacatgggtgaacgggggggtatggagtatggtgtccagggagtggcctggctgggttagtggatagctggtggtggcagcagttgggtctagagcccacatagcaagcagtttcaagagctgattacttagctcaggggggggggggggagggactggtgcctcactctcatgcctcggggggtctataattaatagcaggcttgctttcctcagataaagtttcttttctttctcaatttctatac

SEQ ID NO: 718903 - DNA, 1196 bp, Homo sapiens
ccctgtggaactggcttgggagtgagctgggccgaatagtggtgagagcctggcaaggtcgcctggcccaggcccacggcttccagtgattcctgcgggatgctctgtcagtgctgagtgtgctgtgctcagcagccaggaatattgttctgtctcacactggagatgccagtggacactccagtgctgctgatgctgccattaaaaaactggcggacttcatgaagcaccatgtgactgccaatgggtgaactggatccagctgtggctccttgtgatgtgcttggcctgcacaagcatgtgtatcttgaatgtgcaatcatccactgcctgacaagattcggtgaaaatggcagactccattgagaggaggcacaatgaatgaatcacagactgcagactgcagcgaatttcttgggcctgtcttcgaggacaaccgggagcagcagcaatttcctgcaagatttgtcactgagctgaagctctggatcgacgagaagatgctgacagcccagtgacgtgtcctatgactgaggccctgaaaaactgcatactaagtggcagaaggcaaccaggcattcatggccgagctggctgccaactaaagactggctggacaaaggtggacaaggaagggcgagagctacaccttgaaggaagcccatgagcttgaaagccctggtgtcggaggaagctgaagaggaccttgcacaatgcgctcgggacgaagctgagaccaccaaccaaagccaaagggcccgaaggacgtacatagactgtcaaccgagcatgacatgtatggccaagagctgctgtgcctgtgaaaagattgcatggataagcttgaatgccaagttgcaatcggatgatacgggaaggacctaacggggtacatccgtgcaagaaaagaaatcctggaagggcaatgccgaacaaaacaggggtggacgcagacaggacaggcaaacgcgacaaagacacaggctcggcacacaccaacacacgaccggcaaaacaggcttgcaaacaggaagtgagcgacgggatggaacaacaggaatgaaaaagcgtcagggaacaaaccagagagaagagaagataaacacaaagacgacgaggcaacaaaaagcagaaaagatacaggacgcctagaatcgtgatgcaaacaaaacaaacaaagagaagagaaagaaaag

SEQ ID NO: 718904 - DNA, 322 bp, Homo sapiens
  misc_feature (145)..(145): n is a, c, g, or t
agcgggccttcgacgtgacttaggccggttggcttggtctcaaaatcggctgtcgccatggctagtcgagtgctcagggagtattcgagaccgagcctggctgcgaggctcgcagaatcggcgcggcaagtcgcaccataccggntcctcccgatgccaagagacgagtagacggagcatgaggtcggtgatgacttacgtgtgagggagatcgcagatggtgtgtcctggatgcttgatgaagtgacgaagtactctcactcttcgaatgtatttgaattgttgttgtgattcaactgaatacgttgtgagaatcgttggg

SEQ ID NO: 718905 - DNA, 435 bp, Homo sapiens
cggagaagtgtctcactgaaattatattctgagcaacaagaatgatctgtctggtagaaaaaaaaaaaaaaaatgtttagagaagatcagcaaaaagtgactgtgtggggagaagctaaaaggggaaggtaaaactctttgcctcataagtttatgggaaagtaaattccaaagggcccaggaaaacgtagatataatgtctgaacgggagcttcaaaaggaaagatgacttagagtttgaaaaatgacgtgtacttcatagagtcccgagtgattactgcagggaacagggagccacctaaagagacccacattgcttcagggggcacagttcgagctgagatttggtctagagatgacaaggggacttgtaaccaaatagcaaataaagaagtgtgtgcaacctccgagaacagtgtctggagccccagatgg

SEQ ID NO: 718906 - DNA, 680 bp, Homo sapiens
  misc_feature (308)..(309): n is a, c, g, or t
  misc_feature (422)..(422): n is a, c, g, or t
  misc_feature (613)..(613): n is a, c, g, or t
  misc_feature (667)..(667): n is a, c, g, or t
ttctgtgctagtcagtcagtagcacagcacacgagcaagagcgcagacttcctaggtgtcgtgggccagctctgcctctttctggccatgcgaatcttgatcaggttatgtaatcttctgagccttgatgtcctcatctgtcaaatggcgttaatgatagatagtacctacctaccgtatatgagaagacatgtaaagcaccatggctgtccatagtaatgactcaataaatgcaaactattatttattatcatatgcaagagtaggtgctgcagaggttaaagagagactgttggtttccagttggnnagtatggaaagtgccagtcgtagtgcacagtgctcgagaggttcaaaggaaacgatgatggcacccggcagagatgggagctgctggccaccccctagtggactctgcatagnccatggccagtgcgcccttgccatggtctcgaggatggaaaagccaggtcatcatgtgatttcccactcacataatagacaccaacttactcatttttgttttttgtttagacagggtcttcactctgttggccaggctggagtgtagtggcatgatcatgctcactgcagcctcaacctcctggctcaancgatcctcctgcctcaacctcccacgtagctggactagaagcaatgaccaccantcccagctaatta

SEQ ID NO: 718907 - DNA, 147 bp, Homo sapiens
gtttttcgctagcttcacaccaaatcgttagcgctccttccttcttcctagctatcctgcggcaaatcgcactggctcctggactcttttcctatcttcaccacgaacggctgctagctacgctagctcctcagtcctagcttcatc

SEQ ID NO: 718908 - DNA, 144 bp, Homo sapiens
  misc_feature (1)..(1): n is a, c, g, or t
nccattccactcgggttgattccattctattagtttccattccattccattcccttccattccactctggttgattccattcctttccattccactcgaatacattctctcctattccactcggaacgattccattccattccc

SEQ ID NO: 718909 - DNA, 263 bp, Homo sapiens
tttccttccctcttcctcactgacttccccttgcacaggggcttctgttttatcccatttattatttgtggcgcctatatcaatgtggggtttgtaataggtgagaaatattggcttggagaagctcctgtgcggttagcctggcaatgagtggccgaccatgtgggaacgctcagtttgtcgtatgtgctggaggcctttatgatgaaagtaagcctagacataaaatctggagagaaccatgcaataagcaagtatttttg

SEQ ID NO: 718910 - DNA, 973 bp, Homo sapiens
  misc_feature (826)..(826): n is a, c, g, or t
ggccccagtcactgagccgccgccgaggattcagcagcctcccccttgagccccctcgcttcccgacgtccgttcccccctgccgcttctcccgcacgcgcgcgcttcgagccgtccaccgacggaatacagagaatcgtatcgctatgtccgctatccaggaagccctccacttgctttcgaccccgtttgactagagtgcaaggtaagggttgactgaaccctggctgtccctgcctgggccaactcgcggatcgactactccacctatatacgcacattacaagcagcagcacccaccggcacggacagcaccccttacctacctagtcccaaagggcatcgcttgcttgcattcagcgattacaggcaaagacaccctagctggacagggcgctcttacaagacaacaaaagcacacgcccctgccaacctgcgtcagcacgaaccaccggaacgcctccccgcgacactcatggcgacgacacctacactaacagcccccaccgggcatgcaccccacccgcccaacgcacaccatcctgcccagcgggccactaccaccaacgcacttgcgaaccgccccgaaagaaccgccccaaccctgcacagcgcacccagcagcggcccaacgcgcgtcgatgggcccacattcgaacgctttacaccgtcgacggcgactccccccgtgagcagacacggcaggcacgagcgataccacgctttcgtcctcaccggagcagaccacgggtcgcgaaacgaaccgaacagcaagcgacagagtcaactcgccacaccccataaggagagacccgagacgaaaacngagcgaccgaacccgagcacgacctacagaggccacgaacacttgaagcagcgcacccaggcagccaactccaggagaccctaagtgtaagaccgccggtcacagaacgacggactcgaagcagcaacgcggcaaccacacgaacag

SEQ ID NO: 718911 - DNA, 119 bp, Homo sapiens
  misc_feature (1)..(1): n is a, c, g, or t
ncagtgggtggggaaaggtatgtcccaagcgtcagttcagactagaactttgaatctctctcctgtctcggtctctgcttcctgcttctgccagctaatttttgtatttttagtagaga

SEQ ID NO: 718912 - DNA, 640 bp, Homo sapiens
tttattgagagtttttagcatgaagggctgttgaatttgtcaaaggccttttctgcatgtatgagataatcgtgtggtttttgtcattggttctgtttctgtgatggattatgtttattgatttgcatatgttgaaccagccttgcatcccagggatgaagccaacttgatcgtggtggataagctttttgatatgctgctggattcgcccccctgtccctcccccaaagggaataaaataactaggaatccaacttacaagggacatgaaggacctcttcaagaagaactacaaaccactgcttaacgaaataaaagaggacacaaacaaatggaagaacattccatgctcatggataggaagaatcaatattgtgaaaatggccatactgccgaaggtaatttatagattcaatgccatccccatcaagctaccaatgactttcttcacagaattggaaaaaactactttaaagttcatatggaaccaaaaaaagagcccgcatgccaagacaatcctaagcaaaaagaacaaagctggaggcatcacgctacctgacttcaaactatactacaagggctacggtaaccaaaaacagcatggtactggtaccaaacagatatattgcccatagacgaa

SEQ ID NO: 718913 - DNA, 1049 bp, Homo sapiens
tggcaaacgggaagcaggcggggggggcccggaaaaacgcagcggaggtttcccggggttttcggaccccaggcggccggagtggtgaaatcctcccgtgcaggcggactcctcaatagccactgtttcgccagagagaaggaaggggataaacccaggcgccaccatccacgccagcgcgcacacatgccgttcctaagcctgtcacagccgcggcggcagacagcagttgaaagtttccagggttcttcccttccacgtgctgtagataacccgggctccggggccttcgggtgggtgcctccgtgaatgccccttcaccacacccctgagaagatatcccagggtgggccgaagggaatattagtcagagagggaatacacaattctttcagactaaacttaattctactcccgaatgaatccggggtgaaagttgtaacaggaggaaatctaagcgtccaagcgaacaaggagcgaggcattttcctcaagcgttccagctccaggacctcaccgagaagcgcacaaagcgcctattaaccgtgggcgcaaacaggtgcctgagcgtggccggaaagaccctctatacattcggagaaatccgcgggggcggacgccgcccatgccccgaaggggggaagcgcaagaggggacccagcttttgtgacaaggatctcctccccgtgggaagatcatcgccttgaagaggcaaccaccaggttttgcaagagtacgcagaccacatgtgtttcatctcaatgtgaggcatttaccgacacagaaaaccccgcagaagggaccagaagccccgcccgtttgactccaagaaaccattccagcgcttatggggggccttaagaggaatcggtaaaaaaacccgggggggacaattcccccctttgtgttccccccaaggtaagacacccaggaacggcatatggcataacatggggcctataaaacgtgttccggagacaacagaaggttcctacggggaaacacgagaaggacagcaaataagcggacaccagcactccggggctaag

SEQ ID NO: 718914 - DNA, 405 bp, Homo sapiens
gtggaatgtggttagccaccacggcagcagcggtccccacagtaaccttgtggaatgtggttagtcaccatggcagcagtggtccccacagtaaccctgtggaatgtggttagccaccatggggtccccacagtaaccctgtggaatgtggttagccaccatggcagcagcggtccccacagtaaccctgtggaatgtggttagccaccatggggtccccacagtaaccctgtggaatgtggttagccaccatggcagcagcggtccccacagtaaccctgttgaatgtggtaagccaccatggggtccccacagtaaccctgttgaatgtggtaagccaccatggggtccccacagtaaccctgtggaatgtggttagccaccatggggtccccacgtcgacgc

SEQ ID NO: 718915 - DNA, 1067 bp, Homo sapiens
  misc_feature (92)..(92): n is a, c, g, or t
  misc_feature (173)..(173): n is a, c, g, or t
  misc_feature (442)..(442): n is a, c, g, or t
  misc_feature (459)..(459): n is a, c, g, or t
  misc_feature (464)..(464): n is a, c, g, or t
  misc_feature (518)..(519): n is a, c, g, or t
  misc_feature (529)..(530): n is a, c, g, or t
  misc_feature (570)..(570): n is a, c, g, or t
  misc_feature (594)..(594): n is a, c, g, or t
  misc_feature (598)..(598): n is a, c, g, or t
  misc_feature (600)..(600): n is a, c, g, or t
  misc_feature (620)..(621): n is a, c, g, or t
  misc_feature (646)..(646): n is a, c, g, or t
  misc_feature (662)..(662): n is a, c, g, or t
  misc_feature (667)..(668): n is a, c, g, or t
  misc_feature (678)..(678): n is a, c, g, or t
  misc_feature (684)..(684): n is a, c, g, or t
  misc_feature (688)..(688): n is a, c, g, or t
  misc_feature (699)..(699): n is a, c, g, or t
  misc_feature (703)..(704): n is a, c, g, or t
  misc_feature (715)..(715): n is a, c, g, or t
  misc_feature (721)..(722): n is a, c, g, or t
  misc_feature (727)..(727): n is a, c, g, or t
  misc_feature (729)..(729): n is a, c, g, or t
  misc_feature (736)..(736): n is a, c, g, or t
  misc_feature (738)..(738): n is a, c, g, or t
  misc_feature (758)..(758): n is a, c, g, or t
  misc_feature (761)..(761): n is a, c, g, or t
  misc_feature (763)..(763): n is a, c, g, or t
  misc_feature (766)..(766): n is a, c, g, or t
  misc_feature (771)..(771): n is a, c, g, or t
  misc_feature (778)..(778): n is a, c, g, or t
ggcggagggtgcgtgcgggccgcggcagccgaacaaaggagcaggggcgccgccgcagggacccgccacccacctcccggggccggcagcgncctctcgtctactgccaccatgaccgccaatcggcacagcccgaggcggttgcagatccagttcggcctcatcaactgcgngcaacaagtacctgacggccgaggcgttcgggttcaatggtgaacgcgtccgccagcagcctgaagaagaagcagatctggacgctggagcagccccctgacgaggcgggcagcgcggccgtgtgcctgcgcagccacctgggccgctacctggcggcggacaaggacggcaaactgtgacctgcgagcgcgaggtgcccggtcccgactgccgtttcctcatcgtggcgcacgacgacggtcgctggtcgctgcagtccgaggcgcancggcgctacttcggcgnggacngaggaccggctgtcctgcttcgcgcagacggtgtcccccgccgagaagtggagnngtgcacatcnncatgcaccctcaggtcaacatctacagcgtcacccgtaangcgctacgcgcacctgagcgcgcnggcngncgacgagatcgccgtggacnngacgtgccctggggcgtcgactcgntcatcacctcggcttncaggnncagggctacngcgtgnagancggctgacacngttnntgggccacganggcgcnnggtgngngcccgancnggcatggtaacgctggagtncgncnggnagggncttcggnatgcgaggcggactgggccgacgggaccagggagcccaaagggggcagggcaccaggttggcaaggaaaaggcctttggccgggcccaagtgtgcccagtacagtagcaggggccacaacgcagggtccagcccagggagtgctgctgacactatgaggcaagggagtaaacccgaggacatgcccgaccacgtgctctcaaccgcagattgcgtaggcccgggtgcaacagaaagagtcgattggggtgccaccgtgcagagttatcccagttcggcggaaaagcacg

SEQ ID NO: 718916 - DNA, 602 bp, Homo sapiens
  misc_feature (99)..(99): n is a, c, g, or t
  misc_feature (159)..(159): n is a, c, g, or t
gagcctgggttatttaataaagaaaagcttggcttgtccagaacacttaacaaagttcaggatcaatttaggtaaaagagatgagtgagacaccagcgnttagtgcagggaccataggctcatacattctaggctttatagtacacttactgtgatctncatgcagctctcacactttagcatacaatgagactatatatttttggcagaagggatctatcaaaagtagccttggactatgaggaatcgtattttaaccaccaggcagtccaaggaattatttttaaagggacagctgagtatttcacgtatatactattaaggcatctaaatttttggtgttttcagtatataattttactgctactttttattcttttttttcatattgtacaactatgatattaggtattaagcgacgtaattctttctctactagtgaaccagtttatttcacttagcaaactctaaattgagggaaatatataatctgagaacacacagaaaaatatattgaaaaaccaatagagaattattttaaccatcataaaactcatctaattaatgatagttttaattaaaaaaggtatcgaagaaatggt

SEQ ID NO: 718917 - DNA, 844 bp, Homo sapiens
aagattcctccgctcctctggagtgcacgtgtgtgtgtgtgtgtgtgtgtgtgtgtgtgtacagacccacacacactgactctgtgtacacacacacgggccctggaccaagatgtgagggtctccacgtgacaaaggaaatgagtagaacaatatcaacatgagttctctccctctgaggcctcgacaacagagcgcgtcaagagcacacgatctaacatcataccactcttatataaaagccaaacagcccaaagtgcgacatcgtcgccaacgtggacacgagtctgcaggggataatgctacacggagactacatccagaaggaatcgagctggcaggaagacggcagggtggggggtgaagcccacgacgttcacagaccaaacgacgaaggccagacgaggacgagcacacgcacaccgaacacaagacacaccaccagctgtgcgaccagaagcaggggtggcagcaaacgaagcatggccaagaccatctaaagctgaaccaagaactaccctgacatcctccaacacacacatgatacaccatataagcaaagtggaggcatccctatacagcgaccaataaaaagggggcccccaagaagcaagagagctagagggcgcacggcagaggccaacacacccctgccacaagaaccatagagaaagcagagacacaaaaagttgccccacacgtctgctagcacatcaccacaaggaggagcacgaaacaatcccaagtgggtgatacccacccgaaagaagagcaaaccacggaccaaatagcaccaccaacacgagaaaggacacacccatacactcactcacaaacaaaaaga

SEQ ID NO: 718918 - DNA, 763 bp, Homo sapiens
  misc_feature (92)..(92): n is a, c, g, or t
  misc_feature (173)..(173): n is a, c, g, or t
  misc_feature (442)..(442): n is a, c, g, or t
  misc_feature (459)..(459): n is a, c, g, or t
  misc_feature (464)..(464): n is a, c, g, or t
  misc_feature (537)..(537): n is a, c, g, or t
  misc_feature (544)..(544): n is a, c, g, or t
  misc_feature (571)..(571): n is a, c, g, or t
  misc_feature (586)..(586): n is a, c, g, or t
  misc_feature (604)..(604): n is a, c, g, or t
  misc_feature (653)..(653): n is a, c, g, or t
  misc_feature (670)..(670): n is a, c, g, or t
  misc_feature (729)..(729): n is a, c, g, or t
ggcggagggtgcgtgcgggccgcggcagccgaacaaaggagcaggggcgccgccgcagggacccgccacccacctcccggggccggcagcgncctctcgtctactgccaccatgaccgccaatcggcacagcccgaggcggttgcagatccagttcggcctcatcaactgcgngcaacaagtacctgacggccgaggcgttcgggttcaatggtgaacgcgtccgccagcagcctgaagaagaagcagatctggacgctggagcagccccctgacgaggcgggcagcgcggccgtgtgcctgcgcagccacctgggccgctacctggcggcggacaaggacggcaaactgtgacctgcgagcgcgaggtgcccggtcccgactgccgtttcctcatcgtggcgcacgacgacggtcgctggtcgctgcagtccgaggcgcancggcgctacttcggcgnggacngaggaccggctgtcctgcttcgcgcagacggtgtacaagaagagaagtggagagtgaaaatagaaatgaaaantaaggtnaaaatataaagagtaaaaagtaagagntaagagaaaatgagngagaggaaggaagaaganatagaagtggaaagagaagtgaaatggggagtagaatagataataaaantagaattaaaggaaaanagataaagagtgaagaaagaagaaaaaagattaatgagaaaagaagggagaatggtggnggaaaagagaaggaaaatggataaaagatggagt

SEQ ID NO: 718919 - DNA, 147 bp, Homo sapiens
gctgaccacaaggactttagaggccaaggctaaatcgcttgagctcaggagttcaagaccagcctgggctgaacatggtgagaccccttctctaaaaaaaacacaaaaactagctaggcatgctggtacacccccatagtcccagca

SEQ ID NO: 718920 - DNA, 319 bp, Homo sapiens
  misc_feature (1)..(1): n is a, c, g, or t
nccggactagagcctcaatcaaaggtcaaaggttaaaagtaggacaaacatggagccttcctgtggcaggagagacaacaaagcgctattatcctaagagtacaagagaagtgtacagcctcacctgaatatttatatagataatagatggactatagcctcaaactaccctacttatctagagagttgacagcatcctgaatggaattgctatgaaacgtaaacccctgagagcttcctctataaacatattaacggcaacgctagtataaattatcagggcagactactataaattaaaataaacaggccacaaaat

SEQ ID NO: 718921 - DNA, 426 bp, Homo sapiens
caggagggtgatggcgagcgccgccgggaccctgaagcgcctgaccctggagctcggcggcaacgacgcggccatcgtgctcgaggacgtcgacccgaaggaggtggcgccgaagatctatgccgccgccatggccaacaccggtcaggcgtgcatcgccatcaagcggctctatgtccacgactcgatctatgatgccgtctgcgacgagctgggcaagctcgcgcgggagacggtcgtcggcgacgggctggactcgaagacgcagatgggcccgctccagaacccggcgcaattcgagaaggtgaagggattcctggacgacgcgcggcagaacggcaaggtcgtcgccgggggccgggtcgtcgagcgggagggttacttcgtctcgccgaccatcgtgcgggacatctccgacgacgcccg

SEQ ID NO: 718922 - DNA, 111 bp, Homo sapiens
gagagcatgcgtcttccagcctccacatcagcgttatggatgccttcctctaggtccgtcaggtggcgatagacgttgctgtccgaggcgccatacggtgcgttggcccaa

SEQ ID NO: 718923 - DNA, 615 bp, Homo sapiens
  misc_feature (4)..(4): n is a, c, g, or t
  misc_feature (6)..(6): n is a, c, g, or t
  misc_feature (10)..(10): n is a, c, g, or t
  misc_feature (12)..(12): n is a, c, g, or t
  misc_feature (16)..(16): n is a, c, g, or t
  misc_feature (37)..(37): n is a, c, g, or t
  misc_feature (116)..(116): n is a, c, g, or t
  misc_feature (132)..(132): n is a, c, g, or t
  misc_feature (135)..(135): n is a, c, g, or t
  misc_feature (160)..(160): n is a, c, g, or t
  misc_feature (179)..(179): n is a, c, g, or t
  misc_feature (187)..(187): n is a, c, g, or t
  misc_feature (198)..(198): n is a, c, g, or t
  misc_feature (229)..(229): n is a, c, g, or t
  misc_feature (245)..(245): n is a, c, g, or t
  misc_feature (266)..(266): n is a, c, g, or t
  misc_feature (273)..(273): n is a, c, g, or t
  misc_feature (295)..(295): n is a, c, g, or t
  misc_feature (343)..(344): n is a, c, g, or t
  misc_feature (347)..(347): n is a, c, g, or t
  misc_feature (352)..(352): n is a, c, g, or t
  misc_feature (364)..(364): n is a, c, g, or t
  misc_feature (371)..(371): n is a, c, g, or t
  misc_feature (388)..(388): n is a, c, g, or t
  misc_feature (394)..(394): n is a, c, g, or t
  misc_feature (407)..(407): n is a, c, g, or t
  misc_feature (413)..(413): n is a, c, g, or t
  misc_feature (449)..(449): n is a, c, g, or t
  misc_feature (452)..(452): n is a, c, g, or t
  misc_feature (469)..(469): n is a, c, g, or t
  misc_feature (474)..(474): n is a, c, g, or t
  misc_feature (481)..(481): n is a, c, g, or t
  misc_feature (493)..(493): n is a, c, g, or t
  misc_feature (522)..(522): n is a, c, g, or t
  misc_feature (587)..(587): n is a, c, g, or t
tacnancaananaaanctctttttattgggacttcanaatctttttcaattgaagaggatttcctttgtcacccagcagggtcctggaacttcttggctggaattcaaaaaaccanagttctggttacctanaanatctattctttacgtagtagcttanaagcctcaaaggccacccncacctgangcttggccggntctatgccccccaaaaaagtcttcatgtccncctgcttgtctaaatnagcccctgcttgaagtaaaanatctgcnacatccgtttgtccattttcanaagcataggttaaggctgtgtctcctgttgctgttgtggcatgcacannagngccanaagccagcaaanatttaancaattccaggggtcccncctganaagcctccatcanaggggnggggcagccaagttctatatcagcccctgccttaanaanaaagtctgcaacttcanaaaancctccanagcaagccaaantaaaagcagtttcttgagtttcttctgtntgggcatttatatttgctccttgtgctaagagtagtgccaccatttcttcatgtccttcccgggnagcttccatcaagggagtgtttccttca

SEQ ID NO: 718924 - DNA, 661 bp, Homo sapiens
gtaaagtgggttattgtaaaaaaaccatgccccccaaccatgaaacaacttgatagtgcttgataaaacaggcaaaaaaccctttaaaggggggggggccgtttaaaaatgggcccacaattgggcgaaaattttggaaaaaaatatgttgccaccccattttagaaggccccccctggggggggaattttttgttgagaaaacccccgcctaaaaaaaaccccgggccccaaaaggttttgaaacccccaagtggggcaaggttccaaaaaaaaaaaccacggtcgtaatcaccctcccccgattaaaaaaccaaccttttaagcccccgcccccccagggggggggcccgcgacccaaaattcccttatggggggggaacaaaaattcaggggcccgtataaaacaaccggtgacgtggaaaaccccgggggaaccccacaaataaagcggtggaaaaaacccccctttcccacgggtggaaaaaaaaaaaaaacgccccccagattcccctttccaaaagtgtgcccccccgaaggggggaaagggaaaaattagccccctaaatttttggaaaaaaacgccgggaatattttttgtaaaaaaacccttttttttaaaaccaacaggggccaggaaagggcaaaaacccctttataaa

SEQ ID NO: 718925 - DNA, 166 bp, Homo sapiens
tctaggaggatcccccctcgctttaagtagctccccgggtacccacacctaatgccccctgtggaagcggtctgctccttggcttggagggtgggaaggggagacaaaaatcacagctttggaacagtggttgggaagttatggggaactttggtcaaggtatgaa

SEQ ID NO: 718926 - DNA, 355 bp, Homo sapiens
gttagagtcgtatcaacattcatgtaaatttcatgttttcgcacactccaaacatattgcactgatatttctcgaaacctctaaatatctctatactataaataaacatctgacgaagttaaaagtcaaaatgcattaagatgattttactcacatattatcatcattacactattcacttttaaacaatccaactgagatcaggactctctaattaacgaccgggtgcagtggctcacacctgtaatcccagcaattggggaggcagaggcagatagatggcttgagcctaggagttcaagacaagcctgggcaacatggcaaaacctcgtccctcttttaaaaaaaacacaaa

SEQ ID NO: 718927 - DNA, 702 bp, Homo sapiens
agcgggatgctgcttgcggagacgtggtcaagggagcgccgggcggtagccgccgcggtccgtggctcggtaagtaccaggatcgggtcttggcagcgccgaagggcacgtccgaggatgccgctgctccgggggcccgcactcgtcggggtaggagccccggcgcctctccaccacgcgtgttgggactgagccgggaggatcgcgcgctggcctgccgccgaaggaccccttcgactcctctcctccatcgtgctcttacctgatgtccccagtcccgagacatctgtggatgtgggcccgtcgtattcgccctttgcgtgtacgatggtaagtcgatgctcgcgtgatgacagcgggctctactttctgcgctcgttctacctcacgggtattcttggcctggcacgcgtctccttggtgcttgactggagtcgcacgttccgtggtgtctccctgtgtggcgacttggggccgttcggtacatttgcggaagcgtgcattgattgcgcgcgcatacgaacaacgcgtacggtaggttaacacactaaagcgtgaaatggcttcgcgtttaggcggttgtacatgctcccgctgttaatttccccttagggcgtaggaattagaagccagggggacagccgaacgggacaagaacttggcctaataagggaccactttcaacggcctgggaatgacgac

SEQ ID NO: 718928 - DNA, 285 bp, Homo sapiens
aattagcttggcacaggtaaaaagaactttaattaaaaagtaaattgcagtttgagtgcacctggtaatgtgtgcaatggccttaagccaattaagaagaggtttcccttttatcctttccttcaccaggttgaatgtattgcttggcttttacagaaagaagaaagagaaaaagcaaaaagcgacaaggcatcttcataagagaccccacctcccgggtcaggagatgaggcgggatgtcaaggttgtgcgtcgcagcagccgggcctcctgtgcgcagctaat

SEQ ID NO: 718929 - DNA, 242 bp, Homo sapiens
tccttgcttttatttttattattgatttattcaacaagcatcgttattgaaaatttggtgcaaagtgggtcaaacaattttttctataggcctgaagacctgcattctgagatttctgactactagaattgttctgataaactttcattatgttcagtccagttgattgcattcattggacttcagccgcacaactttcactccttgtaggatgaaatgcgcagagtatagagagctaatgt

SEQ ID NO: 718930 - DNA, 236 bp, Homo sapiens
ctctgagctgccgtcagcaactgagtattcattcatgagcgctcaaccagcacatgggatgatcacgagaagacttgcgaggggaagtaatacatctctgcatcggatcctccaattatcctctgtttcgcttcaaagggttctctggggactccagagacggtaacacatttcggacgctccgggcccagcacctcatacacccagctcccgttaaggagaacgcgtcaaaatcg

SEQ ID NO: 718931 - DNA, 801 bp, Homo sapiens
gagtgaacaacaagtcttactgtaaagacatgagcacaaccccgtctctttgtctccgttgcgtcaagatcattcacttcttacaaagtctaaatgttgtttcacacatgaccatgtacagagagcaaacgcagagattcagagatgaaatcaaatatgggcaggagatccctaaaccaatacaagaccctaagaaccttggaacactaggggtaggcccctttcatcgcactattactagacttgtaatcaatcggcacaccgtttcctgtctcgtatggcggttatagtcttttgactaatgtattactacaagagattgattctcactataccggttatatgattaaccacgggtgtgatgctctcgtacacatctccccgatgctagtaatcacgtcatgaaactcagtcgccgattagtggcctgatttacgcatctggactcgccgaaagagggaaaacggagatctttctccattgcaaagaggttggatctgacgtatcttactaggcatatgggttcaacaggtttcctaaaaatccgtaaatattccagtattgtatagcttatcatgatccctattacatactaaacatgacagtttacatacctccattgactccagagacgacgtacaaaaattttgaacttcccctttgccttagaggggccggcgcattgtgaagcaccacgtaattcggaaggaaaaagccatggggccgtagatggggccggtaggggccaggcaaaggccttccaaaaaatgcaaaaggcaaagtttggggacacggtaagga

SEQ ID NO: 718932 - DNA, 764 bp, Homo sapiens
cgcagtggctcacacgtataatcccagcactttgggaggccaaggcgggtggatcacctgaggtcaggatttcaagaccagcctggccaatgtggtgaaaccccgtctctactaaaaatacaaaaatcagccaggtgcggtggcacacgcctatataatcccagctactcaggaagctgaggcaggagaatcgcttgaacttgggaggtggaggttgcaataagccaagactggcactactggcactccagcctgggcaacagagcaagattctggtctcaaaaaaaaaaaaatttaattggaaccacttgtttaaattgggccaacattgcccttttaaggggtgtccaccattcacttagtcaagggaaatggcagattattccactttggagatactactttccaacaattcaggagtggctaacctggaaagactggacaatttgaaggcaccagtccgtgcaaggctccttccatgtacgcgtaaaagggccacttgagacatttagaacgattaacttgccaaaaactcatagtctggaagggagacttaggcaagtgacagggtccagggtggaatcagggataaatatttagaatactaggcaaaacaagttcaactcagtcatcaggtccagggaaacacaactctgggtgctagacaacgtactcaaaattactacctaaattccagcgggtgaatcctacgcatatggccataagggcaaccttttacaggttatctaaaatttccattttaa

SEQ ID NO: 718933 - DNA, 422 bp, Homo sapiens
  misc_feature (410)..(410): n is a, c, g, or t
aagagggaatagggagtgaaagggaagtgagtgtggttactaagggcaacatgagggatccttgtggtgaagaaaatgttctatatcttgactatatcacgtgaatatcttggttctgatagtgtattatagtccaatttctccaaactacaagtaaatgtacaattatctcaaatggaaagttagttaataaaacattgtctattctactatttttcaacctctccttcctagagactgaaagaggactgcctgtttaaaaccttgaagctgatgggaggagggtactcctaagaacgtgcaaccacatgctggtcttcatgatgatttgcagccccaattcacaccacctggtggtaaaaaaaaaacaaaactccaagccaagaattaaattgaaaatggttctaaantagtgatattcc

SEQ ID NO: 718934 - DNA, 1342 bp, Homo sapiens
  misc_feature (510)..(510): n is a, c, g, or t
ggagagaactagtctcgagttttttttttatttttgggtaacggcagcactttaatttttccttacacaatgactttttgctggggcctaatgtcccacttacacagtaaaaacccaaaatttgtggtcatctcttcaaaaaatcgaaaattggcgtacaaaaaaacaccttcctataatttaagaatgatatcactatttcccgggcgtaacatgcaaaccgtttccaactcaaagcaggtacacagcccccggtgtacctggccaagcgactatcgagctaagaagggaaatctgggtgccctaccggtcttaggactcttatccacccctggacaagacccgcaaggatcaaaacaacttgggtcttcttggccagcctcttaagaagaaatccccaagaacacttcagcctctagacactgttaattccccaggggagaccccagttaatcttacaaataccgaaggggccaacaaatcccgcgcacaacacagtgcttcctccanacacttcccaggttggctgaggataatccgaagattacacaagcgttctcagaggggcagacaattatccctattatgcagaaagcggctaaactccccgaggtttcggtgagaaggcttacgcattgacgtgtgtagtcgcaatttgcgccacaggggcgacacaaattttttactaatttcttcacaaaatataagcgcccccagagtgcacgaggcaaagaatgtggctataagcagccattttggtggtcgtgtgaagactcccggtttataaggcaagggcgatttatgtgcaggggctggacaccagacattgcgacagtgggtccccccccaacattgtggattgtgagtagccctcccgatggcattatgacaacaactcccgacacttctgtgggcgttaccacactggcgtcgtgcgcaccacagtgcagcagcgccccagtagtaaatgagataccccacccacgcagcgaattacagaaccacgacgaagaggaatacacttagcgaccccccactgatggaccggagagtacggcacgagcagtcagacaatggatcgcgaaccgaccaccaacgacggagtgacctcagtagcgcgccccacacgggccagggggaacatactgcccgggttgtgagcaagctcccagagttcgacaacaaatcgcccgcgggagcaaaccaaacgggtcaggagtgaccgccgccgcacaacagcgacccacgaggatggagccgccacacagcggtcatcaacgacgcggaggacgactcccacacagcagaccgccactaccgaatacacaacgaacgttgaacg

SEQ ID NO: 718935 - DNA, 110 bp, Homo sapiens
cagagtttcgccatgcccgggcccaagaagcacttaagtcgtttttgcaccaccgagcattgaatcctttaaacactaacgggggtatttgcccctcttccatcgcaagt

SEQ ID NO: 718936 - DNA, 711 bp, Homo sapiens
atacaaataaaaaacaatacagtataacaactatttacatagcatttacatttattaggtatttttagtaacctagagaagatttaaagtatttgggaggatgtgcgtaggctgtatataactgccataccactttatataagcaacccaattttgatatccacagggggcctggaccaatcccctttggataccaaaggaccactgtgaatagaaactcgagcactcataagtgaagtagtgatggcagtagccagagcggtattaatattaggaatagtagtagcaatagtagttaccaactatgcccccaggtttactccaggctcatgcagagtttgatacctgcactgcctctcctaaggcttggcaggaattagtagtagtgacagtagtaacaggcttctattttttttttttttttttgttaaaaattgggaaactgaaagttataaaggttagaaaatggttttcaaatcaggcagttggtacattgggaggagtgtcgcattgggaccaatcccgtggactcttaaacactatgtctatcacagtttgtgaagatacacaggttagggagaggaagctaatggtcttaaagatagaggtgtacacatagtcatatgtgacgaaagactttttgagattaaccgataatatataaaggtagataattaaatcctgtatatacacagaatagatgctagaata

SEQ ID NO: 718937 - DNA, 955 bp, Homo sapiens
  misc_feature (955)..(955): n is a, c, g, or t
agcagtcagacagcgagggccggcggggcagggggacgccccgtcggggcacccccccggctctgagccgccgggggccggctcggcccggagcggaggaaggagtcgcctgaggagcagcctgaggccccagagtctgagacgagccgcgcgccccgccatgcggggaggagggggaggaggagcgggaggagggacgagcttgctcgggagacgagcgaacaagaacttttgagacttttcctgttgccgctgggagccgcgaggcgcggggacctctttggcgcagacgctgccccgcgaggagggcgggacttgtgggaccccagaccggcctccctttgccgccggggacgcttgctccctccctggcccctttaagcgaggggtgtcccatcgagggcggcaccccaaatttcggggaaccgaggcccttcgggagaggtcggccagaccaaccggggggctttccgctgcaaaaaggactttatccccacaaagaaccctcggagagggacaagccccgccttgaaacggccgggcccttcaatccccccgggcctttgttctcgtgtgaagccccacggcgcattccctatgaccccttttctccctcccgagggacgaacgagggatcatccatcttccgggaccctgtggccaacgagagattcccccgttaattttcacaggaaagcgcgcaccgcagccgtttttcttggcgtaccgccaaggaattcgggagcacacagatacataaggggtaaaatataccccgggtgcgaggactcacctgtaggagaaccacgcccccgaggttcgagagggcgttcacgccttcagcgaacgttgcggcccatttctaccctttaaaggacccctcacacgaggttttacccattccgaagacgcactatccatacctggtttcatggccgtaggaagagaccacgcn

SEQ ID NO: 718938 - DNA, 860 bp, Homo sapiens
ctagacagcgcttcagcattatgcttggaggccgtttcaaacagtgaaatcaacaacaagaagctcaaaactgcaaaagaagtggcactatagagaccatgagaagactggtttgcaggttgagagtaggaacaagaaggcagcgtggggccctgcatggcctccgctgggaggcgatggctcaaattgttgccctactctgcacatgttttcctgtgactgtgaaagcaacacgagtattgattcgggggttaaaaatacattttaacaagcagaaaagttcacaaatatgaaatagtggctagtgaggaccacccccatgctggagctgcagacagaggcttttgtgagtgcaaggcttgctcctatcccgggagcttctggttgccaccagcaccttgtaagccagggagtggtgtcacctgtactgtagcaaaagcaccttttctaaatgtgaagtatggcttgaagagaggaagatggaagatggctgtgttagggatgaagcaaggatgggggtggattgaccaagctgggccagaggtgcgaggagctgatctgcgagccctgtgtgcctgtgagtcctggcggagtggccgtgcgtggtgacagggaggaggcatccaggacagcacccacgttcccgcctgaggcacatgagggtggatgacagggttcggggccctagccttcaagtcagacacacctgagttcaaatccagactccaccactgactggctatgtagccttagacatgttccttcacttccctaagcgtccattttctcatgtccaatacatagattactatgccataggaatattaaatcactcagtgattttgaggttaaaaaaaaaa

SEQ ID NO: 718939 - DNA, 724 bp, Homo sapiens
ctagacagcgcttcagcattatgcttggaggccgtttcaaacagtgaaatcaacaacaagaagctcaaaactgcaaaagaagtggcactatagagaccatgagaagactggtttgcaggttgagagtaggaacaagaaggcagcgtggggccctgcatggcctccgctgggaggcgatggctcaaattgttgccctactctgcacatgttttcctgtgactgtgaaagcaacacgagtattgattcgggggttaaaaatacattttaacaagcagaaaagttcacaaatatgaaatagtggctagtgaggaccacccccatgctggagctgcagacagaggcttttgtgagtgcaaggcttgctcctatcccgggagcttctggttgccaccagcaccttgtaagccagggagtggtgtcacctgtactgtagcaaaagcaccttttctaaatgtgaagtatggcttgaagagaggagaggaggcatccaggacagcacccacgttcccgcctgaggcacatgagggtggatgacagggttcggggccctagccttcaagtcagacacacctgagttcaaatccagactccaccactgactggctatgtagccttagacatgttccttcacttccctaagcgtccattttctcatgtccaatacatagattactatgccataggaatattaaatcactcagtgattttgaggttaaaaaaaaaa

SEQ ID NO: 718940 - DNA, 426 bp, Homo sapiens
  misc_feature (31)..(31): n is a, c, g, or t
  misc_feature (34)..(34): n is a, c, g, or t
ttagagtagcaatcatatacatacaagtatnaancttgagtatttacaaatgtattcagcataaatgtaacagcaaggatgggggtggattgaccaagctgggccagaggtgcgaggagctgatctgcgagccctgtgtgcctgtgagtcctggcggagtggccgtgcgtggtgacagggaggaggcatccaggacagcacccacgttcccgcctgaggcacatgagggtggatgacagggttcggggccctagccttcaagtcagacacacctgagttcaaatccagactccaccactgactggctatgtagccttagacatgttccttcacttccctaagcgtccattttctcatgtccaatacatagattactatgccataggaatattaaatcactcagtgattttgaggttaaaaaaaaaa

SEQ ID NO: 718941 - DNA, 219 bp, Homo sapiens
atgacgacgacactgatggcggactttgtgggtagaaactaaccgaaggtgtggacgacagacgacaggagcatgtgtataattcagggcctaagacatgaagaggaacactaggagatggttctcacattgtccccaacaagacacaacaaacaactatgtcagggacctactcacgtaccctctgacatgacgagtcctatccactatccagtctac

SEQ ID NO: 718942 - DNA, 261 bp, Homo sapiens
aaaaaggtttccaaaaaaaaaactaatttttttttttatttaaaaaaatcccaattttttaaaatccccaattggggccccgggaaaattcctttccgggcctttttttgggggaaaaaagcccaggaaaaggattttttagggttttggaattttaggtttccacccgatttttttttgcaattttttgagcccgaaccccttttagaagggaaattaaaggctttaaaaggtaaaaaaaaaaaaaaattttttttttta

SEQ ID NO: 718943 - DNA, 112 bp, Homo sapiens
tgaaggtagggactgtttgtcttgggacttcgccgccagtccttagaacagtgtctgggccacagtgtgttctctcatatttgttgctggaatccttcaatgaactaaaaaa

SEQ ID NO: 718944 - DNA, 290 bp, Homo sapiens
tgctttggccttcaaaagtgctgggattacaggccagcccttctttttacgagacaggatctccccctttcacccagcgctaccaggctggtgtgcagtggccgtgatcatagcttactgcagcctcaaactcctgagctcaagcaatcctaccacctcaacctcccaagtatctgagattacaggtatgcaccaccatgcctgcctaattcttaaaatttttttagagatggggtctcactgtgttgcccaaattggtctcaaactcctggtctcaagtgatcctccca

SEQ ID NO: 718945 - DNA, 351 bp, Homo sapiens
  misc_feature (108)..(108): n is a, c, g, or t
  misc_feature (140)..(140): n is a, c, g, or t
  misc_feature (328)..(328): n is a, c, g, or t
  misc_feature (339)..(339): n is a, c, g, or t
ttacaaggtaaagctgcaagtggtgatttaaaagttgcagcaagtcatccataatctagctaaaatcattgatgaatctttagttgccacactcaacaacaggttatnaatatagatgaaatagccttctgctgtaagangatgccatctaagactttcatagctagagataagatatcaatgcctggcttcaaagcttaggctgactcatgagttagtggctaatgcagctggtaactttaaattgaagccattgctccatttacccttttgtaaatcataggtcccttaaggaattatgctggaatttaactctttcctatggtcncataaatgganacaaccaaagct

SEQ ID NO: 718946 - DNA, 493 bp, Homo sapiens
ggaatgactgcgcttcactagaacaacgtgtatacttcttatgtcgtgaaataccctcgagctgtttcccgagcatagaccactgtctttacagaacgaagcagagcggcgttcgttcctgatgtgacagacaagattctaggagtttggaaagggtgaagagactgggtcagcgaaaggaacattccggtctttatgttgggatgcaacgtatagatacatgggatgagagccaaaagagccggcagaggtttgtcatcgtgctcgcaaggaaactgccggtagctgatcccgtaaaggatacacatacctagagcggagcctaaagatgcatccagcatgacgggtggagccacgatgcttggactcgagctctgctcctgtgcgttccgtgatcaatggcttatactacctgcacctcagtttttcccgggcaaaaaaggaagcttgctgccggtgcgttggcacctgccttaaagtgccagctactcag

SEQ ID NO: 718947 - DNA, 309 bp, Homo sapiens
gttcgggaaggagttcagtggtcctatcatggctcattatagcctcaaactcccaggctcaagcaatcctaccatgtcagccttcccagtagctgggactacagctgcaggacaagttcgagcatcttaaaatgattcaacaggaggagataaggaagctcgaggaagagaaaaaacaactggaaagagaaatcatagatttttataaaatgaaagctgcctctgaagcactgcagactcagctgagcactgatacaaagaaagacaaacatcgtaagaagcaatagtttctcttactattctgagagc

SEQ ID NO: 718948 - DNA, 275 bp, Homo sapiens
gctcggcatcccaaagtgctgggattacaggcttgagccaccgcgcccggccaatttgtgtatttttttagtagagatttcactatgttggccaggctggtctcgaactcttgacctcaggcagtcctccttccttggcctcccaaagtgcttggattacaggcatgagccaccgtgcccggccctcagtttcctcatctaaaacagaggatttggtagtgctgacccctcagcgggctcctgggagagtccggtgagaaattgcacatcgacac

SEQ ID NO: 718949 - DNA, 166 bp, Homo sapiens
ctgagacagagtcttgcactctcgctcaggctggactgaaacaatcctcccacctgggcctcccaaagtgttgggattacaggcacctgccatcatgcccaactaattttagttattttagtagagtcacggtttcaccactcgtagttgtctttcgtttgttccg

SEQ ID NO: 718950 - DNA, 197 bp, Homo sapiens
atgatcagtgtgtcagcgtggggagcatttcaaatctgctagccatttgaagcttacattaagtatagtcaccgtactatgctatcaagcattaaaacttattccttctatctaactgtatgtgcgtatctacccattaacctaccttccttcatcgccccaccctgtacacccactacccagcctctggtaactat

SEQ ID NO: 718951 - DNA, 291 bp, Homo sapiens
acaaccatagctgggggcaattgcttaaagtcatttcgttcccgactagctgccttgcacattatcttcattttcctggaatttgatacagagagcaatttatagccaattgatagcttatgctgtttcaatgtaaattcgtggtacataacttaggaactgcctcttctttttctttgaaaacctacttataactgttgctactaagaatgtgtatctgtcccggacaacttgtccccatacagttgggttctaaccctcatgcttggcccaaccaaactctctacttat

SEQ ID NO: 718952 - DNA, 647 bp, Homo sapiens
  misc_feature (269)..(269): n is a, c, g, or t
  misc_feature (295)..(295): n is a, c, g, or t
cccggaaaccagttgtttgggcaggatagatgtgagtcctccgggggtgtccagggcaaagggtacaaagggggtaccagtggtgggccacaaaaaaattgcccccaagacccacagggccctggcaaaaggggcctggatggggcaaggcatctgctccgtgtagctttttctgtgggcgcggtgggggagaaagggttcatccccgcctttaggtcacacaaaaaatttattagattggcccggggtcctcttcaagggcgggaaantggtcaagaacaatgcctcccctggntattacctattttcaaaaaggaacaaccccctgggggggtttggcccctatggggaagggacccaaaactttgtccttcttaaagggtgggtgggggggaccaaaaaagggggggtccccccccccaagtcccttttggggcaaaaaaaaaggcggggtttggagaaaaaatgaccttaaggttatttaccccccccccaaggttgggcctgggcggtttccgaccctgggggggaaaaaagcctttttggggccccttaaaaaaggccgaattgccaaggaaaaagggggtttatgcccgggaccaatttttccggggggggggggtccaaaaaaggtttttttccctgga

SEQ ID NO: 718953 - DNA, 265 bp, Homo sapiens
ggacctggacatcagctgcaaacacccggccacgcactgcacatctgcgaactatcatcttgaagagactgttcctgtttcaacagcatcaccgctaccacgcagtttctgtgaactcagctgagtttttatccaattgaaatagtaatttatgtccttgccttttcccggttcttttccccaagctgctaacttggcaataattcttgctgccatatgaacagtgaagggatcctggcgattcaacataggcagaagcaggaag

SEQ ID NO: 718954 - DNA, 941 bp, Homo sapiens
gatggcgactggcgtactcggcttggagactggcgcggacgtcgtgtccgtagttctctgaaacgggtcacgtagtttcccggtagttcaggctgctcatgaatagaacagcaatgagagccagacagaaggactttgaaaattcagtgaatcaagtgatactcttgaaaaaggatccagagaaacgaagtgaagcataaggaactctacgcgctatataagcaggtccactgaaggaccttgtaacatgcccaaatccaggtgtatttgacttgatcaacaaggcaaatgggaggcatggagatgcccttgcgcaggctgcccaaggaagctgccacggcagaacttatgtggatttggtgtccagagtatgagtccttcattggaatcctctagtcaggtggagcctggaacagacaggaatatgcacactgggtttgaacaactctggtgtgtgacctccgaagatggcatcactaaaggatcatgtaacacatcgcggcccatatgagaaaaatgccataaacactgagatgtatcatgaaattatgcgtgcacttaatagctgccagcaaggatgagtcaggcatcactgtgttagctaggaaatggtgactattacagtagtgggaatggtctgactaacttcacttgatattacccctggtggagtatgagcgaagagagctcacgcaaatcaatgtcggtttgactgctggcactccggcggggggtgttcatgagatcagagtaaacctcctgatgtgtcgcgggcaaaggggtccaatcgcggggatatcatccctactctacctggcttatggatgcgtggcttccatcggcggggcggccttcaatacgcatgtaaacctagagccaactggaaggagtcctgcaacctttcctgataaagccaccggccccatgtatttggaaacacg

SEQ ID NO: 718955 - DNA, 316 bp, Homo sapiens
gggaggggcaatagtcctggtgaagaggaggggggagcggcaccagctggagtggggcctctgccgctgcctcttcctgctgtggtttctccggcttagactgcccctctcacctggcttgtctgtggggagatctttgttctctggctgcttttaagactttctccttaacagtggtttcagcaattcgattgaggcaaaaaggagctgcagaagccatgtctgtagcatttgtggcctccccttctgtataatagcagccatgttttggcctctgcagggctaaggtcctctgagcagctgcttctccacatct

SEQ ID NO: 718956 - DNA, 189 bp, Homo sapiens
atcagttacacacactctgtcgagacgtaaattacggatgagattattcgcatatctacatgcaaacggagcatccatgctctctatttgcctattcatccacgtaggccgaggcatatactacggactcctatactattcctagaacacactgaaaccacttggacgtacgtcctaactaattatacc

SEQ ID NO: 718957 - DNA, 387 bp, Homo sapiens
aaccaaatagacaagccacacaatgatccatgcaagaagacagcccgatacgaatatgaaatggaagacaacaaccatacaaccaaggtaaaaataatagtatagacacatgtactaataaaatactcaagagaatggaaacgataataaacacccagaccgagaatacactgccacctggtcaatttaccaagaccaccttttataccatttgtaaaacctacagctacctacccccgcctctgaaagagactgtattcccaagtctccctacagagttcctgccacctcgtcaagacccacaccagagtctccgtcaacggactcaggctccagctgtggcacaacatagggtttttaacaagaaaaataaagtgaataagcgtg

SEQ ID NO: 718958 - DNA, 695 bp, Homo sapiens
tatggaaaaaatggtattcaaaaccaagattgggcttccagcctgggcaacagggcaaagccccatctctacaaaaaatataaaaattagccaagtgcagtggtgcgtgcctgtggtcccagctacttggggaggctgaggtgggaggatcgcctgagccttaggaggtcgaggcctcagtgagctgtgatcgcaccactgaactccagcctgggtaacagagtgagaccctgtctcaaaaaaaaagatctgagcttgaggggtgctaatgctactgaggtgtcaggtgacatttatttcaggctttctcagctgacagagcaaacagatatatgtgggtatactaacctatgtaaatacacatatctataaatatttctgtatgtcgtaatctgtatctgtgttgagttaaacatgaattcttactgatttcttgagctctgatccattattacatagatcattctaaaccctgtcccttatgtgatctggaaaatctccactccagcaattgagaatcttttaggccgggcgcggtggtcatgcctgtaaatcccagcactttggaggtggatgcaggcagatccacgaggtcaggagatcgaagaccatccctggtaacatggtgaaatcccgtctctactaaaggtgcacaaaaattatctggtgtggtggcggtgctgtgggcccaggaa

SEQ ID NO: 718959 - DNA, 216 bp, Homo sapiens
tttgtggtcgctaggtggatggcgagccgggcagagatgctcctcacctgtacattactgggcaggcaggcagagggactcctcactgtcccagtgcgatgggcggacaggcagagacgctcctcacttcccagacggggtggcggccgggcagaggctgcactctcagcactttgggaggccaaggcaggtggctagataacggttgagcggaga

SEQ ID NO: 718960 - DNA, 928 bp, Homo sapiens
  misc_feature (810)..(810): n is a, c, g, or t
tatgaagtgtttgacttcacttataaaccttctggaatgtgtggttctaggaaggaaaagaaagtttgccagaattttctcatcccaggatttcctgtgtgtgcttccgtgtcagtaatatagactcagtgctcaccctcgtcatctctagagccagatcggatttaaatgttctggatcatccttgtacttaggaaatgggaaatgccaatagtgttttataatctatacatggctcagtgtctccactgcaaaatcaaagggactaggagcaaatttcccagtgatggcaggaattttataggaatgctgaagttttacaaaggatcctgcctttcagagtgtaagcagacagtaacagtaatgagctgctactgtcctgtcacactagcttgggatctttgtcagagctataatttgattcattgggctttataataattgaagcattaatgtatatctgtactttcagaatttacgtaagcttctggattttctgaatatagttctatgtgtctcttccggttgttaccatggtatttttagcataagggcgtacatttgtgagcaccaaggtgtaaaaatgagccctgagtacagtaagtggtgggctgggcgtggaggtacacactgtactctcagtcttggagggtgaggcgtgttatgaatgggacggccatctaggtattggtggcttgccggaggggtcatcatccccggtaagggggtgacacagaacgggtgcgtgagaacccctggaaaggggaacgccaactttgtgggcgccccttctagccaagggctattaangcggcaaagagcgccacagcaaaaccaggaagggaaccgtccgcaaagaaaaaggccacaaaacacacacgaagagacgcaaaaaaacccaggaaacgagcacgatcaacaacacccg

SEQ ID NO: 718961 - DNA, 189 bp, Homo sapiens
tccaggttacgtgatctcctacctcagcagccgagtaactgggactacagacatgccccaccacgcacggtaatttgtatttttagtagagatggcgtttcaccatgttgaccaggctggtctcaaacccctgacctcaagtgatccatctgcctcggcctcccaaagtgctaggatacagtagggaga

SEQ ID NO: 718962 - DNA, 118 bp, Homo sapiens
tgtatcactgaagtctgaggtttcaaaagtgattttttgtcccacaagaagtttcaagcacttaagctagaactttcagtgttaactttgccctaaagaagttaagacattctgtata

SEQ ID NO: 718963 - DNA, 114 bp, Homo sapiens
caagacgatcccggccgtgaactcgaagaccggcaccttaacggtttcactggtgaacaccaaaacgcggtggttcgccgacgagatgccatgcttcgccaaatcgctccgcaa

SEQ ID NO: 718964 - DNA, 468 bp, Homo sapiens
aagagcatgtgtaaggatgtagactcgggagaaagcacgacatggttagtgaatgacaaggacagtgcgcagaagtgaatgagcccagtttggaaagataggttgcaataataatgagaagactcttttgggtcaaatgaaagcacttgaacttgttcacaggtaggtgggcagttttgctctggtgaaggcttctaaacagtagtgagcagactcagggtcattttgggaaaatctaatgttcgtcagccgttggcaaagcttctgcccttgaggctgggcccactttcttagactttgaggagagattgaacatggaaatcacggctgcaccagtctcctgtctagaaaaaacatctagacttctgtttagaaaaaacagctagttgcatctgcagcttcctgaagctcttcattcctgaatatgaaattctatatgtctgcccgggcatttttatagcactgaaa

SEQ ID NO: 718965 - DNA, 583 bp, Homo sapiens
  misc_feature (6)..(6): n is a, c, g, or t
  misc_feature (121)..(121): n is a, c, g, or t
  misc_feature (318)..(318): n is a, c, g, or t
  misc_feature (356)..(356): n is a, c, g, or t
  misc_feature (373)..(373): n is a, c, g, or t
  misc_feature (375)..(375): n is a, c, g, or t
  misc_feature (382)..(382): n is a, c, g, or t
  misc_feature (387)..(387): n is a, c, g, or t
  misc_feature (438)..(438): n is a, c, g, or t
  misc_feature (455)..(455): n is a, c, g, or t
  misc_feature (463)..(463): n is a, c, g, or t
  misc_feature (486)..(486): n is a, c, g, or t
  misc_feature (505)..(505): n is a, c, g, or t
  misc_feature (522)..(522): n is a, c, g, or t
  misc_feature (550)..(550): n is a, c, g, or t
tttttnttgcttttgaaggtttccctagagcagacatcattctattgcacagatgtgtcattttggcattatagaaagttgcagttaaaaacgctttctccaaaataaaaagacaaatganatacccagcatatacagttgaaggcaaaggagggcaggctttagagggatggggtccattgcttttgctgtgcatcacccttgattagcagttacattttggtagtacttcttacccccaatttctagaaatccttttcaaaatccaagatcaagtggggccccaatcatttcaggggaatcaaccccttcaaggcngcctgattcaaagaaggactgaacccattactggctgnattaggatagctgcagngngctgggngctgncccaacacttgttggagcaagccctgtttgtcttaaagcaaggcgggtggnattccaaatgctggagnggggcatnccgtgggttcccccattcttcangctttgtaaaccccggtgnccggccccccctgtggngacctgcccgcttggccgacggcttctngtcctttcttaagggtttcttcaaccccttttt

SEQ ID NO: 718966 - DNA, 161 bp, Homo sapiens
  misc_feature (16)..(16): n is a, c, g, or t
  misc_feature (57)..(57): n is a, c, g, or t
  misc_feature (80)..(80): n is a, c, g, or t
  misc_feature (86)..(86): n is a, c, g, or t
aaggagcttgccgaanagtgagaaaagcctgccaagtaaagcagcaggtatacaaanaggtagtcatttcggcactcaanagatgncactaatttggcagctcctattcactgaggaaaacgccatacactgaggcagaaactgagtcaggtggaggaaat

SEQ ID NO: 718967 - DNA, 295 bp, Homo sapiens
ctgggtactctaaggatcttagccgaatgtcgcgtcatgtggaagcggcgtcagctgcgcggcgcgagaaggttgcacgcatccggtcagatcatccgacagcgaactgcgaagaaacgtgacttgggattcgctgtgcgcatcccggtttcgccggaagtcgaccgtatcaagtcgctgctgcgcaaaccacaatgtttgcacacgcgtatgcgaagaagcctcctgcccgaacctgggcgagtgcttcttctgggcgcgcacccgccacgttcatgatcatgggtgacatctg

SEQ ID NO: 718968 - DNA, 121 bp, Homo sapiens
tctcagaatcctgatccagccttccctagctcagtaaagggcactcccttcttccagtgttcaggaaaagtatcttgaagtcatacttaagtttttctcaacctgtgggtagtcccggttc

SEQ ID NO: 718969 - DNA, 531 bp, Homo sapiens
aaagctctacatctgattgcatgttttaatgagtctgaatcgttcatgaaggggaaatatattatttttttttcccaatgactcccagtctactcgcaaacaaataccattgtagaaaaacagtttatttgctggttatagtttgaatcttgaaatacaattcttcactgatgatactggtataaacatggtggttattaattcatgctagcacaaccaaaactaatttaaccattattggtaaaaatgagtcatttttgaatctctattaaaatctgaaacacataaacaaatctgtgctaaaactgggactggcttctcactctacatataattaaacttccagcttcaaccatctgatgttgaaatctaaaggacctccatgagttaaatgtccccgacaaaccatgtagatggacaaacaagattggtggtctttaattgctggcgacagaaaaggctgcagtttagtacttaaacctgcagttagtggtcaactttctatccaggcagagtaaactaaggagagct

SEQ ID NO: 718970 - DNA, 127 bp, Homo sapiens
cgtagattgtttatagttgactcatagaggatcccgaattacgctcctacacgcacgcgagaggaagtgaaagaaacgcatgctggctgcgtgttacccaagctggtcatccgcgtgcctccaggta

SEQ ID NO: 718971 - DNA, 445 bp, Homo sapiens
agtggtcattgctgctctccgtcctgagcgtcgtgcatctcttcaccaaacatctgcggctgtgggtggcggaagcgctctgaaggaagagggctcctggctgggttggtagggagctggagggtgctgggggcccccgcggcgcgcgtccctgatgagcttcccgcgtgttggagtcgtagatccgaaactcggggccacggtgggtcttgggaagaaccggcatcgggtggaacaaggcggtggggggcacagcctcccggtcgggacagggcgcacggctgtactccctctgtgccttggtgtgatcgtccctgagcgggaagagctgctcctccaacttgtcccagcgctccaggcaggtccacagccagtcagggttgaccacgtgcaggtgtccgcactcctgtgccttgcgcaccttctctgtgcccgctcgcgcggg

SEQ ID NO: 718972 - DNA, 111 bp, Homo sapiens
tgctagctgactatttagttgaaatagaagagcccgttgtagtagtatgtcaccattggaacagattgaccggtatgtaccgaatccaacagaggtggtgcacacagtaaa

SEQ ID NO: 718973 - DNA, 172 bp, Homo sapiens
  misc_feature (129)..(129): n is a, c, g, or t
  misc_feature (139)..(139): n is a, c, g, or t
gatcaagacatactcatccagtatgaccggacctggctggtagctgaccctacgtcgctgcgagtccaaaaagttggaggccagtgccgcgctcgtaccagaaatcctaccgataagccatcgtgactnaaactcactngtataataaacagttttgagggatttaaagttc

SEQ ID NO: 718974 - DNA, 1001 bp, Homo sapiens
gcgaggcaggcggatcacttgaggtcaggagtttgagaccagcctggccaacatggtgaaaccccatctctactaaaactacaaaaattagctgggtgtggtggtgtgcgcctgtagtcccagctactcaggaggctaaggtatgataatgcttgaacccgggaggcggagcttgcagtgagcgaagatcatgccactgcactccagcctgggtaacagagtgagatcctgtctcacaaaaaaaataaagggaatgtggaaaagagggacaggggagaagggacacgaatggagaagggaagctaaacagacacgactggacgcaaggcaagagttggcgacggccagccgcaggacagggtacccaaaacatttcggaacacggacaggtccccgcttcccaactggcgtatttgaccaagctaaagcaatttatagaaggcaatacccacgagataactcacgaagcccggacagggaaaaatggcagggcatacacgaaatggcccggggcggacgggtgtccacaaactggcaacggaaatcccaaaagcccactaccaagaagtcacaactaacgatggaagaaacacagcagaattggggagcagggatccaagattctacatggtccccactggacctcaacccaccatggaggccctaaacggatacacaacggggcgacaaactctagccgaaaaacacgccccttaggcgacagacaactaccggagtcccaaaactccacaccactggcccatcgggagacataacccaagggaaacggacgggcacagggccaataacacacacaggaaacaaggaagcgaccgacagcagcaacagcacgccgacagaaaggacgaacaaacgagacacacccacagccagcagacgccaaacacagaacaaacgccaacacaccaagacaacccgcaacacccacagcaaagcaaaaaacgcacaaccacgacccgacgcagaaacaccccagacaa

SEQ ID NO: 718975 - DNA, 2773 bp, Homo sapiens
aggaagcagacctgcgacgggaccgaggaatggaggggtggtcgggtgtgtggatggccagagtgacagcttagggagaagccggatgtggaaggggaggaactgtgtggtatgcccaggcccctgggcccagccctggcttggcagcccttgctccctgctgagggccctgcctttccttcccctgaaacagctcccggagccctgcctgttccctgtccatccaggccagcagctgaaggagcctcacctgcctcccttctctgagtagcacggatttgaggagaagcagcgaagatgtccagcgagcctccccctccttatcctgggggccccacagccccacttctggaagagaaaagtggagccccgcccaccccaggccgttcctccccagctgtgatgcagccccctccaggcatgccactgccccctgcggacattggccccccaccctatgagccgccgggtcacccaatgccccagcctggcttcatcccaccacacatgagtgcagatggcacctacatgcctccgggtttctaccctcctccaggcccccacccacccatgggctactaccccccagggccctacacgccagggccctaccctggccctgggggccacacagccacagtcctggtcccttcaggagctgccaccacggtgacagtgctgcagggagagatctttgagggagcgcctgtgcagacggtgtgtccccactgccagcaggccatcaccaccaagatctcctacgagattggcttgatgaatttcgtgctgggtttcttctgttgcttcatgggatgtgatctgggctgctgcctgatcccctgcctcatcaatgacttcaaggatgtgacgcacacatgccccagctgcaaagctacatctacacgtacaagcgcctgtgctaacggagctgggactcgggactcccccgcctgtcagtctggccccctgtgctttgctccctgcgctcagtggtcactttcccgctcccacttggggctgggagccgtgccaccatcccctagaagtcctgtcctcttcaccctgccctacctgagccgctgactcttctggcaaaaattctgttgggatttaaggccaagggtcagtgggtggcagggggctggcaatgagcttgtgtgttgttggtctgcttggtgtgtgtgatcgggaagataagctgggaggggtctcctgctggggtcctgatgcctctgtttccaaacaaggtacaggttcagtccagactctttccccctgggaccaacagcagccagagcagttagccagttagtccccaggcctgtggcacaggcgtttctgacctgctgggccgagaatgggtaagttgtctggagtcaggtgggcccacgtaggacagggtcacaaagcctgggtttgtttctgggtactttgcgcctctggggtgctagaggtggggcatggtggctggaagtaaaactgccaactctggccctcagaactctcaggtatagaagcccaggatgtctaataccctgtcccagtgcccgagagctgcctggtgtcaggtagagaggacactgtacctgggtgaatgatcagaccctggtagctaagaaggaacttgtccctttgagtcagtgtgcagaccccctttcaggccatgcgtctgtgaaccctgtattgctggggccggaaggagcccgtgagcctagccccttcccgtctgccctgtgtcctcactgcgtgtgggtatgacctctgcctggtggctggtgtatcccaactggggaagagatggcagagggtcccccttgtgggtgcgcttggatgtgcagagccttctccatggattttcttccctgtaagtgccgggcccctcaccccagctgacaggctgttgctgtgcctgctcacacctgctcctgcaggcacactgggctagggacgaggaaggagcagccacaagtggtagaactgccttggtggacaccagcctcgccctgtctttatttcctgaatggtttgtgaacttgctcacctggaccactgtatcctgccactgtccttcctggtctcgcactgccactgcatggcctcctgtcactgtgaatcgtggcccagtctcagtttgtagtttctcattaaattggccctttcactcccccttggccctttcactcccccgccctgggcctctgctctcttgcctggcttccttcttttttgagggaaagagggtggggctgcaggcagtctactggcaggacgggaggctgagtcctcagggtctcacaccctcagtgctgatgccatgccaactgcctgggacaacaccaacacgtaaggacctaattaaaccaaaccagagtcgggtgtagaccagccctgggatttccagctgtgactgggccagggcacacgttggtctcggcagtggctgtaaggtcaccttccttcctctgatgctggtttcaaccatctatatatggcatccacgcatgggatctgcaagctggagccctcctacccgcaggcttgagcacagcatcatccagccctggggaggcgcacccttaagcaagacagactgggctgaggctgacaggcagaagactaacagagcgcagtctgcacacgcaggttctgggcgacctctggccctggccatctctgcactaactcatctgaattatgaaggtggcagtcttggtcagtagtttaaagagtttccctactttttaaccctttttgaaataaaacttttacaggt

SEQ ID NO: 718976 - DNA, 186 bp, Homo sapiens
agcgagggaacagagtgaaaccttgtttccggcaaatcaaaagaggacaaaacaaatcaaaacaaacttcagaaattttttggaaatgcaaagagcctcctgaactctgtaacaggaaatgggaatttggcctttaaccacatgaggacaaattaaagttagtgcgcctccccaagttacccatat

SEQ ID NO: 718977 - DNA, 266 bp, Homo sapiens
ccgtgggtcggtgtactcgtggggggggtaccattggggggcacgttgattggatggtgagggagggatcgttgagctcgttagtcatgtagaggatgcgtagggatgggagggcaatgaggactaggatgatggcgggcatgatagttcaaacggtctctatatcctggggcgtctgagatgttagtattagttagttttgtttgtgagtgtcagagaaaagggcatacaggactaggaagatagataaggaaaatgattatgac

SEQ ID NO: 718978 - DNA, 104 bp, Homo sapiens
cttgggtgggaggattgcttgggcccgggaggtctaggttgcagtgagccatggtggtgccactatactcagcttgggtgattgattgagaccctgtctcaagt

SEQ ID NO: 718979 - DNA, 111 bp, Homo sapiens
ctaccgtggttattggagctccatcagtacaggagcttaccaacgtggacggtcaagccagtgcctgcatctccccgatccgaagacacacggtgtctgcccttggtgcaa

SEQ ID NO: 718980 - DNA, 924 bp, Homo sapiens
gacaaatctgatgttaatgttgctcttagaagtcatactccatggtcttcaaagaccaaaaaatgaggtttgctttgtaatcaggaaaaaaaaaaattaatgaaccttaaaaaaaaaaaaaaagggtttggaagggaaaaaaagggggttccacctctggttatccttaaagtcacttcagggcctgttggaatgtggcaggttacaagcgagagagaatggtctttcattgtgaagagtgtgggccttgtgtgaaagggagatgtgcgtgtgggaatctgctttccaagccgccagggtcctgacggcagcaggagaaccctgtggtgggtcttcggggaaagcctgaccgtgtgttcggacggactggctctttccggaagttctcagtaatggagcccagagtaactggccaccgccttggtggcagctcggggagctccaccaaactctcgggcctggccagttctcaagcgagctaatctggccataaatcggataaaagcaaaactcccgaagtgaggacctagtaacttggctctcaacattttaaaatattggcaagtggcctctagtgaatggggcgtaaggggcctgtctctgcaccggtgtgtccatctgcttgcagtattctcacccatgtggaatgcctgctgctggttaaccctgtggaaaccctgggggtgaccaagggtgggaaaggccaccttgaagaccactctcataagcagggaagggcttaagccaggttcactacaaacagaagatggggactggccctggcccctccagccgagatgacctattaactccccaggccaggtccccactaaggcaaaccaaacgtcaaggatttgacctgatccgaaccgtaccactcaagaactggccgccagtggggaggttgcccacttccattaaggg

SEQ ID NO: 718981 - DNA, 219 bp, Homo sapiens
ctcagactatcagagtgatttttcacatcagccacaagaatgacctgtccggcgtacaagacacttcttaccatgtaatgcaagggagaaaaaagctcaggtacttcaataagatgtaggaaaagaagacttccactctaataggatgaaaagatgatcatttatttacatcattctggtttcttttaattgcttcacaatccactataaagaagattc

SEQ ID NO: 718982 - DNA, 162 bp, Homo sapiens
cataggctgggcccagattagatgtaacagcttaaggcaagctgatcttaacctgctgatcaagaccaggatcaaacccctatccttctggacactgtgttgcatccttaacctgctgagccacaacgggaagtccatgttacagcttcttgtcactgagtg

SEQ ID NO: 718983 - DNA, 176 bp, Homo sapiens
aacgaaaagcatgtctatatcaaccaacacctaaactggggtccgatgagcgtcgagaatcgaggcgcctataagacacggcgatgcggattcatacccgcagacgccagatactgcattaccaaaagtggaccactaggcactcgaataccacgcccggctccacgccagcgagc

SEQ ID NO: 718984 - DNA, 945 bp, Homo sapiens
ctacaacacaagagccagccatgtggattactaaaagatgttggcttagtacaagaggaagtagatgtggcagtcataactgccgcagaatgtttaacagaagagggccagacaagtgctttgacctgcagccttccgacaaaactgcaagatttatgcttaaatgattcaaattcaagagcatgacaacactttcaacacttacctgacttttcctttcaggacagactaagcactgttactaaaacaatctgcacaagcaagcactcaaacaacgtttagacccttaaggataatgatgtaatccaagattcctcttcagctttacatgtatccagtaaagatgtgccgtcctcattgtcctgtcttcctgcgtctgggtctatgtgtggatcattcatcgaaagtaaagcacggggtgatctcccctacctcagcatgaacattaaccgatcatatacaagatgcagtgactatacatgaagaaatacagaacagtgttgttctaccgtggggaaccattcaaagagaatgatcttttgaaccaggaaaaatgtccacgcatactccttcagtcattaacttgcacgcggattggacacaccaagaaacgcatagattcctgcacccacacacgtcactcaccacctgagtccactggactggccgggcgacaccacgcccctacagcagccgcactcctcacacaagaggcctacttaccttggggaccacctccacatggttcccccaagaagactcaactcctcgcaaacatcggtcgcatcgaaacccggataccaactacactcacaccgactaacacacgacccaatcccaacatcagagcatcagtgcacccacagcactcaagaactaatccacatcagacaactcaaactacagtacacagagggacccaccacacaggcaaccccaccaata

SEQ ID NO: 718985 - DNA, 319 bp, Homo sapiens
  misc_feature (54)..(54): n is a, c, g, or t
  misc_feature (62)..(62): n is a, c, g, or t
  misc_feature (144)..(144): n is a, c, g, or t
  misc_feature (146)..(146): n is a, c, g, or t
  misc_feature (169)..(169): n is a, c, g, or t
  misc_feature (268)..(268): n is a, c, g, or t
gcctcggctcctgagtagcttggactatgggcaatcaccaccatgtccagctantttttttngtatttttagtagatatgggggtttcaccatgttggccagactggtctcaaactcctgacctcaggtgatcccaaggtgctngnattgcagacatgagccaccacgnctggcctagaaaattatttatcttgggcattgattaaattgcatttctagacactcgccgtcagtagactaaaagatttttttcccctctgaataaganaaccgttcgttcaaggatctcaatattaattaatttttggcaaaacatccc

SEQ ID NO: 718986 - DNA, 109 bp, Homo sapiens
aaggatcccctccaagatgcgggagaagtggcaggacgaggcggcagtgagtgtcggctctgggacccctccccaggccccctgaccggaagccgctgtcggcctcctg

SEQ ID NO: 718987 - DNA, 663 bp, Homo sapiens
  misc_feature (4)..(4): n is a, c, g, or t
  misc_feature (100)..(100): n is a, c, g, or t
  misc_feature (178)..(178): n is a, c, g, or t
  misc_feature (180)..(180): n is a, c, g, or t
  misc_feature (183)..(183): n is a, c, g, or t
  misc_feature (185)..(188): n is a, c, g, or t
  misc_feature (232)..(232): n is a, c, g, or t
  misc_feature (239)..(239): n is a, c, g, or t
  misc_feature (241)..(242): n is a, c, g, or t
  misc_feature (356)..(356): n is a, c, g, or t
  misc_feature (359)..(359): n is a, c, g, or t
  misc_feature (400)..(401): n is a, c, g, or t
  misc_feature (404)..(404): n is a, c, g, or t
  misc_feature (411)..(411): n is a, c, g, or t
  misc_feature (417)..(417): n is a, c, g, or t
  misc_feature (424)..(424): n is a, c, g, or t
  misc_feature (429)..(429): n is a, c, g, or t
  misc_feature (431)..(431): n is a, c, g, or t
  misc_feature (442)..(442): n is a, c, g, or t
  misc_feature (470)..(470): n is a, c, g, or t
  misc_feature (473)..(473): n is a, c, g, or t
  misc_feature (478)..(478): n is a, c, g, or t
  misc_feature (483)..(483): n is a, c, g, or t
  misc_feature (496)..(496): n is a, c, g, or t
  misc_feature (499)..(499): n is a, c, g, or t
agcngggacacccagttaaactgctcgttcagctgctccagcaaggaggaggtgttgagcatcttccactggtaggactttagcagctcgttttattttntggttaacctcttagcgacctggagggattcgtcgagctcccgccgcagcttagcctgggaggggttgttggtggaanantcnannnncaagatctcccggcacttgtcacactggtccttcatccgcagtnagcccgngnnttgtggcggatctcccggcacacagtccggtcatcgtcgccttctcgtatgaattctgttggcgggtgctggaaggccgggctgtggaagtggatgtccatggcctgctgagcntcntgtatgatctcgaggaagggctggaacatggcgtggaagtnnagnggctcgnacgganagaaggncatcnanctgcggacgangcgggacttgggaaaaaaagtgaggctncgntgggncagantaaggcagtagtngtngtatcctgaggctacccggctgtagaaccagtcctggaagagatggtctatgatgtctgaacgcccggaagaagtggtcagcaatacaaccagatgcgcgtatgttgccgtatcgttctacaagacagagcagatcgaggacgatcactcatgtgatcgcagaa

SEQ ID NO: 718988 - DNA, 1065 bp, Homo sapiens
  misc_feature (77)..(77): n is a, c, g, or t
  misc_feature (80)..(80): n is a, c, g, or t
  misc_feature (111)..(111): n is a, c, g, or t
  misc_feature (113)..(113): n is a, c, g, or t
  misc_feature (134)..(134): n is a, c, g, or t
  misc_feature (147)..(147): n is a, c, g, or t
  misc_feature (158)..(158): n is a, c, g, or t
  misc_feature (215)..(215): n is a, c, g, or t
  misc_feature (223)..(223): n is a, c, g, or t
  misc_feature (244)..(244): n is a, c, g, or t
  misc_feature (250)..(250): n is a, c, g, or t
  misc_feature (257)..(257): n is a, c, g, or t
  misc_feature (465)..(465): n is a, c, g, or t
  misc_feature (468)..(468): n is a, c, g, or t
  misc_feature (470)..(470): n is a, c, g, or t
  misc_feature (475)..(476): n is a, c, g, or t
  misc_feature (479)..(479): n is a, c, g, or t
  misc_feature (532)..(532): n is a, c, g, or t
  misc_feature (535)..(535): n is a, c, g, or t
  misc_feature (552)..(552): n is a, c, g, or t
  misc_feature (603)..(603): n is a, c, g, or t
  misc_feature (677)..(677): n is a, c, g, or t
  misc_feature (709)..(709): n is a, c, g, or t
  misc_feature (718)..(718): n is a, c, g, or t
  misc_feature (724)..(724): n is a, c, g, or t
  misc_feature (733)..(733): n is a, c, g, or t
  misc_feature (741)..(742): n is a, c, g, or t
  misc_feature (779)..(779): n is a, c, g, or t
  misc_feature (789)..(790): n is a, c, g, or t
  misc_feature (793)..(793): n is a, c, g, or t
  misc_feature (828)..(828): n is a, c, g, or t
  misc_feature (840)..(840): n is a, c, g, or t
  misc_feature (902)..(903): n is a, c, g, or t
  misc_feature (913)..(913): n is a, c, g, or t
  misc_feature (915)..(915): n is a, c, g, or t
  misc_feature (917)..(917): n is a, c, g, or t
  misc_feature (919)..(922): n is a, c, g, or t
  misc_feature (929)..(930): n is a, c, g, or t
  misc_feature (942)..(943): n is a, c, g, or t
  misc_feature (946)..(946): n is a, c, g, or t
  misc_feature (960)..(963): n is a, c, g, or t
  misc_feature (966)..(966): n is a, c, g, or t
  misc_feature (976)..(976): n is a, c, g, or t
  misc_feature (978)..(978): n is a, c, g, or t
  misc_feature (988)..(988): n is a, c, g, or t
  misc_feature (990)..(990): n is a, c, g, or t
  misc_feature (992)..(992): n is a, c, g, or t
  misc_feature (1004)..(1004): n is a, c, g, or t
  misc_feature (1056)..(1056): n is a, c, g, or t
gggcccaggaggagggggaataaagaaggtggaggatcctggctaccactctgaatccgataccgcttctcttaganctnagcgacagaaaaagggaagggtgtctcatcncncttcctcctctcctccctgtnctgagccttagcnatggccgaggnaggggctgggctgagcgagaccgtcactgagacaacggttaccgtgacaaccgagcncgagaacnggagccttaccatcaaacttnggaaanggaagcnagagaaaaaggtagaatggacaagtgacactgtggacaatgaacacatgggccgccgctcatccaaatgctgctgtatttatgagaaacctcgggcctttggcgagagctccacggaaagtgatgaggaggaagaagagggctgtggtcatacacactgtgtacgtggccaccgcaaaggacggcgtcgtgcaaccctaggaccgagnccnanactannccntccgcagcctcctgacccttccgcagccccctccagggccaatgcagcactanatnccctctctcctccagcnttcctgtgtctgtctggccctaaagtgtatccatgtggctacttctccagncccctccttccctctcttctgcctgatagagggaagaggaagaggaggacgaacagagatcctgaaattctganttgcgctattccagaacccagcctcctgggtntccccagtnctcatntttcctccnaatacccnnccttctctctcgagggatctaggcacctggtccccangtcttccttnngtnctcactgccaaactgcctgtcctgggatctagttntcttggccctgnactctcaacatgagtagcgaacacttaagttgggttttcaccagtcccagctttcactgccnnggtcccagtnanantnnnngaatttnngccctaactttnnttnttactcctggtttnnnnctntcccactaananatttaatctnantnttagtccttgcntgtgagatatgaggtttacaggagactcagagctccagcctttttcttctgntaacctttt

SEQ ID NO: 718989 - DNA, 195 bp, Homo sapiens
taataacataaaagttaacctgtcataagtgcttatgtaggtgaaacaagaggtggaaattagcaactgtcttatggaggagcgacggaacaacgctggagacaatcgcttgcttcagcaaagggcttgactaccgctacccagtccggccccagctttagggattgcgaggtcacatttagggggtcaatttgc

SEQ ID NO: 718990 - DNA, 285 bp, Homo sapiens
  misc_feature (80)..(80): n is a, c, g, or t
  misc_feature (136)..(136): n is a, c, g, or t
  misc_feature (203)..(203): n is a, c, g, or t
atggcttcaaggttacttcgcggagtggaacgctggccgcgcaggcctgagggctcgcggccccagtggcgcggccgcantgcgctccatggcatctggaggtggtgttcccactgatgaagagcaggcgactggnttggagagggagatcatgctggctgcaaagaagggactggacccatacaatgtactggcccaaaggnagcttcaggcacaggaagacctaatttagtccctccatctccacaagagatagtaggctgcatctgtaagagacaatacagc

SEQ ID NO: 718991 - DNA, 81 bp, Homo sapiens
gcaaagtgggttaatggtggcgctaaaactgctggaaactttggagtgtttttgtgttctttcggattacttctgtggtat

SEQ ID NO: 718992 - DNA, 374 bp, Homo sapiens
cttaggacagctcctgggccttccgtgccagctgaggacggaggtcgattcttatctactctctgctcgaggagagatgagatctgagtgctgcagatggcagtattaggttggtgcgcacagaaattgtggtatttgccattacctttcataggaaaagccacagttacttttgcaccaacctaacagtagcttccttaataactaacctgctctagtgcacaccagccaagtcctattcccatcattcaaattctcaagctcagtaaatggggagcagcagatgctcctcatgcctgtgtctcagaggggaaaaaagccgtggttgccattaatactaatgcgacacagcacctatattgcactttctatgt

SEQ ID NO: 718993 - DNA, 115 bp, Homo sapiens
  misc_feature (39)..(39): n is a, c, g, or t
aggtgacttagaggatccccaggcctctcagaacagggntctctcagaatagcatccccctcaggctctcagaacaggattccctcagaataaagttcccggaagggagcccaag

SEQ ID NO: 718994 - DNA, 694 bp, Homo sapiens
agagagagagagagagagagagacagtttcagagagactgccacacagagggattgtcatggggatcgcggtagtgcctccttcaacgccgcatgccatctttggcagcaccggcagctgacagatgaacaggtacataaagctgatcgcgcacagcagccgatcattcaatatacgtgatcgcgcaaccgagttgggaagaccgcttagtcggtttgcactagccattgtgcgacatatgttcgaccagacatgccccagattgcgtatttcgctggacacttatgaccggacgtgccagagccatatcctaaaggatgactcattcactctgacccagagccagctaatctcacaagttaaccccgcaagggatgagctgaacacacatagctttttccctcaacgtgttcaaacatttcggtcccccccctttaattaaacacctgtataccaacgccaggtggtaaaagcatgattacatcccctatgtgaagacccggttccctcacccgctttcaaaacagaagcccatgtgcacaataatggtccaagatgccgcaccaagagggccatgtgttaataagaaccgccttaaagttaggccctgttcgactaaccccaactgaagaaaattcccttctccccactgtccctgtcactcaagggggactccccggcttgcaatgtcttt

SEQ ID NO: 718995 - DNA, 361 bp, Homo sapiens
tcagagaacactataaacatctctacgcaaataaaccagaaaatctagaagaaatggacaaattcctggacacaaacaccctcccaaaactaaaccaggaagaagtcgaatccctgaacagatcaataacgagttccaaaattaaatcactaataaaaaacacaccaaccaggaaagaaaaaaaaaaaaaaggccctggcccagttgtattcacagttgattcctaccaaatgtacaaaagaaagttggacccattcttactgaaccctttcaaaaaaatcagggggaggggtttcctccttaattcattctacgaaaccggttttatcttgataccaaaatttggaaaagacacaccggg

SEQ ID NO: 718996 - DNA, 223 bp, Homo sapiens
cgtgctgaggtgtgacggacagtgacggacagtgactggaacggtgactggaccagacggacggacagtgactggaccagacggagtggcagtgatggacagtgacgggcagtgatagacagcaacagagagtggaggacagtgatgaacagcaacagacagtggagggcagtgatggacagtggaggacagtgggggatattttcctgcctggctgctccag

SEQ ID NO: 718997 - DNA, 460 bp, Homo sapiens
caccatgttggccaggaagcttgaactcctgacctcaggtgatctgcccatgtcagccttccagagtgctgggattacaggcgtgagccactgtgcctggcctaaaattttagtgttttttttttttttgaaaatgaatttgggctcttatggcccaggcaaaagtgcaggggcgcaattccggaacactgcaccctctccgaatttcggatttcaagcaatttctccggcctcagcctctcccaagttcgcgtggaattccaggcgcccgccaccacgcccagcttatttttttgtgtattttaagtaaagagggggttttcccagtgtggttgaggcgtgtcctcaaacgtgtttacctcattatccacccgctttggcctccaaaaggtgttgggtttccgggctgtacccattactccgggcctaaatttttattaacttttttttgggccggggt

SEQ ID NO: 718998 - DNA, 107 bp, Homo sapiens
tcagctcggacaggtgatatcctgaacatccaggccaataagcgcggtatgcccctgtattggatatcacctaagcagtgaagccagctgaagaaaagagtgcttgg

SEQ ID NO: 718999 - DNA, 200 bp, Homo sapiens
gagtatccgaagcgtcaaatcgaagatagattggcatggcttattcgtatttttgtatggttggtatttttttttttggggttggatccaggtttaaaaactggaacgggataaaggtaacagcagccgttggaaggaagattccccaaaattccacaaggcggccgagaatttggatggcccttggtggtttttaaatt

SEQ ID NO: 719000 - DNA, 363 bp, Homo sapiens
aggtcgtcatacctacagaagaaattgaagaaggatgtgcaactcagcaaagaaggtggtctgtttccccaacaaaaaaggttgcatgttgccacaccagccaagaaagcagctgtcactccatgtgcaaaaatgtgcatgctgcaacacactgccaatgaatgacagttacaccatgccaaatgcagttaccacacactgtgcaagaagggagccacaccagtgcaaagcatatgtgtagcaactcgctggtaagaagggtgctgccatcccagccaatggggtgcaaagaatggcaagaatgccaagaagtgaagacagtgatgaagaggaggatgatgacagtgaggaggatgaggagga

SEQ ID NO: 719001 - DNA, 385 bp, Homo sapiens
ctcattaaaggatggacaagagacactcacacctgactccactgggggccatttatgttgggttgcgatattcaacaggggaggtcttccttctttcatctgggggcgagtttcacgcaactatgcatgtactctcatgatgaaactttacaaattaacactttagaaaacaggacgtgaaggacgcccgctaagaagtgcattcacctgcaggtttactcagagcagcgccatctgtgacaaaggtcccgcgggccagggggaccctgatgtggacatgaacccagcgcccatgcccgattcttctttcccacacttccgcatgcttaaccattaagtaccatgaggttcgcccaggagctgggaggttaatatcggaaaatgt

SEQ ID NO: 719002 - DNA, 821 bp, Homo sapiens
gcatgtgcctgtgatcccagctgcttgggaggctgaggcatgagaatcgcttgaactggggaggtggaggttgctgtgagccgagatcacgccactgcactccaccttgggcgacagagtgagactctgtcttaaaaaaaaaaaaaaaaggtagcatctatccttcccagaatcattttttacgaagttttgtgtattattgtggtcggtcattattattattattttggagacaagggtctcactctctggtccagggctaaagcacagcgggggttcaatcaggggctctctgcagcctcaatttccctgactccagggatcctctcacctgggcctcgggagcacgctggggactgcaggtgttgtgccactatgcctgggccaattaaaaaattttttttggtggagagggagtctggctgtgttgcccaggcaggtctcaaactccggggctcaagtgatcctctggcctgggccttccaaagtgctggccatctcgtcgggcctattataattttagagatagggtcttgtctgtcactcaggctgagtgtaggggtgtaatcatggtcactggaagctcaaactatggctcagggatctttaacactcaagctgccgagtagggggcactgcaggcacgtgccacatgcccagctaagtttagaacatttttgtaaaaagggtccccatatgttgctaaggggtccaactcgggttcaaggaactctgcttggcttaaaggcgggtacgggtaacccgaccggcaagtatctattaattaagcccaggcagacacgttaatcgggggccgagga

SEQ ID NO: 719003 - DNA, 673 bp, Homo sapiens
gcggtcagtgtcagctgccgcggcctcgggcccggcgactccgcccccagccccccttccctccgcaggcagcggctccctccctccccagaacagctgaaggtctcactcactccgaggggagcgcaggggacggggagcgggcgtgaggacagcagcgagagagcgccgacgctggaggagagcacttgattttttgccgtgcccgccgaccgcggacaccgtaggctgccctgggcaacgaggggagcagatacatcactatcaagcgaaaccccacactcctcacagaagctcacacacatcaccagggcacgacggcgtagtaaaacgtcatccgaccaccgcacaccggcagcgttcaccaagcagaggcaactctagccgagcgcgaagcgcattcagaactacacacccgacgcaggatggccgcgcgactaggccaccgaaggcaccaggcgccagcccgcacgcgaacagactcacggagagcagggaggggggaaacctgacgggggacaaccgaccagcagagagaaccaggagaagcgagacacacaaggcgacacacgaaaaggccaagccacaggcccgggccaaggcgaccaacacacccagacgcgaaagaagcgcgaaccagaaagacagccaccaggcgccagcaggaacccac

SEQ ID NO: 719004 - DNA, 330 bp, Homo sapiens
ggtcgaccttacctggtataatcataaagaactcccaatgagaaactcaagactagtggctgggtgcggtggctcacgcctgtcatcccggcactttgggaggccacagtgggcagatcaagaggtcaggagttcaagaccagcctgaccaatatggtgaaaccccgtctctgctaagaatacagaaattagccgggtgtggtggcacaaacctgtggtcccagttactcagatggctgaggcaggagaatcgcttgaacttgggaggtgggggttgcagtgagccaagatcgcgccattgccgtccagcctgggtgacagagtgagact

SEQ ID NO: 719005 - DNA, 385 bp, Homo sapiens
gtccacaggaggttcttctaggccaccacctatgttcacttaaagtccaaagtctcttccgtaagcttgtggtgaatgctgccaggctagcaactcacccgtcagggcagtgggctcccctcgggcccaaggcaagagcagaaatactatccaagagcctaggcctggactgggggaacccaatatccggctggtggctctacccaactgtgacttcactggtacctaggatgcaacacaaagtccccttggcttttccctctgcttttctcgaacagaaggagtctttcaccatagccaccacagctgtgaacgtgctgggtcacccctgaagcctgcatgtctcagggcccaaggcccacagtatactccatgggtatcactg

SEQ ID NO: 719006 - DNA, 214 bp, Homo sapiens
tagaggatctccccgactagccgacagcacaggtctcccaggacagacctactcacccagcatgaactacaggagagggtccccatcctactatgacaacaggattcccttcaacaactgggatgacaagagcattcgaaaggccttcatccgcaaggtgttcctaggtgcttgaacttgcagctggtcggtgaccctgtcgggctagtcgggg

SEQ ID NO: 719007 - DNA, 633 bp, Homo sapiens
agatgtggtatcagcctgagtcccattaagcgtgcgattgcgtcgaacgtgcagaatgactatgtataaggacatgctgaattggatcacctagctccaggcagagcaaagtgtaatgcacagatcatcactccatagatatcaagcccgtgtctggactagacaggcaaaccttgtagtgtactcctgacaacctcatcttgacttcaccttggtggtgtccctcggtagatcatcgccttcagagatatgccagcataattctgggacgcctcgagctgccgaagtaaattgctcgcaaactagtggcatgctcgacgtctggcatcttaccatgggtcaaacacataagagcaccagaagtctgacttgccgcttatgcaaaattcttttggaatcagatactagatggagagccaatatgcttcaagtgatagtggaggtcttaaaggctgatgaaggaattcgtaaacgaacctttgaaagtcattgaatgataaaggcatgcttgggtaaatcatatgaagggtgacttccctgttgaccgggcagtgataatttgagataatttaaatataaccgttgctgaggaaagggaagggtgctagtggtggcagttgaagaacgtagctt

SEQ ID NO: 719008 - DNA, 1013 bp, Homo sapiens
  misc_feature (124)..(126): n is a, c, g, or t
  misc_feature (128)..(128): n is a, c, g, or t
  misc_feature (132)..(132): n is a, c, g, or t
  misc_feature (884)..(884): n is a, c, g, or t
  misc_feature (898)..(898): n is a, c, g, or t
cctagcaatctaacattaagcttccctctacgcttatcatcttcacaacttctaatgctacgtgacgtatcctagaaatcgctggtgcgccttaatcgcaagcctacgtttcacacttcgtagnnnancctntacctgcacgaaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactggcttattacaattttactggggtctctattttaccctcctacaagcctcagagtacttcgagtctcccttcaccatttccgagggcatctacggctcaacatttttggtagccacaggcttccacgggacttcacgtcattattggctcaactttcctcactatctgcttcatccgccaactaatatttcactttacatccaaacatcatttggcttcgaagccgcgctgatactgcatttggngagtggtctggcantctgatgtcccctctatgatggcgcttgcgcacaccacaacaagagacacaacacatgtgcggggcgccgccccgagaagttacactgtgggcgccccggcagaaagaagtctcg

SEQ ID NO: 719009 - DNA, 1326 bp, Homo sapiens
tagattaaaaaatgcctttatttttaaaatggtgggcttaactacttgcaaggtactggagccagtttgggaatccacccgggtattcagagttaaaacgtggaccaaaggaagtgtgaagttcagggcctccgggctgtggtcacctcctctccagcaacctcaattctacagagcatttcttcagcgtgtttttgtggtgacggtggtgggtgaatctcgtttgggaattccctctgtggttgtgacacagaacaaggctccgaacctttggaggaaagaacgcggttacccccacgttctttcgtgcatttaagtgggggtataagagaataagtggccgtggactggtggtagacaaacccttgggagaagaaagctcaagctttgtgggaaaagccccctcgtggggtgttccccatgtggtggatctccatatgtgggaggctcgtggagtgggtcctttataaatatgtgccaaagtgggtgcgagataacacgtggagctatgtggacacgccacctcagaaacccgtgatgtaggacgcacgctgtgcgggtgagcagtgatggcgcgcatctcccacaatgtgaaataaacatcacaatttttgtggcaaaatattcttaaaatcttatattatctttggcgatggagaacccctctcaagggggggctcttataactggaaagacacaccccggagggagtgctatatacaccatttggggcccacttgggggccatattaaaggggcaccacaaaaacaccaaccccccaatgttacgagccccccaaagcccaggagtaaagtgggtataagggtgtcccaaccagttcaccttttggggggatatacacttccggctttctcaaaaggagatttacccccttcattaccctcattatgacaaaagaaaaattcttctctaggcatgagaccattcaatccccccccaagaggaaaaaaaggcgcatcccctataaaaaaaaataatgagccatataaggggtagacaaccacccatcctctacaatataccacaagatccctctaatgtgtgggcggcagattgttgccacgagcaactctccacgggaaggaggaagaaacgacgggtgggaacaaagagagagacacgaaaaagacaacaccaacagtaggccacccaccgttataaccacaccacaagagggccgaaaacgagacacaacacatggagggaacccacataaaagggagaaccaactataaacaagcgacgtgggaaaccccaacatcaaaaacaaaaacctcactgtgtcccacacaataacaacacac

SEQ ID NO: 719010 - DNA, 677 bp, Homo sapiens
  misc_feature (124)..(126): n is a, c, g, or t
  misc_feature (128)..(128): n is a, c, g, or t
  misc_feature (132)..(132): n is a, c, g, or t
  misc_feature (547)..(547): n is a, c, g, or t
  misc_feature (582)..(582): n is a, c, g, or t
  misc_feature (639)..(639): n is a, c, g, or t
cctagcaatctaacattaagcttccctctacgcttatcatcttcacaacttctaatgctacgtgacgtatcctagaaatcgctggtgcgccttaatcgcaagcctacgtttcacacttcgtagnnnancctntacctgcacgaaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggcccaacaggataccccgtaatccctagagtccatctaacacatcgatnctcgataggagataatacctggctactagctatancaccgaaccaatattagcctgttatacaattactggcttattacctctcgctagagncttgggttcttacattccgcgggattcggtacattttg

SEQ ID NO: 719011 - DNA, 437 bp, Homo sapiens
  misc_feature (5)..(5): n is a, c, g, or t
  misc_feature (29)..(29): n is a, c, g, or t
  misc_feature (50)..(50): n is a, c, g, or t
  misc_feature (67)..(67): n is a, c, g, or t
  misc_feature (139)..(139): n is a, c, g, or t
  misc_feature (143)..(143): n is a, c, g, or t
atacnccaattacatattatacatatacncacaccatacaaattaacagnaagaccatatggatggnatggccataggagcctaaatagtccataatctggaaacaatcccaaattttaatcagtaatagaaatggatnaatngtgggcctggcacagtggctcacatctgtaacccttagcactttgggaggctgagctgggagaattgcttgagcccagaagtttaagaccagcctgggcaacatggcaaaaccccatctctagccaaaaaaacccacaaaaattagccagttgtgatggtgcacacttgtagtctcagctactacttgggaggcttaggtgggaggattgcttgaggctggtaggtggaggttgcagtgagctgagatcccaccactgccctccagcctgggtgacacagcaagacctcgtctc

SEQ ID NO: 719012 - DNA, 142 bp, Homo sapiens
caggtcgagcgcaggtcctcagtcaatggctgtggtgttgttcagcatgcacacagctctctgtaccctggccaggtctccacgcgaggcaccacagatgggaggctggtggagacctggccagggtacagagagctgtgtg

SEQ ID NO: 719013 - DNA, 872 bp, Homo sapiens
  misc_feature (124)..(126): n is a, c, g, or t
  misc_feature (128)..(128): n is a, c, g, or t
  misc_feature (132)..(132): n is a, c, g, or t
cctagcaatctaacattaagcttccctctacgcttatcatcttcacaacttctaatgctacgtgacgtatcctagaaatcgctggtgcgccttaatcgcaagcctacgtttcacacttcgtagnnnancctntacctgcacgaaacacataatgacccaccaatcacatgcctatcatatagtaaaacccagcccatgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcttcgcaggatttttctgagccttttaccactccagcctagcccctaccccccaattaggagggcactggccccccaaaacaaggggcaatttcaaacccccgggtttaaaaatattcccccctttaaggaaaaaagtttcccccaagttccctttaaaaaacaaccaattttcccgggtaatataacttcccggccaatttccaaggggaagggttaatctcaccaagtgccaacaccccttggaagggcttttcaacccaacttaagggttcctacacatttaaggaaaaacacaccaagggccggaaatacccaaaattcaattttcaaaggccaacttggctttatttcacccaaatttttaacctggggttcttcctaattttaaccccttcccttaacaaagggccttccagaagtaactctccgaagtcttgcccc

SEQ ID NO: 719014 - DNA, 162 bp, Homo sapiens
tggcgtctggtcataatttggttttccatccgggaactgtggtctccagtggttatagaggtttcacatactaataatgtccccagagacgtaatgatccctttctacatcttaattatagagcaccctaagtatttagcacatggtgccgatgaatagcga

SEQ ID NO: 719015 - DNA, 613 bp, Homo sapiens
gcacgagatggatggaggggtgtatagatggaggggtggatggatgtgtaggtgggcagatggatgcgtgattgaatagatgggtggatgatgggtggatgatgggtggatgcccaactggccagcaaccaatccctgaaatttgccccattcctatcctggccgagaagctccatgaacaaatttacacggtgaccgggccaagccgaatccctgccatcaaggataggcacgacatgccctacatggatgctgtggtgcatgacattcaacggttcatcaccctcatgccctacaacctgccccattaaccaacccgagacaccattttcagaggatacctcatccccaaggttaagcaatgaacctgcagcacacagcatgaacaccatcctatcagctaatctccttcctgccagcgagcacgatgggggccctatgacccttccctttgactggggtcactgactgcaatggctggccccactcccacccttgtgggatactgcatctccagcagtgcttacattggcctggtgacccaaacagtcgcaggccttcacctatctctcacagccctcccctggggtcaatccccccagaggttggcccc

SEQ ID NO: 719016 - DNA, 555 bp, Homo sapiens
aaagcgggcgctgtcggtggtgaagtgcgcatgtacgccaaggcgcctctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcccaacaatcagccctgggcagacccgagcaggagggagagccagagaaaaaaaaaacccagcatgagaacccagtaaataaataaaaccataaaatatttagcccctttttttttgggcttactggccaggaaatggtaccaatttttcagtgttggacttgacagcttcttttgccccaagcaaaaaagaatttaaccctgtttcaaacccgggggagttggctgtgttaaaaaaagacccttaaatgctttagccagtgta

SEQ ID NO: 719017 - DNA, 479 bp, Homo sapiens
  misc_feature (443)..(443): n is a, c, g, or t
tccatccacaggaagtcatgcatcttcagagattgaaaatgtcagggaagtccagcgggcaggaattctcttcttccgaatcatgctgctcgagctacaggaaagcatccaactactcaattccatggaatttgtgtcactgttgctctatgaccatactcttgtaacagagccaaattctcctcaagacagcaaatctatggagttggaagccaacgtgaaactagtgcgtgacatcctgaaggcggttatcttgttctttcatccagagttggaattttcaagtgactttggaagttgggataagtgtaaattttatgttaacaaatatttagtcaacaatatttgtgcctttgatccaactgccaagcatgtggaagttaatgtacagcttattgatgaatatatcagaggtaaatttccacttaattacagcctaaatntatgccaacagcaataaaacccagttgtgattttta

SEQ ID NO: 719018 - DNA, 479 bp, Homo sapiens
ggtttttggtggaacaaaactaagttgtgacgccatcatttacgggcgaaggcgctatgagaagtggctcttatgctccatcgaccaagcgaacatggtggagttcgttgcccattgaaaccgagctgacttactcccgtttgaacaaaggtctcgaaagaaggtaatcggtgaccaaacggacctttaatcggggctggaccatctggatgccctgagggggcatcgaagtcctcttccctatgtgagatatggactctggaataggattgcgctggtatgcctagggaacacgagccgttgttcaaggtgttggatcaattgagtatagactgccgatatgactggtgaggacttgagatagtcccgctgggaggataagctctgatgtgacgcgccccgggcgcttgttcatatctaacctggtacgtacggatcagtgccaatgtcaggcactcgttgcgctagaaaattcaaga

SEQ ID NO: 719019 - DNA, 662 bp, Homo sapiens
attgttttttcccagaggtcttcctttttgaacggccaaattctttttacgagggccctggaagaaccccagggtaatgggaggctcttttataaaccctcccccctgataaaaatcggcgtaaggggtttaaaaaaaaccttttccatcttctcctagaaattaacggcatggtgtcatataagtaattcccacgttaaatcttgaacccgaagatataattctcccagagtttgaaatcagtgattatattactgtctgagcaagatagtgtcgttactggccttttatacccaatctttagaaatattatgtccatatgtctacaccataattggcctaaagtcctgcttttgtttaaccgtcaggacacaattgtgcagcctctggcactttctttgtgtgcggttcatgcaaagatggacattactcgctgttttcgtaccctcaaagaaatggccaagatttatctcgctaactggtgttactaaacattttttcccactccttgttcccccaaaggagttaattatgttcacccagaagacaggccctatgagaaaaatgggagcaaaatcctgacagcttagtttgtacactgtacgtaccgtacctttctgagtggggctggactgatgaaaaaagaaagatttaccttacat

SEQ ID NO: 719020 - DNA, 464 bp, Homo sapiens
  misc_feature (370)..(370): n is a, c, g, or t
ggctcagtgatctaccgctggctctcaagtgctggatacgacttgagcaacgagctggcccagtatgctttttaaggaagccagttgggagaaaaatatgctaaataaaatagaggaaaaaaaaacccaaaaagactcacttcacacattgcaaagtaagtaccagacagattaccgatttaattggttttccaaaaaaacaaaactgtgtcagcatgtagttgaataaattttaaaaaccttaggattaaatacaaacttgcaccaaatgtagaatctataaagaaggtgaaaagtaatagctcagacaccttttgtttggctgtgtttttaaagctttgagttaggtgcccaaaaaactattagctgncaccacttcagagacatcacatagccactccagcttctactgaactatgagcagacctgagaattttgggcccatttttccatatgtacaacta

SEQ ID NO: 719021 - DNA, 688 bp, Homo sapiens
  misc_feature (672)..(672): n is a, c, g, or t
tcctctagtaaggaaggcgataataaagagatagtcattaatatccacagagactgtcttgagaatggaaaggaagatcttctagaagaaagaaataattatattctttcattaattccttatttctttcttctagaagaaagaaataaggaattaatgaaagaatataattatttaaaagaaaaactgcttcagtgtgaaaaagaaaaagcagaaagagaagtaagtatgaagaaaactataaacttctggaaagaaaatttaaatatttcattctggctatatgttgaacctagttcaatatacaaataaatagatgaaaatgtgtttaccattctgtataattccatttacatgaatcatccaggaaatacatctatagggacagaaagatgattaatgtttgtgtaggcctggggctggaagcgggtcgtgactgctaatgggcattagggattgtcctggagtgatgaaaatgttctaaagttggattgtagagatggttgcacgacacagtaaatttactaaaaatctttgaactgtttgttaaaaaagataaattctataaatcatatttcaacaaagctgtttgaataaaaatcatatttcaacaaagctgttttagtaaaccaaaaaaggtgtttactatatcagcttggaaacatgctttgnttccaggagataaaag

SEQ ID NO: 719022 - DNA, 184 bp, Homo sapiens
cgcatgggggtgggtctgaggcgttatctgcttctacccctgtctgtaggcagtggcgtggttattcctgaggtccggccctgggaggtcgtggtaagtgtggacgtgcgtgcagacgctcctcaatgcatgctgccctcgtctgtgcctcacactcatgtagaggactggtacgtgggctctg

SEQ ID NO: 719023 - DNA, 468 bp, Homo sapiens
cttttcttaatatcatattttcctcgtgctattttctttgggtttactttgccattctttccctagggatttgagatagatcatagtttattagtatccaatcttttttttctaacatacacatttgctactctaaagtttcctctgtggcttactttagcttcatctcaaagtttctaatatgttacttttatcatcgaattcaaagcattttagaaatatatttttaattttcaaaataatatgttgttttctggcttgattacattttattcatggaacatattctcataaaagtttttgaagttgccttatggtcaatttttgaagtgttacatgtgtacttgaaatatattcatttaagtgtttagtgtacatattgcacttcattgtttatatacaaatattttgatatattattttactatgtattttaaatatttattaaatatcattgtttaaatctta

SEQ ID NO: 719024 - DNA, 301 bp, Homo sapiens
gctcttggcggtgggagaggcgcagtggctgcaggctgccccctgccggccacaggggagcagcgtccgcgctggcgtcgaccggccctacggccatctcctcagcctgctccctgggaggcaggctccagaagcaccccaacggagggccttattaagcgcgagaagcctttgcagcgagtcatccccgtgagtcctatctgcggcaggcaggatattcgatctaacatgtgtatcaacgttggttcacaccacttaccatgtgtatgagttttaaggaacttgtattgcatttataaag

SEQ ID NO: 719025 - DNA, 562 bp, Homo sapiens
agtgggatacaacgaaaggagggatttccccctttctatggaaacgggggtacccgtctctccacgtgcatcgctacagctagtttcaagccgcggagcaccatgaggtggtggccgtggaggaagccgatctgatagagggggaggcaaaagcagatactagaaacaaacaaaactttggaccaaaatcccagttcaaagaaacaaaaagtggaaactattctatcataactacccaaggactactaaaaggaaaaattgtgttactttttttaaattccctgttaagttcccctccataatttttatgttcttgtgaggaaaaaagtaaaacatgtttaattttatttgactttcgcattgcttttcaacaagcaaatgttaaatgtgttaagacttgtactagtgttgtaactttccaagtaaaagtatcccctaaaggccacttcctatctgatttttcccagcaaatgaggcaggcaattctaagatcttccgcaaaacatctagccatctaaaatggagagatgaatcattctacctatacaaacaagctagctat

SEQ ID NO: 719026 - DNA, 599 bp, Homo sapiens
taacaccattaacaggccatgctgagactaacgtgagctgagagaaatgctacccaccgatcttagaatcgatgttggtgcgtatagtctgactagtttcaaggagactgggcgaagactctggccagaatgatctgtggatggaaaagcgccagcttgctagtggagaggatgatgatgatgaagattaccagagtactatgttggaagaagtgtccctgcatggagcgctatccaagcaatgaggtgcacatagctgcaagttggatgtacatactttctagaagaattagagaccatgaagagagtatcactagggaagctggctagtctctatatacttatcgagctgtctctctgtaatgcaagatggatggggtgtgatgggaggtctgatcccatcatagatctctactattgataaacgcccaagaccccttgggacactgcaagctcttttcagattacgtcttaatacactagttcattctgtctggagctaacttgaaagcactgaaagaaagcctgggaatcatggttgtgaagaacataaagattaatgaaaaggttcttatgcctagttaactgacatcaaactg

SEQ ID NO: 719027 - DNA, 376 bp, Homo sapiens
tccccctcgttccccagtgtacagatgggagggaggcaacccgtacatgaccttttaatggttttttcgagctacaaaattgtcacaaaggagcacaatattagaacagttgtctgttatttttatatcaatgaaaaaccacctaaacttggttagctcgaaatgatatcacacaagaagacatattggagcatctaaaaaagcacctgcaaggacaaggattcagggagaatggtggaaagagagcctgcgataaatcaggcacatctattttttaccagtttcaactgtgtcccttctaccactatatctcttatacacttgtgctttgaaagtcattgctccccattggggcatgtatacaggcttgagagta

SEQ ID NO: 719028 - DNA, 117 bp, Homo sapiens
tgtgatagaacagaggaggctccccgacatactcgcagatgaaggtcccctgtgggatggtctgcagggcgcggaccccccagcccctcttgctgtccagctgtccacctcctctgt

SEQ ID NO: 719029 - DNA, 879 bp, Homo sapiens
taagcgccatctgctcgcggcgccgtctcctgctcctcccgctgctgctgccgttgccgccctgagtcactgcctgcgcagttccggccgcctggttccccatactaagtcgccggtaaagaaaccaaggtcttagagacctgctcacagtcgtttcgtgagggaatgcacactttctgggtctagggtccaaatctatctcttcacagcagatctacttgattaccaattctgggccttgcaggggaggatattgggagttcttacaacatggcagactttgacaacaaagaaacagtctgaacttgatcaagaattgggatgatgttgaaaaatggtagaagaagaggaaacgggtgaagaaacaaaatctcaaagcacgtcagtaactgttcagatgatgcaaaatcctcagatttcttgcagcctttcaagaaagatttgatggtcgggtagaaaccccaacgggatactttgaaagcctgctagggtagttaaaagacgagtgattgctctcaaaaacctgcaagttaaatgtgcccagatagaagccaatttctatgaggaagttcatgatcttgaaaggaagtatgctgttctcatataaagctctatttagataagcgattgtgaacatttttcagtggctttatgaaacctacggaagaacggtatggtgtttggacccatatgagaagatgagatttcggggggaattgggaagaaagggcatattgggagatgagaactggtggagaaaaaaagaccccagggaattctgaattgggtcacttgtttcaaaattgggcttgtcgggatgttctggaccgtgaccttttgagcgtgagaaataagggagttcacatggagcagtatggt

SEQ ID NO: 719030 - DNA, 719 bp, Homo sapiens
ctgtacggctcggaattacgggatggaggcggaacggcagtgcagcccgaagccccgcagtccccgagcacgcgttgcatgcggtccctgctgactcccgctgccgctgctgtctggcgctcctgtgcctcgctcctgtgcctgcgcccccggtggccccggccgaggccccgacctggtgcatgtggacgcggcccgctgcgctgtggcccctgcggcgcttctggaggagcacaggcttctgccccccgctgccacacagccaggctgaccagtacgtcctcagctgggaccatgcagctcaacctcgcctatgtgggcgccgtccctcaccgcaggcatcaaggcaggtccggacccactggctgctggagcttgtcagccaccagggggtccactggacggggcctgagctacaagttcacccaactggacgggtacttggaccttctcacggaagaaccagctcctcccagggtatgaggctgatgggcagcgcctcgggccaattccactgactttgaggagaagcagcaggtgtacgagtggaaggacttggtctccaacctggacaggaccatacatcggtaggtacggactgcgcgcatgttaccaagtggaactttcgagacgtggaatgaggccagacccacacgactctagacaaacgtactccaataaccatgccaagggcttcctgaacctactaacaatgcctg

SEQ ID NO: 719031 - DNA, 197 bp, Homo sapiens
gtcagctctgcaccctgggaccaggcaggctccgaaggtaagccggtccctaaggcgctggggaccacgcttgtccgaggctgagttaatggttaacccacaatgcaaaaggtgcctgcaggcgtgtgaagaggtctgggctgcctggggcgtgagcacacagccaagtatgagctcaacacttgcagggcgtgggg

SEQ ID NO: 719032 - DNA, 1277 bp, Homo sapiens
ctctcattcggacgggcgcggaggacgctgtctggaaggaacgccgcgatgtgctagcgcgagggtagagtgcaccaggatccatgttcaaaccttgtgatgggattggtgatggtaggtactgggagaaaatcggacacttcgatgaaacgttcaattatgacttggttgaattatgagaagaagtatgtagcgcatccttggtgtgttcgagggttccatcgcgcacattagtgtaaccgacgagccagaacaggaggacctgattgaatgtatcaactgtattgggacgacaggcgcggctcgaggtagcaaattcgtgatggagctgatgcgatggcgtacttgatagtcgcatacggcgccaggttgtgctcatacgatagagtgtttagacttgtagacatacgatgaggtttacttgaaccaaggaattgttgtcctaacaacgtgtggcatgagcagactcttgggtaaccgaagtgtcgttgagaaatcagtgcgccacgatatgttgttaggttgtgggcagatcgacatacgctggcatcatgtacaggaccaggcaaacgtggagagggcggaaaataccacatttgtcctgtcccaccggagatgagcacagacatcttcgaggtaactcacgacgagttgccttgccagaacaggttaactacagacttatgacaatagcccttgcctactggcttggctaagggaagcttcgtatgggagtcccttgaacttgggaatttggtcggacatagcctggctctacggccccagccaggaagttgtcattggacccagctttgggcagccacagtaatgaagcaacgacttaggagggttgtctcagaacacatgtggctctcccggggattgagggcatgaagacctgtgagcaattggatgctgggagccccacgcgtccgaaaagctcaggaaaataggcgagctgtccttgttgcatgtgatgggactgccatgattgttgtccaccacccattattcatcaagctaacagggaacacggttgcaccaccacgaggagaagcagaaggcacaagcaggacgccgcacgagagtggggaacaagcaaagagccgaggggaccccgaaaacgcggcaggaccggggccgcagacacaccaagagcgcgcacccaaccccacggaacagccagatactaccctacggagaaaaactagtactacaccgagcgccactccccaaaccacagagaaatccgctcgaccaacccgtccacaccagct

SEQ ID NO: 719033 - DNA, 351 bp, Homo sapiens
aaccggccgcccttttttttttaatttatctttttttaggagctaaaaatggccccctatatattcaacgtctcaacaggactgtatcattcgcccaattacattggctgaattgagggaaagataatttagtaattctggtgacaaaactgtccatcaaacgcaaacgctatacacaatcttactctcttcgttcagctatgtacaaaccttaataaaaatagtaaatgttaaatctaaaactcttgccaatatcaataatcatctacctaaagacaggcttttgtttggtcagtgacaatttaacgtctcctttcataacaaatcccacaaacctatcatcttcttcca

SEQ ID NO: 719034 - DNA, 154 bp, Homo sapiens
gctaccgccctgctcacgtaccttgattgcgcccttcaccgggcctgaggcagggtgacctttataaccccctattggggggttgcccatatatttatcctgaatatcacattccaggccactggaaaattacagctttcagcagggaaacccc

SEQ ID NO: 719035 - DNA, 456 bp, Homo sapiens
gcgaccttacagggcgtaagcagctaatttgttatgtcagaaagtaagacagcgcttatatataatcagaggacagagcatgttgaaagggcacaggaggccagcctgaaagaggtgccagtggcaaaaggtggaacaacggtagcagcaaatcaagtagtggtaacattaaattataacccaaagaatggccagatggggtggctcacgcctgtaatcccagcactttggaaggccgaggcgagcggatcacctgaggtcaggtgtttaagacacacctgaccaatatggagaaaccccatctctactcaaaatactaaattagccaggtgtggtggcacatgcctgtaatcccagctactcgggagactgaggcaggagaattgcttggacccaggaggcagaggttgcaatgagctgagatcgcaccattgcactacagcctgagcaacaaga

SEQ ID NO: 719036 - DNA, 377 bp, Homo sapiens
  misc_feature (322)..(322): n is a, c, g, or t
  misc_feature (349)..(349): n is a, c, g, or t
  misc_feature (366)..(366): n is a, c, g, or t
catgattgtaagtgttctgaggcctccccagccatgcttcctgtacagcctgcagaactgtgagccaattaaacctcttttctctatatattacccagtctcgggtatttctttatagcagtgcaagaatagactaatacagggttcaattcagcaagaggatataacaaatataaatatatatgcactcaacactgcagcacccagatatataaagcaaatacgattagagctaaagagagagagtgaccccaatacaataatagctggagacttcaacaccacattttcaggcactgggacagatcttccaggacagganaattaaaaaaggaaacatcaggacttnattctggcactgttggntccaaatgggt

SEQ ID NO: 719037 - DNA, 317 bp, Homo sapiens
ggggcagacaggagatggcagatggacacctgggaggggctcactgagctccgcctctccatcaacggaggccccgtctaggttgtggaggatgcttgagagagccctgatgttctgacctcccaaaaggtcaagggtgctggcagccggtgagacgccgcagtttgctctgctccccggggctgtgcttgccaggagacatttcggctataagcaggcgagaatacctccagaacacacatcaggaagacagatggtgtgcaggtggggctcagggctgtcatcccctgaagctgcttctgaaagagctgttcttt

SEQ ID NO: 719038 - DNA, 120 bp, Homo sapiens
gctgcactacatccgcaagtacaaccccttcgagaagcgcacaagaacatgtctgtacaactgttccccttcttcagggacgtgtcagatcggtggacatatctcacacgttggcgctgt

SEQ ID NO: 719039 - DNA, 202 bp, Homo sapiens
acagttttctctggagcagaagagcctgtcgctgaaaatcatgcatgtacttttcccacttcatcatgatcaggaaatcccaactacccttatagagttctcacggtaaagtaccctacatttgctaaccccctggtcctgactattgtaccccggtgtctggatggacagaagctacttaggagcgaacatgaacatgcgt

SEQ ID NO: 719040 - DNA, 319 bp, Homo sapiens
cgtatgataggcaaagcataccaccgtattgctgacatggagaaagtttagtggtattaatggaaggataaagcagccacagcattcccttagtccaaatcctaattaagagcaagatctcaaaactcttcggttctatgaaggctgagacaggtgaggaagatacagaagaaaagctggaagctagtagaggttagctcatgagatttaacaaaagaaaccatcgctataacatagaagtacagggtgaagcagcaaatgctgatgtagaagctgcagtaagttatccagaatatctacctacaataattgatgaaga

SEQ ID NO: 719041 - DNA, 357 bp, Homo sapiens
  misc_feature (14)..(14): n is a, c, g, or t
  misc_feature (20)..(20): n is a, c, g, or t
ttcacttttctttntctttntgagagccggagtctccttctgttgcccaggctggagtgcagtggctcaatatcggctcactgcaacctctgcctcctaggttcaagccattctcctgcctcagccccctgagtagctgggattacaggtgcctgccatcatgcccagctaagttttgtatttttagtagagacagggtttcatcatgttggcccagctggtcttgaactcctgaccccaggtggtccacccgcctcggcctcccaaagtgctgggattacaggcgtgagccaccacgcccagcctgttttcactttcagacattttctgaaatgaattcccttctgtcgtcttctc

SEQ ID NO: 719042 - DNA, 415 bp, Homo sapiens
tgtggggaggagagttctagcctgagcagtgccttgctgtaaggaactgagggttagggtggggcagctgcagccagaagctgctgtggcttctggtcacacctgctgtgtcagcatcactgtggacagtccccatccctcccactttcaaatgtggcccagtctggtgacaaattagagttgagagacaggtttggggcaaggagaggtggggaggggtcttcgggatcaggacaggaatcccagagtagcatcagtgagccgggagagtctcatagagttggggagaaatcagtagtagataagtacagaaccaagcaaacagagcaagaggactatgaaccgggggggagacttccgtaagtaagcaaagatgccctgagtaaaacacccaggtcagatatccctttaaatt

SEQ ID NO: 719043 - DNA, 385 bp, Homo sapiens
ctataggtgggctgcgaatttgagtgcagagatatgaactgagaccaacaatactgtcgtgactaaaaatattgctatcgctacttggcttagcgtgtataaagggactaatgtaagacctagccgatcctgtacacccttctggacactctgtagtgaatgcgatgtcagttattatagtaaaccttgatttgtatcttctgcgcagggctctggtccagaagatgcactgtgtgcttgagagcctgctagaagtggaacacttaccagctttggatccatgtaggcaaagatttgaacctccatgatgatctagcatctgactgtgtgatcgtagcaagttgtttcacctttctgagctttattttctcttctataaaatggg

SEQ ID NO: 719044 - DNA, 855 bp, Homo sapiens
ggagagaactagtctcgagtatatatgtattttttaaatatatactttaagtttaagggtacatgtgcacaacatgcaggttggtccatatgtattacattatgccaggtgggtgtgctgcacccattaaactcgtcattaaacattaggtatatcccctaagtgctatcccttcccctttcaccccaccccacaacaggccctggtgtgtgattgttcccctttccagtgtccatgcgtcctcatgtgtctcagttgtgcaccgtgaactttgggagtgggccagggtgcaaacttacgtgacattaaatcaaacgcaaaggtgactacttggggcgtggcttgccgcaaaacactcaacacctttctcagttagacgacaacctagtccttgggagtactacgctatacactgtcttcgcgcatatcttgtgaaagacacagcaaggcaaatcaatcattcactacccagcgcgtggggtctatcccacgcgtggacgcaaacacgtggacaggcccacagagaaggacagctcgaacgagctgcagacacacactcaccttctgcgaacgaggtcaaacttccgacagtagcaacaccaaagttgtctaccccaaaaaatccacgccgtgtacaaacggggtcaacgcgctcccagcgacaagaaaagccccccacaacaaaaacagataggaacgcaagccgtgacaggtgtaaaacaaagagcggcaaccaagaatacgtaaccccgacagggagggaaatcaacaaaccttcaaagacggggactggaaacacacgtgaacaatcatggtacaacagacaaggtaaacgcgcagccataactcagaact

SEQ ID NO: 719045 - DNA, 194 bp, Homo sapiens
caggagcagacgtaatatataacaccaattcaaatccaagggatgctttctacagtttgggtgaacggctgctcacgcccctgtagaaaccgatctctgaatttggattgtggaaatatcctaaatcgcttccatggacaaaatccaaagtcacatctcttttatattatcgtgttttttgcagcctgtagcca

SEQ ID NO: 719046 - DNA, 344 bp, Homo sapiens
tgtcccctagcgggtctcatgatagtgaataaatctcaggaaatctgatggtttcataaagggcagttcctccgcacatgctctctctcttgccttgctgccaggtaagatgtgtctttgctcctcctttgccttctgtcacgattgtgaggcctccccagccatgtggaactgtgagtccactgaacctctttttctttataaattacccagtcttggctatttcttcacagtagtatgaaaatggactaatacagtaaattggaactgaggtagtggggctctgctataaggttaacagaatatgttgaagcaacttggaacagggtaacaggcagaggttg

SEQ ID NO: 719047 - DNA, 396 bp, Homo sapiens
  misc_feature (174)..(174): n is a, c, g, or t
ggactctagaggacccctccgagaagagttgtgctcccatatagtaacttactactccggaaaaaaagaaccattaggatacataggtatggtctgagctatgatatcaattggttatcctagggtctatcgtgtgagcgacaccactatatttacacgtaggaatagacgtangacacacgagacatatttcaccgtccgctaccgatattcatctgcgatcccacaccggccggtcaaagctatattagtctgactacgccacacgtccagggtaagcaagtatgcaaatgatctgcttgcagggctctgagtccctaaggattcaatctttcttttcaaccgtaagggtggcctgacctgtgcattgtaattagcaacactcatcactaggac

SEQ ID NO: 719048 - DNA, 254 bp, Homo sapiens
gctcggccgtgttcgatcactgtactatgattggcctgactgaagtgggctgtgactatagattgaaaaatcaagacagaaatgctaaaaacaaacaaccttagctaccataatgtataaatctcaaaactcaccagacaatccaatttctaaagaaactgatggaataaatgcttccccttaacatgaactatggtaaagatagcattgatctgtcaggaaattcaccaagtccagtacgctgactctttatg

SEQ ID NO: 719049 - DNA, 499 bp, Homo sapiens
tttttgtctctggatttgcctgttccgggcatttcatacaaatggaatcccccttgtttgtctggcttcttccatccagcatcgtgtcttcaaggttcatctgtgttgtagtgtggattagcacctcagtcctttttatggctgagtaatagtccactcactgtatggataaaccatgttttcttcatctatccatcatctgatggacatgtaggttttcactttttggctatgatgagccatgctgataggaacatccgtacaaggttttgcgtggacgcgaaggtatgtttcatgcctcactgtgtatcaggccccattcctttctgtggctgaataatattccattgtacacagagaccacattttgtttatctcttccccccgttgatggtcacatgggctgatttgataatttttaaagatgcaccttctgaggcgggaggatccttgggaccgggaggtcgagactgaagtgggctatgactgactaccgcgc

SEQ ID NO: 719050 - DNA, 885 bp, Homo sapiens
gagcgccgccgcatgttctccgggctagcgcgagcgccctgagcgttgtagagcagctcaagtggaggctgcgtgagagatcaggtctctcaggcagctgaggagttcaaacagtaattgtattgcagaatgttgaaggatgccctgttgggggtgtgtcccagttgaagtacccctttcgggggagccaagatcgtggggtgttaactctgaaagaatctagggagaggaggtttgctggaggaaattgccttcaaggcacaagggttggttgaattggattgccttcaagtttcttccagggaaaacattttctcccctcaatttaaaggagatatttacacgccttttcctgtgtggcttgttcttattaggcaaaattcacagttatcatgagttcctactttgagtgtttgtgagacaacttgggttgacaggggaaatacgcgaaattttttacagcaattaagggtaaaataaacaggtgggggttggtggtaaaaaagtgtggggggggcggcccaagagggcgttatcaccccttttttttcaaaaaacatttttaacccgcccttttttttaacacgcgggggcggggagcaatttttattttaaaacaagaacgcaggcgcgcgccaacagaaaagacagaagaagagaccagcaggcaactcaccccgccccccttttttttttttttttttaatagcagcccccccgcaccaacgcaaagaagcaaatcccccccaccagcacaaagcaagaaagtaaagacaacacatcaatacctcaccacagctccgcccacaccccatataatattatttttttctttttatctccacacaccccgacccacgcacaacctcacaagcacaaaagagg

SEQ ID NO: 719051 - DNA, 357 bp, Homo sapiens
  misc_feature (66)..(66): n is a, c, g, or t
  misc_feature (253)..(253): n is a, c, g, or t
cttgccccggtagattggtgaagcctttaattaattgccacaactgctaaggattgtgactcacanctagtgatagtgcggacgtgacatggagcttgttataatcacgagcagatttaactctttcaaaggccaaaaggcttctgatttcaagagacatgtttccccaagaactcacacatgctcatttcatgcatgcacgccaggctctggtccccccacactggggatcctgaggcagcagaagtgcagnccctgccctgagggagtgcaccgtctaggaagagtgacaggctaagaactacacagaccattatagtgggtaccactcaccaattccctacattagggcggctg

SEQ ID NO: 719052 - DNA, 737 bp, Homo sapiens
ctggtgttgccatgtcctcatcgccaactgccttgtaatcattgacatctagcctttacaagagcttcctccatgctgggcgccggtcctgatgcgtgggtcctgacgctggcctggcagtccggctttgccatcggcatcgtggtggtacggctggcgttgtcggggtcaccgcccagcatgccccgactatttcgtggtgcatgatcctgattctcatctgtctggccgaggtgctcggcctctacggtctcatcgtcgccctcatcctctccacttatatgtagaccgctctgccgagcccaccagtccacagaatagttatgtaaagaccacccgctcctgcattccagaacgaacagccttgacacatatcgtacggggaccgctcgctccccagtagttggtcttgtacatgcgcagtgtctgtagtgcccatcgtctgttgccccggccttgctccccgacccgtccccgtgccgtggacatatgggcccactcatcgcccctaccaggccccttggcgacctccacgccacctagagtgctctgtgtatagcggatgatttagaattgtcagtttctctttactgaatgtttagtttactaaagatctggccagttcctgcgtactgcggagcggcccctgtctcccagctatctataaccttagctagagtgtcgtcattgtgggttcctgttgctgaacttcatacgtcgagcggccctcaccgacc

SEQ ID NO: 719053 - DNA, 233 bp, Homo sapiens
  misc_feature (172)..(172): n is a, c, g, or t
tctttgggaagagagaagaacagagtgtccgattctgcctctatttatgtttctattcgggaacaaaggtgggtggtgtgtgtgtgtgtatcctggtgtgggtttttaaaagaattgggaggaagaaaaaaaatttctcggcccttttcctcgatctcgctccccctttggnttcttacgacgggtcccccttcctttttgggtcctggtgaggtctggtttggctctgagcc

SEQ ID NO: 719054 - DNA, 190 bp, Homo sapiens
  misc_feature (59)..(59): n is a, c, g, or t
  misc_feature (62)..(62): n is a, c, g, or t
  misc_feature (108)..(108): n is a, c, g, or t
ttgtaacagtctgctggtagatccatgacattgacattcccagtgggcctgggttccanaanttccagtcaagagagctttctcgactgtgcttgtatattacagagnttgggagccagattgttagcccttcattttgggataagagctggagcttggcccatttaaggctagttattaatctgagaaa

SEQ ID NO: 719055 - DNA, 89 bp, Homo sapiens
cctttgaacactgattttttttttttaaattgtcaaacttggtacaaagcaccagcatggccaagtttctatagggacttcatttcatt

SEQ ID NO: 719056 - DNA, 209 bp, Homo sapiens
cgggcatgttgctacacagtagtaagcagggctaaagttagcacgtcaatccagtccatacactcagaccaaccaaagatattattatcgcatggcaataattggttagtaataaagaatgttttaaaagcatatagtagtaataatcaaagtggtataaggtttagatataagaagcaagtgtatcatgaaactgcattattttatac

SEQ ID NO: 719057 - DNA, 355 bp, Homo sapiens
  misc_feature (13)..(13): n is a, c, g, or t
aaaaaaaaggggngtgtgggggggggttaattttttctttaaaccccccccgggggaaggggcggggcgggaaaaaggtttttttttgctttggttcccggggaccagggttaaagagaaaaggcccccccggggtttttttaagggttttggtaaaaaaccccccttgggcccagggggggggttggggcccgaaatttttttttcccccttttggggggaaacccccccttttttcccccccggttggaaaccaaaaaaatggcccccctgggaaagggggggaatttttttccaaaccccggggaaattttaaggccccgggccaaaagggggaaaatttaaaatttttcca

SEQ ID NO: 719058 - DNA, 140 bp, Homo sapiens
gaggggcggtgtggacccaggcgattcatggagctgggatgccacgatgttctcaaatgaccttgttcgtggccatggcccttcctgtcctggcctccatgtggggcaccatgatctccacccagtgctgtgactacccc

SEQ ID NO: 719059 - DNA, 862 bp, Homo sapiens
ctggggcgtctcagcgagcgcgcgagttgacgcggatcgtgggccggagcggagccgaggcgtcagatgcacagtctctgacatcagtctctggaccctccaagagcactagtgtctaaaggcctacggttgggggggaaagagctcagagatgaggagcagacagctgaagcgataagaacaaatgatgtgaaagaatggagacagtgttgagatgagtcaagataaaaatctatacaaatcttggtaccagctgtccctatatacatggcatggtgaagtaaaaggggtgtcctgttgatgctcttggtgggttccaagagacaacaggagaagggacctctcttcgaggggacataaaatgtttgcattgttgggtgacccaagtacagctaagagccaatttctcaagcacgtggaggagttcagccccagagctgtctacaccagtggtaaagcgtccaggtgctgctggcttaacagcagctgttgtgagcagcatgaagaatctcatgagtttgtcattgaggctggagctttgatgttgggtgaataatgggtgtgtgtagtattgatgaattttggtacagacggacggtgcgggatccaagttggtcattcatgaaggtcttggcacaaggagaccattatttcctccataaaagcaggagtagaagggtactcttggaaggccggaggcacattttgggggcggagaacccaacatgggctcttagacgatccatctttggcacggagtcaattgggggcccacatgtcgcggggacatccaaattgggggaggatagggcagacatcttgccggctgaaataaccacaaagacagatctatccaaataaa

SEQ ID NO: 719060 - DNA, 198 bp, Homo sapiens
gattacatatgctgaggctgagggtgtgggggtgtgtggtgtgtgtctggagtgtgtctgggtggtgtgtcgggtgtgtgtgtgtctggggtgtggtgtgtgtgtccctgcccgttcttcacggctggtaccagggtgactgactatagtaaatgtgcattgctagccgcatgacaaagctttttcagcagtccatcc

SEQ ID NO: 719061 - DNA, 209 bp, Homo sapiens
gtttgaacctgggaagtggaggttgtggtggcactccagcctgggcgacagaacgagactccatctcaaaaaaacaaacaaacaaaaggccagccggggtgtggtgaggcaggtggatcgccagaggtcaggatttggagaccagcctcaatggtgaaaccctgtctctactaaaatacaaaattggccggggcgtggtggtacgtcct

SEQ ID NO: 719062 - DNA, 440 bp, Homo sapiens
  misc_feature (244)..(244): n is a, c, g, or t
  misc_feature (364)..(364): n is a, c, g, or t
  misc_feature (380)..(380): n is a, c, g, or t
gtacactccacactgtgggagctgcccgagcagcggctcaagggtccagacacagaatcttcttgggtccaaataccccctagaagtatcccattggccacttcatgctcacctcatgtaaatgaagtggtagcttgcattcagtctgattggtggcagaaagcagccaaccagaggctgaagtggttacaaaggtcacactcctgtgcaaacatctgattggttgcaaaaagcaaccaatcanaggctaaggtgaagttacaaaagttgcatttctatgcagactaagactcagctcgcaatcaagtatggttggttgtggacagcccaatttcccccaattttcccacctgccagggcgggnaaaggtggggatttgnaaagggagtaaccctctggtctttttgttacttaggcgtgggagaagttaggattttccc

SEQ ID NO: 719063 - DNA, 334 bp, Homo sapiens
  misc_feature (59)..(59): n is a, c, g, or t
ccggagtatcgcccaacacaacatcatgtagcacttataggaataaatttacttatggnattagaattacctagagggatgttttaagaattctgaatttgacgctggaaaatcaacagtgaattgtcgtaccactccagttgcggagagatttttcaccagttccacctctctgactctaaagcatgctgcatgatatccaagtgaaatcctgcatccgcacgtagtgctgctaacatcagacatcgtagtcagaatctactcactacgagagccgcagacaccgactaacgtgataatactttcagaagccgtagagcaaagtctagtactc

SEQ ID NO: 719064 - DNA, 282 bp, Homo sapiens
tacttactctcgttggtgataaggaacagctaacacaacacacagggtttttctgctcccaaaatgggattcttcagtgcaccaaatcgaagaaagcactggacgtcacgctggtttctccattgtttctccttaacattggaacccgtaacttttgtctaattacattcttacattctcaattaataattgtaaattaaaagtaaaactttccttcaaaagggaacaagttattgtaatgacaaggtttttaattaataaagctcttgcgaatagctaaaa

SEQ ID NO: 719065 - DNA, 190 bp, Homo sapiens
ttttccagtgtgcagtctgcagctgggtgtgcgtgggacttgcgtctgttggggtgtgtgtgcgtggggtgcgtggggcgtgtgtgttgggggtgtgtgtgcgtggtgtgcgttggctgtgtgtgttggcagtgtgtgcgtggtgtgcgtggggcgtttgtcttggggggtccggctgtctgcagggtca

SEQ ID NO: 719066 - DNA, 165 bp, Homo sapiens
ctgagcaggacaccaaagttcctgtgccaggctacacaaaggtaccagagccatgtcctatcaacgatcactaccaggcccagctcagcagaagaccaagcagaagtaatttaggtgcacagacaagcccttgcagaagccaaccaccagatgctaggacaccct

SEQ ID NO: 719067 - DNA, 329 bp, Homo sapiens
atattgcagcttaattgtgtgttgtttcttttctcttgctgcttttaggatcctttctttattacagaccatgtttttatccttgacctttggaagtttattaaatgctttgaggtacttttgtttgggttcaatctgctttgctgctctataaccttcttgtacttggatattgatatctatctctaggtgttggaagctctttgttattattcctttgaataaactttctaaccctgtctcttgctctacctcttctttaaggccaataactcttagatttgcccttttgagactattttctatatcctgtagggatgcttttttat

SEQ ID NO: 719068 - DNA, 952 bp, Homo sapiens
aaggagaaacagttccacgaaagtgatcacacgaatacctgaatgcccaagagtcaggccaagcagcgccaggctgaacctgtggcgctatggagactttcgagctgatgatgcagactgaatttggtcgtacagtccgctaaggaggggatctgggtttggcccccagcgcccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccgaaggctttctggcggcagacccttgtcctctgtggatgatgggcactgctatccacagtctctggcagttggttacatttggaggttggtgggcttgtttgaaaagagaaaaggtcctcaaatcaggaatgcaagcatcagagactatgtcctagtgggacgggagtaatccgaaaaacccaggctggccgcctgctggcacctgcctctatcccagagtgccctcgtcccagtgtctctgtcgcaactggtggactatgtgcattgccggatacgctccatgctcgatttgccggttgtgttcgcgtcgttcgctctgggccagcccatctgtattgaaggtagagagggcgcccaagtaacgtagtgtaacgtgcgtgcctggcaggccccttattggaatagacctgaacagctactaaagaggacgaaccgagggaaactaggaaaaagggaatacggaaggacctgagccacacggcactgtggctgtaagtacgactaacaatggatcataattgtgcttaggatgacatgtggaaacaacagtctagaatgacatgaatcataaataggacaacgtcccagtgggaataagggcgcccaggccctgtataaaaacagaaaaaagtaga

SEQ ID NO: 719069 - DNA, 151 bp, Homo sapiens
cccttttttggggggatttttttccccggggtcccccccccccttccttttgggggggggttttttttttagggttttttttttgggggggggcccccgggggtttttttttttttttttcctttttttctttttaccccctcccctttta

SEQ ID NO: 719070 - DNA, 167 bp, Homo sapiens
  misc_feature (39)..(39): n is a, c, g, or t
  misc_feature (150)..(150): n is a, c, g, or t
  misc_feature (156)..(156): n is a, c, g, or t
gacagcagcccaggcaaaggccaagaccacaggagcctnccggctcatcctgcgctaaaggctgcagaggccccccaagatccgtaactaccattatggactgacttcttcccccacccgcccactgggtgctcggggccttcgcatggngcctgngctttcacctc

SEQ ID NO: 719071 - DNA, 782 bp, Homo sapiens
  misc_feature (1)..(1): n is a, c, g, or t
nccgcaacaatggtggccctggtaaccccgacataaaacagaggtgtgttcctgtgtaatagtgacgcacgccctctctttttagtaagtacaggtagcgctttctatggaggctcaatttgtatggggtatacatatatatggcgaagatggggtcaccacatgcggggcggcttaattatttttatagcccctccgaggtggggaaatggatgacactcacgctacgtgtctgtgtctatcaagatacaaagatatcgaaagctggcggaggagcctcaacttttcggggttacatgtggcacacacatttgcgaacttaaacgaacttgctgcaacatgccgcccctcgcacccaggaactttgggaacgcccccccgcggtggccgaattgattcaacgccacccgggtggcgagagagcgagcccggcaccacacagcgggggtatacaacttctcaagagacagacacaagacagcttgcaggcacccccctgggatgtaaagacaaggcacacctggggcgtgagtcagagacacagacacatctctattcaaagacggcgtgtacaattagataccccctaaccctcgcgaggaaggggaaaaagtctgcccgctacccttgtgtcgaaagtattggattacatacgagtcgtccacagactttgatgaaataggcaccatctatgtggggccctaacttaacgccgcccacggatataaccaggcggttgagccaattttcttccgtaaaaaatatcacacaaatgaacgaaa

SEQ ID NO: 719072 - DNA, 329 bp, Homo sapiens
catcatacatttcaaaatatacaaaggcaatcctcattgaacgcctagacagctgggtcatatacaatagacacatcggtaatgggaccatatttagagaacacttctctatatatctctgtctgtggtgtacaagctcagtcccaaatactccaagacaacagttaggatcaggatttgcccgattcccaatatgacgcctgcgagatagacatgggagaatggctgtggctgtgccgtctacgatcatctcgaatgtaagacctgctacgtgatcgtctatgggagcgggagcgagaccgtgaccgggtataatgccttcgggagct

SEQ ID NO: 719073 - DNA, 393 bp, Homo sapiens
  misc_feature (331)..(331): n is a, c, g, or t
gacacccgtgaagttttactcttaagcacagcccaataagagttgccaaagagcaatgagggtactgttggtgtgaacttgataataaccaaatagtcatcttcatttatttcttgaacttccacacaactctctgtgaccacttccagttcttctaaagtattgggcttttctgggtcccggatagttcgaatcaaatcataaacttctagcgctttctcttccatgatccggggtgccaggcagctccgtgctcagaaaagcctgagagccataggaccctgctcagcgtccaggaaagcagcccagacactcgctccatcctcacgtntccccatccctggcgactgtcccaaccgagccaccgtctttccgcagccgacctcgagagag

SEQ ID NO: 719074 - DNA, 132 bp, Homo sapiens
gcatctctcggctcaccaatatggacccaccgagaaaaatccccccaggctgctatgactgtggagatggcttctataaccccaccaccagggtcatcaaggattatctgaaccgctttctgagaaatgcag

SEQ ID NO: 719075 - DNA, 1318 bp, Homo sapiens
agcgggggacgagccgatcgccgttagcagggagcgggcggtcgccgctccgggccggggtcccgagggcgagcagatcctcacgaatggccctatgggtgctgcgatcgcgacgtgctgggcgtcctgtggcccatggtcagccgcagcggtgggctactgcgatgactgctccaggtgcctggaccctgccatcttaatgactccaggtcttcagcatccatccaccgtggttcaagtgccccgggttgccgtctgtagcccggatgctccaccaggggggcgcccaatggtgcccgcgcctggggctccgcgcgatgcatttggtgcatgcccctcggacgattgcgcactccggcacttgtgtcccccgacgcggacgatgggacgtcccggccctgccaaggtcggaggcaagactgccctcgcgcgggctcgagggtaggatccgctgtgacgtagaaggtcgggggtcccttggaccgggttgctgggccggacgcgcctgcggcgctccggaccccgtgccggtggccggggagcggaggcggacgggagttggcttcgatcgatcgtagttcccctccctccttcgcgtggggttgccccgggcgatgcttgcgttcccccttggggttcgctcgagcgcgccttttgccccatgaagcaccactgtcactatgaacgcgccgactcttgccacacgagcgtcacaatctgatgcgcaatccggaacactcccaattcgtatgtccgagagcaaaagccgtggcggtagtgggaccgactcccccccacttgggcagggcgcataccgttgtccaaactcgacagggctgcccacacaatgcaaaatgccgaagacaaatcccgggtggagagcaccttgggcgaggaaccttcctgtgaattcattcctttggcgaccaagcaaagtaggttcctatttacgaccccctggatggcagagaaacgagcgcattggaactggcggtttgacgaagtatagtgtccccccgcaatccgcggcgaagagacaattttggccgatcccccttgtgaagaagggcgcagacggaggagattggcacacgagcgggagaagagagcctatctcttgttcgcactgtagtcccgctcgatatcgcaattgagcctagcaatatagtcccggacaagagcgcttttccttgcagttagcaatattgtgctttctactcaacgcaagtgtattggatggaccaaccttcggaagagacgtggtccaaccaatagaggaaacatctgtgtacattttggcccgcctttgtaacccacc

SEQ ID NO: 719076 - DNA, 279 bp, Homo sapiens
atcgagctcggtaccgcttggaacagcagtttcagattttggaacattgtgttatacttactggttgagcatcactaatccaaaattcaggccgggtgctgtggctcatgcctgtaatcccagcactttggaggcctgaggtgggcagatagcttgagctcaagggtttgagaacagcccaggcaacatagggtacccccatctctacaaaaatgcaaaaattagccaggcatggtggtgcatgcctatagccccagctactctgtatgggggatctcg

SEQ ID NO: 719077 - DNA, 219 bp, Homo sapiens
gtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacatgtgataataaaatcgctactttaaggggtttgtccaaaaa

SEQ ID NO: 719078 - DNA, 280 bp, Homo sapiens
tagaggattccgtatatgctgtctcaatttcttggaaggcataactcacatttagaaatggacaccagtccagcctgggcgcggtggctcactgcctgtaatcccagctctcagtggaggcaagaggcaggaggatagcttgagctcaggagttcgagacctgcctgggcaatatagcgagaccccgttctccacaaaaagacaaaaaaaaatggacaaaaaaaaaaaattagcgatactccccttaaaaatgggcccccaggccttagggcagagattc

SEQ ID NO: 719079 - DNA, 1822 bp, Homo sapiens
tccgcggcgcggcggaggctctggggttacagcgagagtcttctaatccgcaggcgctgcgggcaggtccattcatcattttggcagcagcacaccagcattcacagcacagtcaccaccaggctgctcaccccaagtagttctgcacatgttcctgcaacagacagcagtcaaccatgtatcagcaacagtggcactccagcagtcagctatcgagcacagcactcattgggcctctccaaccatgccaccagtctggccacatcatgggcattagcatgctaggcacagtcagcatcacagcacacacatagcaggcacagcacacccaattggcacaccagcccaccagtatgacatagggcagcccatcaatggctatgtcacaatgggcggcaacgcacaaggcacagcagcatacccacagttacagcatcgtagggcaaacattgcagcatttggcacacacatcatagcgcgtggcgatccatcatcccaaatgagcgcttcaatcacactcccaaagccaggcagcgcaggcaactgggtcatcacgtcaatggcccgcacacaggccattatcgttctaaacgcaggccgtatgggaccaaaggcaagccataggataggcacacactctccgtgtggcaataggaactcgtcacagtcagcccaacaaaaccgaggaccgagcacatttggcgggcaggcacaagcgcagcaggccatttgcggcacaccgggttaggcacagccgcgtagcgggcacgcgtccagaatccgcatgaccgagcaaagccagggcaatagcacaaagaggcacaagcgatggcgaaaacacgccacatagaccacgcaaagccaaaagggtaaggaaaagacgggcaagcgcaaccatatcccaatcggcgcccacacaaggcatacacgcatcgcaagagacgcatcacatagggcacactaatcggagaacactgagggacaccacacaatacaaatcggagagcggaaccaccacaaagcggtaaggacactacaaacagtcacagtcacgaacacagcatcgagacatgcacacaagatacacggtacacaacagggcacacctatacacccggccaggggaacatcgacaatgaagtaaacacaccaccgaacaccgaggcgaactgcaacgtacactacaggcgtagggggaccgacaccagccacacatacacagtgggcacgcatggcactatggcacatgaagctggcgcgaccgcggctccgtccaggcaccgcccaaatgagctacaagtaacaaagatgcgctgatatgtggaacgcccatcgacgcgcacacgcaggatgaacacagcacgcaacaagcgagcaacagacacatcgtacactgcgagaaccatacacaccacaagaggagagagcacacacgaaacaacgcagaccagtggccacgaccaccagtggcacaatactaccaccacagggcacagactgacaccaaaaccacggcgagcaacgaggcgcaatacaccacggagcacggcaccacatgtcagcgacacacatcgcgcgaccaagacaggaggaaccgaacgctacacgagaacgcgcaaccgcaccaagcacagcacaagaacgacagcggcgacacacaggcgagatgaacagcacaaaagacgacatcgagcacactgaggaacagaccgcacacagagagcacgatgacacagacagactcagacacacacgcacagagcaacacaccacgaacagaaccgcataccgcacaccaagacagacgaacagcaactcaccg

SEQ ID NO: 719080 - DNA, 288 bp, Homo sapiens
  misc_feature (89)..(89): n is a, c, g, or t
  misc_feature (131)..(131): n is a, c, g, or t
tcatagttaatagaccatacttagcaatcatacttttaaagtgggaaagctgaatgacacttttcagacaatgaacattatcaaaacanaatgtataatttcttaatttgaataataaattaagcgtttanatgctattggtagtcttgatatacagaaataacataattagggtgggtctattttcatttggggtagtataagtgtagaatgtactatcatcttcattagttcaattggtatattttcattagtatttaggaaatagcatatatgcagcacccgcaa

SEQ ID NO: 719081 - DNA, 886 bp, Homo sapiens
gaaattaggcaatagggatggtaggattcaaatgtgtgtcattgtagaagtggaagctattagcaccaatgacataaatacatacaagacatcagaactaaaatgtcatgtattaacagttataggtgtcatttaaaaatacaagttcctttatatttctgtcccatcaggacaaactgacaggatatggggaatccattggttatcttccatgtgtcacttctttatggacaggagctaatggaagtgaacagtcatgttcaaaggcaagcatttatagaaaaaacaggagataatgtttaaatttcattatcaaactgggccatctgttttgtgtaactccccgactagttggatgggagagtccccatgctaaaattcagctactcatagataaattcagaaactgggtcaacggcaacctgctgttttagtgtgtgaaccagacgatagacttgcttcagcgagacaattcaatcaattccctatggccagacgaactgggttcagcctaatgtcacaatgtactgttgtaagaactgttactcatcttaagagtgcctatattaagatagatgcatgtctcacacacgggcgtgcaaggacatataaccgacactctcactgcatcacaaagcaagacaagaaggagtgcaatggccatcgctactgacctgaacgtaaggaccaagccaagaatcctcgcgagaggcaggagatcatcctacaggccaaacacacacgcgacaacagcacagggaccaccaaaaacaaaacacaccaagggccagaccatcagaccaagggcgacagacaagcaacacgagcgacaacccacacaaaccacacaacgcacagacaaacaggacagacgaacacgacactc

SEQ ID NO: 719082 - DNA, 334 bp, Homo sapiens
ggaggaaactgaggccccaaggagtggtgacttcccaaagtcaagcaggcaggaagctcttcagccagggctcacacctcagacagaggaccctatgcttttcctgtgtgactcactaacctcatgaatgtgaccctgatggagcagagggcccaagcaggtgcccagccgggatggtccgtgacatccgctttcctgagttggcttgatcaccgtgcttcccctcttctctgtcgttgcagcctccaagtacaccaaggtagagcagctgaccctccgggagcggctggcccgtattcaacacacacaccctcttccaagaagaccacccggc

SEQ ID NO: 719083 - DNA, 286 bp, Homo sapiens
actgttacaacctacattttcattaaactatatcaatatttaccatgtaagtgtatataatattgatatagtttaatgaaaatgtaggttgttaaacagtaggcatattatagcctcatttgggtttgtatattgtaatttaggcatagaaaaatgtcctggcaagcactcagcaagactaatcaaagaaaaaaagagagaagaatcaaatagatgcaataaaaaatgataaaggggatatcaccaccgatcccacagaaatacaaactgtcatcagacaatgtat

SEQ ID NO: 719084 - DNA, 286 bp, Homo sapiens
aggaatgcactcaagtgacctgggccagcaggtatgacactaaatcgttactggcctttctcacccagttaatcagtctctgtactggtctcccttgtggaaacaagtgtctcggttaactaattctgttttatggttgtgctcaaaattcatagcaggtgccgttcattcttgtgcttttagatcaaacccattcccatcatcagcaattattcctgggtttatactcatcagcatcatttaggactttacaagttagttcattgagtagtttatttcaattgtc

SEQ ID NO: 719085 - DNA, 164 bp, Homo sapiens
  misc_feature (76)..(76): n is a, c, g, or t
  misc_feature (161)..(161): n is a, c, g, or t
ggatggcagctggacagggtggtggaggtggcatctgtttgcggacttctggatctcccccaacagatgccacctncaccacctgtccagcaggcagagagctttttgatgatccctcctatgtcaacgtccagaacctagacaaggcccggcaagcagtnggt

SEQ ID NO: 719086 - DNA, 290 bp, Homo sapiens
ccgtaccaggcgcacttctcccactctccaccctctgacaggtccccggtgtgtgttgatccccctctatgtgtccaccgtgtcgtcagttatgttgtttcccctgttataagttacaacatgccgtatcttggtcctctgttcctgtgttagtttgctacggatcatgtcttcctctgaatttactctattatctctcactttcctcatgtcaccgaattcctggaagaaacaatctgcacttgtctccatattctccacttgaccaactccagaagtgcgcctgggtg

SEQ ID NO: 719087 - DNA, 475 bp, Homo sapiens
cacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatc

SEQ ID NO: 719088 - DNA, 345 bp, Homo sapiens
gtaggaacggcggtcacttctccttactatagtcgtggaggatacagagtcacgttccagatctcgatcatactcaactcgatgtctattagagcatgaagactttctgaaacctgccctagagctgggatatcgttagtgggcaacattgttaatggtgtctggtttaaaaagtgaacagttgcctagtgaagttaggtgacttgggacacctttaacagatgactagtttgggtggagttgaaatgctgttcgcattctgcatttgtgtagtttggtgctttgttccaagttaagtgttttcagaaaagtatgttttgcatgtatttttttacagtctaaatg

SEQ ID NO: 719089 - DNA, 582 bp, Homo sapiens
tggggaagaagtagggttcttggccatggtggctccagctactaatcctggttttaaaattacgcaaagaacgatactggcgtatcaatcttcaaatggagttttctacccttaacctggccaattattcacagaaactaatgtcacgggcgcaccggcctataaagctatactggcgaaagatggtgcaaaaagacaaggcaatggccaatttccgagatggtgattctttttataaattcaagaattctccaaatggtgttcacatacctcatcaccataaaaagatagccccaaaatatggtgttctggaggggatatcctgggcaaagcagaaaaatctaatggggataatttccttcaattatactcttcccaaattttaagatttattattttaaaagaaggggttttaaaaggggtaaggttttaaaaccttttttaagagaaaggtccaatttcaatattatcagccttatatggaaataggggccctccgggcagtgagccaaagtactatatactaaagattggacccaaaagatgaccttagaagtcctctggccctcaaggagttagaag

SEQ ID NO: 719090 - DNA, 380 bp, Homo sapiens
gctaatcccttgtaaattaactgtagttcaagaggacagctctttggacactaggccaaacccttgtagagagagtcaaaattttaacacccatagtaggcctaaaagcagccaccaattaagacggcgttcaagctcaacacccactacctaaaaaatcccaaaaatataactgaactcctcacacccaattgggcccactctatcaccctatagaaggcctaatgttagtataagtcacatgaaaacattctcctccgcataagcctgcgtcagattaacacactgaccttacaattaacagcccaatatctacaatcacccacaggtcatttttcccctcactgtcaacccacacaggcatgctcataggggaggtt

SEQ ID NO: 719091 - DNA, 174 bp, Homo sapiens
gtatatacttcaagaaatttaatctttaatctacagattataatatacgcatctagttgattcaatacccatctctcatttatacttacgtaaaatcagtaaatcaatcactgaaactgctttgcgaaattatgacagtaggataaatctgacatagctgactctatcttgcgg

SEQ ID NO: 719092 - DNA, 409 bp, Homo sapiens
aagcagtggtatcaacgcagagtgcccattacggccggcaaaaaaaaaaaaaaaaaaaaaaaaaaaactttttgggcggcgcttaggcccctagaaagaggttttctgaacacaattgtggttggggcgcgcgcgaggccccaagtatgttatagcagacatggcggacatcggggtttcacattagaagagacctcaggcggatagagaacacaaggggctgggagattcctcccccaaatataaaaaaagcccggggggaaccacgcgacgttgttatgcacaaaaactctccagaagtagggcatcaagagggaccaaatagagggggaactcaactaaaacaggggctgtcacaagcagagagctcgaaaataatcaaaaataggacgcccgggcgtaggggggg

SEQ ID NO: 719093 - DNA, 200 bp, Homo sapiens
  misc_feature (13)..(13): n is a, c, g, or t
  misc_feature (44)..(44): n is a, c, g, or t
  misc_feature (200)..(200): n is a, c, g, or t
gagatggactgtnactctgttgctcaggctggaggcagtggcanaatcctggctcactgcaacctccgtctcccaggttcagtctctttgctgttctaaatataaacatgtgagtacatgtgtctttttggtagaacagtttattttcctttgggtatatacccagtaatgtgattgctgggccagatggtaatcttaan

SEQ ID NO: 719094 - DNA, 2376 bp, Homo sapiens
gatccctgctggcggttgtggtgctgcttgcgctgccggtggcctggggtcaatgcaatgccccagaatggcttccatttgccaggcctaccaacctaactgatgagtttgagtttcccattgggacatatctgaactatgaatgccgccctggttattccggaagaccgttttctatcatctgcctaaaaaactcagtctggactggtgctaaggacaggtgcagacgtaaatcatgtcgtaatcctccagatcctgtgaatggcatggtgcatgtgatcaaaggcatccagttcggatcccaaattaaatattcttgtactaaaggataccgactcattggttcctcgtctgccacatgcatcatctcaggtgatactgtcatttgggataatgaaacacctatttgtgacagaattccttgtgggctaccccccaccatcaccaatggagatttcattagcaccaacagagagaattttcactatggatcagtggtgacctaccgctgcaatcctggaagcggagggagaaaggtgtttgagcttgtgggtgagccctccatatactgcaccagcaatgacgatcaagtgggcatctggagcggccccgcccctcagtgcattatacctaacaaatgcacgcctccaaatgtggaaaatggaatattggtatctgacaacagaagcttattttccttaaatgaagttgtggagtttaggtgtcagcctggctttgtcatgaaaggaccccgccgtgtgaagtgccaggccctgaacaaatgggagccggagctaccaagctgctccagggtatgtcagccacctccagatgtcctgcatgctgagcgtacccaaagggacaaggacaacttttcacctgggcaggaagtgttctacagctgtgagcccggctacgacctcagaggggctgcgtctatgcgctgcacaccccagggagactggagccctgcagcccccacatgtgaagtgaaatcctgtgatgacttcatgggccaacttcttaatggccgtgtgctatttccagtaaatctccagcttggagcaaaagtggattttgtttgtgatgaaggatttcaattaaaaggcagctctgctagttactgtgtcttggctggaatggaaagcctttggaatagcagtgttccagtgtgtgaacaaatcttttgtccaagtcctccagttattcctaatgggagacacacaggaaaacctctggaagtctttccctttggaaaagcagtaaattacacatgcgacccccacccagacagagggacgagcttcgacctcattggagagagcaccatccgctgcacaagtgaccctcaagggaatggggtttggagcagccctgcccctcgctgtggaattctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgc

SEQ ID NO: 719095 - DNA, 225 bp, Homo sapiens
accgagtattggagttcagcacggtgctcactgtgtcgacggaacttgtacagggcaggcatgcaccgcagtggtgaatacacgtcgaccaggctccatctaaacgagctgtggaggtcaacaaggtgctcatgtgatcgaaggaacttgtctatgggaggcatgcacggcagtggtgaatacacgtcgacctggatgcatgcttgcagtaggtaaggtactgga

SEQ ID NO: 719096 - DNA, 516 bp, Homo sapiens
caccgatacgctcctaacggcaggttgcagtgagcagatcacgccattgcactccagccaggcagcagagcgagactgtttccaaaaaaaaaaaaatacaaaatttagccagacgtggtagcatacgcccgtagtcccagctgcttaggaggctgaggcaggaaaatcacttgagcccaggaggcagaggttgcaatgagccaagatcctgccattacacttcggctggggtgacagagccagactccatctaaaaaaaaaaaaattctctttaaaaactcaggcacacgggtgtgatctgactggcagttttcccaggctcgggggggcagggacgccggggggaggcttggccctgagatgggagactgggcctcaggactttagagcgaaacagaggaggaggggatgggtcgggatatccaaggcaggatctgccgggagatacgctgtggggggggcacaaagacctcaagaccgggtccgggctgtccctgtcacttgtgactttgtggc

SEQ ID NO: 719097 - DNA, 843 bp, Homo sapiens
  misc_feature (1)..(1): n is a, c, g, or t
  misc_feature (75)..(75): n is a, c, g, or t
  misc_feature (82)..(82): n is a, c, g, or t
  misc_feature (105)..(105): n is a, c, g, or t
  misc_feature (134)..(134): n is a, c, g, or t
  misc_feature (145)..(145): n is a, c, g, or t
  misc_feature (149)..(149): n is a, c, g, or t
  misc_feature (154)..(154): n is a, c, g, or t
  misc_feature (159)..(160): n is a, c, g, or t
  misc_feature (162)..(162): n is a, c, g, or t
  misc_feature (176)..(176): n is a, c, g, or t
  misc_feature (183)..(183): n is a, c, g, or t
  misc_feature (216)..(216): n is a, c, g, or t
  misc_feature (223)..(223): n is a, c, g, or t
  misc_feature (225)..(226): n is a, c, g, or t
  misc_feature (252)..(252): n is a, c, g, or t
  misc_feature (256)..(256): n is a, c, g, or t
  misc_feature (258)..(258): n is a, c, g, or t
  misc_feature (270)..(270): n is a, c, g, or t
  misc_feature (324)..(324): n is a, c, g, or t
  misc_feature (326)..(326): n is a, c, g, or t
  misc_feature (385)..(385): n is a, c, g, or t
  misc_feature (407)..(407): n is a, c, g, or t
  misc_feature (438)..(438): n is a, c, g, or t
  misc_feature (445)..(445): n is a, c, g, or t
  misc_feature (447)..(447): n is a, c, g, or t
  misc_feature (450)..(450): n is a, c, g, or t
  misc_feature (459)..(459): n is a, c, g, or t
  misc_feature (471)..(471): n is a, c, g, or t
  misc_feature (476)..(477): n is a, c, g, or t
  misc_feature (482)..(482): n is a, c, g, or t
  misc_feature (484)..(484): n is a, c, g, or t
  misc_feature (488)..(491): n is a, c, g, or t
  misc_feature (495)..(495): n is a, c, g, or t
  misc_feature (510)..(514): n is a, c, g, or t
  misc_feature (516)..(517): n is a, c, g, or t
  misc_feature (546)..(546): n is a, c, g, or t
  misc_feature (549)..(549): n is a, c, g, or t
  misc_feature (563)..(563): n is a, c, g, or t
  misc_feature (572)..(572): n is a, c, g, or t
  misc_feature (575)..(575): n is a, c, g, or t
  misc_feature (603)..(603): n is a, c, g, or t
  misc_feature (698)..(698): n is a, c, g, or t
  misc_feature (707)..(707): n is a, c, g, or t
  misc_feature (768)..(768): n is a, c, g, or t
  misc_feature (820)..(820): n is a, c, g, or t
ncgtttctatttacatagttccattaattctattagtttgaattagattttaagtccaattttgaaaagcttgcngaatttnttctgaaattacttaaaattacngtatgcgtaaacttacaaaaacatatgcnataccaagggngagnaaagnaaaanngngaagtggctacaanggtcccnggggcatcacctgctcacctaggggccaggggngctgggngnngttccgttactggtaacctatctggntgtnanggttcataagtnacaatgctttttttgtttaaaaaaaaaaaaaagtctgtactttacaagccaaangngaaaatgccacacatcctctttacgctttcatgtaccctaggtcactccatttggttgntaccaactagggtacaatttcngggatcataatcttttcatgaaattaaagcngaaaacngnccnggaaaatcnggcttcaaagtnggggnnacttngngggnnnnatgnaaattctttggaatnnnnngnngggctataaccaatcaggggctctttgcngcnatcatccgcaagtngatccactngcncatgtggttgatcataaccgaggggtgngggggcttttattacggttatgagctcttgtccttctgtttttatttcacctttattatttgggggaaattctgagtcagataaggagctatgtnattccaganagctggaatcagtatcaaaaccatttctggagtgatcactctcagaacaatttctggagtnatacgagtttaaagcgatgctgccaggttcagactggttactacttaaaggngaagaactctctctctctattgg

SEQ ID NO: 719098 - DNA, 2009 bp, Homo sapiens
agaagctagaaagagggcatccgggttgtgcaaatttcagacacacggatatcccgtggcgcctgcgtccggagcccggccctgctgctggactgtccccggccacgcccgccgcccctcccgcatcctggccccttccccacccgacggaatcccggggaggctggaagtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttta

SEQ ID NO: 719099 - DNA, 1271 bp, Homo sapiens
gaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcacgagaatgtttcaagaaatagttgtagagaaaatcttcattccctggctccaaaacattttctttcccacagaaatcatgtaaaactcctccagatccagtgaatggcatggtgcatgtgatcacagacatccaggttggatccagaatcaactattcttgtactacagggtgagttggcagcaacatctcttggtttaagagttccagcacagcgatagtactttctagccacatctcagcaaggaaactaggctattgccacctgctcttaagaggcttgaacacaggtgttaactcctgattgaaatgaacaaagataggagaagattagggggaaaatctgtatccttgctggaaaccagggcagtgcacatataagagtatgctgttcactggatgggaaagaaaaaaacttagaagtgtagtagtcaaagcacacaaacaaccctaacccagagtagacattgctggaagaaagggaagaccatgtagcagctgtgtgagagaatgaatcttaatgataacagcatgatcccttgctagggctgccatcaaaaagtacaggccttcctcgttttattgtacttcgcagatgttatgctttttacaaattgaacgcttgtgggaacgctgtgtaagcatgttcgtcggcatcatttatccaacagcgtgtgttgacttcgtgtctctgtgtagcattttgattattctcacagtatcccagatgttttcattattatcatgtctgtgatagtgatctgtcatcagtgatctttgatgttactattgtcattgtttggggtccctacgaactgcacccatataagacagaaaacttaatcaataaatgtgcgtgctttgactgc

SEQ ID NO: 719100 - DNA, 383 bp, Homo sapiens
  misc_feature (28)..(28): n is a, c, g, or t
  misc_feature (372)..(372): n is a, c, g, or t
acctgctgtcagggaacacacagctganttggggggaggcctggtaacactggcctaacttgatctctgttccccagggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtatgttaccagcgtctaagacccagggttcatctgtgtgaccagtgtctgagtcctgggatcactgagtgaacactgtctcancccaacccagg

SEQ ID NO: 719101 - DNA, 495 bp, Homo sapiens
  misc_feature (441)..(442): n is a, c, g, or t
  misc_feature (452)..(453): n is a, c, g, or t
gaggaaacacactgggtatctttttattaactcaaatattcttgatttcttggtctctaggtcactgtcaagccccagatcattttctgtttgccaagttgaaaacccaaaccaatgcatctgactttcccattgggacatctttaaagtacgaatgccgtcctgagtactacgggaggccattctctatcacatgtctagataacctggtctggtcaagtcccaaagatgtctgtaaacgtgcgtaaacttgcgttggatctttcccatgtctgcaaaagcttcttatggaattatttcaaatgtgggatatgagaaaccttttctgaaaagtgttcggatagatggatgtaagagtttttcttgtaggcatccttgattgttgcttgaaatgttaacttcacgagaatgtttcaagaaatagtgcaaaaatagtttttnnaccccgaggnncggttgaaagacggaacccgccgggccaagagcgggcccccc

SEQ ID NO: 719102 - DNA, 423 bp, Homo sapiens
cagcgaactccagctctgacacaccagctccagctcctgcttgcgggctgccagcctcccccgctgtctctcggcctctgcacacagttctgcctctgctcgcaattgctctgccaggcgggcgcgctcctcttccagctgtgccactcgtgccctggatgctccccacacttcagcgggcgctctcgctgctgtagctcctcgcactttcttgcagctccgtgggccctgtgcgctgcatgcacctcaatcctgcctgcgtcaccctgcatgcggtggcttcacccttggtaaacgagccgccaccactgccatgtgtctcatcgcttgtggtagtgccgcgcagttcctgctgcatcaccctcatgggcgctctgctgctgctggcgcttctggaaggccctgcgagccaggtatccctgc

SEQ ID NO: 719103 - DNA, 1943 bp, Homo sapiens
cggcgcttggcccagtcccgcggtcctcgtcgcgaccggcccgggccgcaggacgccgcgctcgggggagctgagccacctctccgccaggcccgtgcgagcggtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttta

SEQ ID NO: 719104 - DNA, 1919 bp, Homo sapiens
ccctcctgtccttcctgccacctcctgccaggctggctctgggaagtgggtgaaaggagatgccaaggccaacgcgtgggcctctggccacctcccagggtgtggtgcccctctgtgacacctggtacttgggtatgaggaagggatggcttagctgcccagagaaggtggcaggtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttta

SEQ ID NO: 719105 - DNA, 697 bp, Homo sapiens
gggttgttgctgtagtggcggacaggaggtggtactgcatatggcggaatcagtcgagaatccttcaccatggcatccagcccaggtccagcgatcgagcgaggcattgatcctctcgacctccagccctggcgaagctcccggcgtactgatgccctcactccagccctggcgtgatcttccacacatttgaggatgagtccgatgtgctccataggttcgacagaggggcgccctggaggaagacgaggatggagaggagcgaccagtcggagctggcgatgggagcgggactacgcgccatcccagatgctgggcgcactatgaggcgcgagggagtgcatctgtatcatgaggcatgtagatgatggagacggtcaggatcagatcgaggagccaagagggccctgctgcccggttgacccggtgcgatgggtgggcccgcaggacacgaagaggtgcggagatgaggccgcgaagatcgctgatggtgccgccgggagtgatcctggagcgacgctgcgccccctggtgcaaaaggacggcccaggtgtggagtgtgtgtcacaggcatggcacggaggaatgccatgaattgcagggatcactgcattggagagatctggaggaagctggacgcgcatcatcccggggacctactgcagctgtatccgcgggtgaacgcttggagggagct

SEQ ID NO: 719106 - DNA, 602 bp, Homo sapiens
cagggtctcactctgtcacccacagtggattgtgtgatgcaatcatggctcactgcagccttgaactcctgggctcaagtgatcttcccatctgtctcctgaatagttagaactacaggtgtgtcccaccacgcctagctaatgtaaaaaatatacatttgtagagatggggtctcactgtgttgcccagactggctcaaactcctggcctcaagtgagtcttctgccttggcccctcaaagtgttggtattataggcgtgagccagtgcacctggcctcacatgacttttattgcattatactgttataactgttctcttttattattagttggtaatctcttaccgtgcctattttataaattaaattttatcatatgtatatatgcataggaaaaaacatagcatatataaggttcagtagtatacacagtttcaggcattcactgggggtttttgaatgtacccaacacaggtaagggggcgatacttgtaatacatttttaaacgtaaaagtagatatttttgacatacaacatagtttttaagattaagattttttgttgcacaccgccgaaataaaagatggaattctactgaag

SEQ ID NO: 719107 - DNA, 2004 bp, Homo sapiens
  misc_feature (133)..(133): n is a, c, g, or t
  misc_feature (136)..(137): n is a, c, g, or t
  misc_feature (142)..(143): n is a, c, g, or t
  misc_feature (148)..(149): n is a, c, g, or t
  misc_feature (277)..(277): n is a, c, g, or t
gagacagagtctcaccgtcacccaggctggagtgcagtgacgtgatctcggctcagtgcaaactccgcctcctgggttcaagggattctcctgcctcggcctagttttttatttgtagtagagacagggtgtnacnntgttnnccagnntagtcttgaactcctgaccccaggtgagccgcctgcctcggcctcccaaaatgctgggattacaggtgtgagccaccgtgtctggcagggctgaattttgaaagaccagttgactggagaaaccgctngatgggaggggaggctggagagccgactgggcatccatacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttta

SEQ ID NO: 719108 - DNA, 451 bp, Homo sapiens
  misc_feature (3)..(3): n is a, c, g, or t
  misc_feature (19)..(19): n is a, c, g, or t
  misc_feature (45)..(45): n is a, c, g, or t
  misc_feature (112)..(112): n is a, c, g, or t
  misc_feature (286)..(286): n is a, c, g, or t
  misc_feature (289)..(290): n is a, c, g, or t
ganatgagagctgatgggntggggaagtttgagagaccgggtgtngtttaaggccggtatgaacagcaggatgtaaccagcttgcttctgtgctcagaagttaggggaggcngatggaggggaaggagggaaggagttgaggtcttaagaaggcaacttctgggcaatcttccattgtgaggtggggtccacgtccccacaacccacgaacttgggttgccgtgcggcatgtggcaaacctgaggggtgactccaagatgcttcactctgtgtgctggaccgggangcnnccctggcagctgacctgcaggcgctctggccaaccacccggggtgagcccagccattcctgccgagggtgcactggcttggggcagaagtctctggatggctccagcctgtcccgcggagccggccccaccactcacgtcttcccaccggaggccagcacc

SEQ ID NO: 719109 - DNA, 1791 bp, Homo sapiens
cggcgcttggcccagtcccgcggtcctcgtcgcgaccggcccgggccgcaggacgccgcgctcgggggagctgagccacctctccgccaggcccgtgcgagcgcaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttta

SEQ ID NO: 719110 - DNA, 251 bp, Homo sapiens
tgaacccagcaggcttgtgtccttcccctaagggcaatgagttcccccaggctccacgcaggtccagagcggctgtccaggtgcctgggcctcgactcagaaaccttagaaatctacctggtactctattctactgtggctgagctagtgccgaaaccaccaaagtccttcccactcttccctccactttccccagggtgaggcagtctccctacgtctcaccacatgcccatacggcacaagcaacaagc

SEQ ID NO: 719111 - DNA, 1443 bp, Homo sapiens
tggtctaaatttaatgtttacgggtccttcgaattgtgtggtaggggggggggctcccatttggtctcccctccaggtttaagtggagggtttcttcttacttatttagaaactttccgctttcaaagcgaaggcttctcaaatctcatgtgaaaatttatttaatattacgtgcgtgttagaaaaattgaattgagccatacaggattaatataggagtgtttccagtgtgtgggtgttatgtgcctctcggggtatatcccgagtataaccgtctcggggccattcccggaaataggcccgagaaaagtgtgtctgtggtgggaaaaaagtttaaattttaccgcccgaattgaaattattaatatagtgtgcaaaagtcggatttggggggccgtataggttctgggccccctagggtgtgtatagcccgtggaaaaatttgagggagaacactccaggtgaatgttgaaagccccctccatatttagagtgcgcaaaaattcacgagcctccccatattgtggagtggggcaccaatagtgtgtgaaagtgtgtacgccatacaacagcgttttaataccgcgtgtggttcgggtggtatagatctacaggaaattctcaaaaggtgacaataaaaaattggggccataaattatacacaattgttgcccccagttttcgaggggccccacactattaacggggatagcacacagacgacacaggcaattgtgaaatctccccataaggggggccttccaaaaaagccctctgtgggaccacgcgacgaaaaatcaattttatccaatattattgggcaatccccccggttgagacaatgatttgtttggcgccagaaagttctcacagggataaaacaatatacccttttattgaaaacgccgccccgcggggttgtgggagaaaaatataagacgaagtggacacatatctattatgggggtataccacccgcgagaaggcggcgcgtgccaacacaattatatttgccgccccccgaacgagttgagtatcaactaacgcggtctaataaataacccccaatacgttgtgaacacaatcataatgtgggaggggtgtgcctcacacaccacagacaaataatataaaccccccatgttagtaagagccgcccatgttgtagtactaatcataagtatggctgaaaaaaaacgcgataaaccctgagtttttttccaccccaaaggggtgaccaccatataattcaccccgcgggaagcacaaataaacagagtatcgacacaacaggtagggggaagacgaaaatatatcctccacgaagcgacctggtgtcgtcgagactaaaagaataataaattacaaccacggaggagcagcagcacaaagaaaaattcacaaataaatgcaggtgaggtactagtaaaaaaagagggcgcc

SEQ ID NO: 719112 - DNA, 1828 bp, Homo sapiens
actgagcaactagcggaatccagtagcaggccctccggacttttttccttgggtaccaggtactcggggccaggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcatcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgtttgaattacacacaaaaatgttccctgcagcaggtcataaactctgtgaactaatgaagctgacaaacagagctggagtacgtttcccctcacccttcctttcctcctagctcagcaaggggtgctcaggttcaggatgttgtttgttgattcaggctcaaccaggctccgcaagaaaaccttatcaggagattttattttcatgaacaggtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggccttgccatatgccacatgctctgaagggagagtgcttgcatggactttgccaaatcctgtctgctccatctcagttgaatggaaaaggagggaggtggggctggtagataggtgcatttggtgctagtatccaccaggttttgtgtgcatcccgtaatgagcccacttcctgaaaacatttaaagaaaaaagatatcagctggagatggcagtgcgcacatgtaatcccagctactcgggaggtttaggtgggaggatcactcaaacctgggagtttgaggccagcctgggcaacacagcaagaccctgtcttttttt

SEQ ID NO: 719113 - DNA, 515 bp, Homo sapiens
  misc_feature (54)..(54): n is a, c, g, or t
  misc_feature (62)..(62): n is a, c, g, or t
aagaaaggtctctgtattttgaggaactcttatgtagtagaaaagacaaatgcnagaactantaataattttaagtcagggtgagtctattaatagccagcagtgatgcaagagactgtggtcaaagaagggaagctaactctttgtagaggcatcaaaaatgcttcacagaggaggtgacagatttgttaaggatattccaggccgtggagtaataggttttaatttggtgctttaatttggaagaatatctcaggagatggtaatatgtattttaggtctttttttagggctttacaatttctaaaaaatatatttgggcttttatttggaaataactttagacttacaaaaatggcacaaatggtacacagagattatatatgccctccatccagcctcccgtaatgctgatatcttctgtaaacatagtgtagttatttaaaacaggaaatcaacagcagtggtgctattaactgatctacagaccttatttgaattttgccagtcgtctc

SEQ ID NO: 719114 - DNA, 251 bp, Homo sapiens
atggtttgatctcagactggtgcagtgcgtttacaaggctctgtcttaccacagctgtagagtagatcacagccgtgtgtttgccaggtcccaggaacttctatatagtctaggggtaacaaaccaacaaacaaacaaacaaaacaaaacaaaacaaacaaacagaaaacaacaaaaaaacctgcagtgtgtcagtaggctgtggaggtataggacggtaacaccacacgtattttgtaccgacgctcgaa

SEQ ID NO: 719115 - DNA, 174 bp, Homo sapiens
caggaagtcccttgccatcctaaaagcccccccccttttttttaaggagaatgggccagtcctttcccaagtccccacaggggaggtgatagcattgcttttgggtaaattatgtaaagcaaaatttttttaattttcgccctaaaactttttttatttggttttattttgaaa

SEQ ID NO: 719116 - DNA, 2382 bp, Homo sapiens
cggcgcttggcccagtcccgcggtcctcgtcgcgaccggcccgggccgcaggacgccgcgctcgggggagctgagccacctctccgccaggcccgtgcgagcggtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggccttgccatatgccacatgctctgaagggagagtgcttgcatggactttgccaaatcctgtctgctccatctcagttgaatggaaaaggagggaggtggggctggtagataggtgcatttggtgctagtatccaccaggttttgtgtgcatcccgtaatgagcccacttcctgaaaacatttaaagaaaaaagatatcagctggagatggcagtgcgcacatgtaatcccagctactcgggaggtttaggtgggaggatcactcaaacctgggagtttgaggccagcctgggcaacacagcaagaccctgtcttttttt

SEQ ID NO: 719117 - DNA, 180 bp, Homo sapiens
gaggagtctcgtgaggcagggtctcaggagtgagtgtggggggtgagctggaaaggcccagatcagaccagactgtggggctggccgaggctcgtcttttcccaatgggggggaacaccggggcggcgccttttcccttcccttggcggtagacttgggagagaggctgactggtggccc

SEQ ID NO: 719118 - DNA, 1389 bp, Homo sapiens
actgagcaactagcggaatccagtagcaggccctccggacttttttccttgggtaccaggtactcggggccaggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcatcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgtttgaattacacacaaaaatgttccctgcagcaggtcataaactctgtgaactaatgaagctgacaaacagagctggagtacgtttcccctcacccttcctttcctcctagctcagcaaggggtgctcaggttcaggatgttgtttgttgattcaggctcaaccaggctccgcaagaaaaccttatcaggagattttattttcatgaacaggtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttta

SEQ ID NO: 719119 - DNA, 681 bp, Homo sapiens
agcggaaaaagaaaccggtgtgatggttcaggcctgtaatcccagcacttcgagaggctgaggtgggcggatcacttgaggccaggagttcgaaaccaccctgaccaacatggcaaaaccccatctctactaaaaatacaaaaaatctgccagtgtggaggtgcatgcctgtaacccaactacttgggagctgaggcaggaggaatcgcttgaacccaggaggcagaggctgcgtgagcccaagatcacacctactgcattgcagcctggcggagcacagacatgagaaaaccaacgtgaatccgaacaagcatgacttaaggtgactgcctattacctcctggataggttagactggacatcactcaaggaatctgtgctcctgtccctagacatttttcataacgctttagtacagctattagagatttatctataacctaaagtcaggatctgcaagttgttgccatctatctgggataacattaaattcccttcttgccatttatggcactttctgtaagacacgatttctgtgctagagctgcattctaagactgtctattctaacccaagttgtgtctcctcaggacctagcatttgaataggtcggaatatccttctggaaaatgattgactccatcagggaaagagtcaagtcccagtctctgagcgaagata

SEQ ID NO: 719120 - DNA, 2236 bp, Homo sapiens
  misc_feature (133)..(133): n is a, c, g, or t
  misc_feature (136)..(137): n is a, c, g, or t
  misc_feature (142)..(143): n is a, c, g, or t
  misc_feature (148)..(149): n is a, c, g, or t
  misc_feature (294)..(294): n is a, c, g, or t
  misc_feature (369)..(369): n is a, c, g, or t
  misc_feature (432)..(432): n is a, c, g, or t
gagacagagtctcaccgtcacccaggctggagtgcagtgacgtgatctcggctcagtgcaaactccgcctcctgggttcaagggattctcctgcctcggcctagttttttatttgtagtagagacagggtgtnacnntgttnnccagnntagtcttgaactcctgaccccaggtgagccgcctgcctcggcctcccaaaatgctgggattacaggtgtgagccaccgcgcccggcccaattggggtttttaaaagataactctcgtgctacacctaggggaacagggatgcccnggcagccttgggagggcagatctggggtggggtgcctacagggaggtggcgaggccagctgattccatggtcagnccccaggacttggagctgggtatggactagaaccagaggagggcaggtgtgtgaaatgaccantgaccccacccctgggtgcaggtggaaggccccagtgcgcctccaggctggtttcccctcttgccccgcaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggccttgccatatgccacatgctctgaagggagagtgcttgcatggactttgccaaatcctgtctgctccatctcagttgaatggaaaaggagggaggtggggctggtagataggtgcatttggtgctagtatccaccaggttttgtgtgcatcccgtaatgagcccacttcctgaaaacatttaaagaaaaaagatatcagctggagatggcagtgcgcacatgtaatcccagctactcgggaggtttaggtgggaggatcactcaaacctgggagtttgaggccagcctgggcaacacagcaagaccctgtcttttttt

SEQ ID NO: 719121 - DNA, 298 bp, Homo sapiens
tatctgagcacgcggcgctgcagagaattttagtataaatgaaattctcacagataagaagtacaggataattatttgccaagtttgaaactgccattatatttcaaggcattctcttttgggagtggttttatattttaggtttgacatttcagatgatcctcacatcttgaaggtgttatacggagcattacagggtgagtcttatatacatgcaggtgcgatttaatttgaagatacttccatttaaactttatgctgccagagttggccagctaatgcaaaagaattctgatag

SEQ ID NO: 719122 - DNA, 1501 bp, Homo sapiens
gctcagctttgcagagcgcccgacttccccagcagagaggcgtggtttcacgatagggctatggtgccattgtattgggccactgtcctgtacaatgcatgcctgcgcctcctctcgacgcgtgccgagggccgatctggtcgcgagggccgatgctcttctctattcatagctctgcgtttgtacaggtctgggtctgtagggagccagggtgtcagggttgcgtcttgcttggccatcttcagctttcacatctagtggtcctggccaggagaggcccgatgcgcgtgtatcctggccacggtgcatggatgagtcatggacctgtgtgaatgggcgtgttcttatacgatttgtataaagctgggttggaaacactcaattgaaccagatcatgagttcctatgtaaccatggaacaatcgatgcagcagtctccactgatctattccatgtcactcatggcagcaaataccatcatagtgagtgaggaatgtccatggcgccattggccgtagtccatgatacgcaattggtgctttcatgcgtggtcgcttctcgccgtctgtagttgacatagcggggacttggcataaacggttggacacgattgcgccttggggaactttgacaggagcaggaaagcagtccccttcgcgttcgacccgagcgggacttctggagtacatcttcccaagcgccatgtgatccgtgggcggggacctctagactcatggagggggcgttctctgtgggtgtctggtcacgacctaggacgtgtgccgtatgagcgcttatcgcctttgtggataaaatctcgcgatacacagagcgacttcccgtggccctttgtggatcccccgttgtgacgggattgtggcgccttcccctatttcgtgtccgagggccattgcccggcattgtggcgttggtggttggttccatggacatgcgttgtgggccgttgaggccatgggcattctcgtatggcgcttggggatcacctcgtttggcaccttttggaattagggaccctgcgatcttccatgggattgtcctgcgctcggtacccgagagagtcaattgccaccacggaaatgattagccgtccatatatcaaggattgccgcattggaggctttggaacacacccatgtgttcacgggcagcatggttattactaaagaaagggaaaggggggcagctacatttgggccccactttgcgacacaccaaggagaacaatgcacggagagaccccacaccaagtcgtttgttcccattggtcgcaccccttcgtctgaacttagagacgtctgcataaggtgcggatacttaggacactctggggaacgaattttatgcacaactcctggtgtttggcccaattcttcggggaaggtgaatctacaacttcacctttccagagagtgatatcattccgttagggcactcactatcccggagaaatatatcacagaagtgaagacacattggctctg

SEQ ID NO: 719123 - DNA, 838 bp, Homo sapiens
  misc_feature (393)..(393): n is a, c, g, or t
gacacaccctgggtgtctctttgtcctgccggcacgtgaggactcatccagtctgcagcagcgtggggcccctgggatggagacgccatgatccccagcttcacggctctgctctgcctcgggctgagtctgggaccccaggacccatcatgcaggcagggccgcgaccccaaacgcacacctctgggctgagcaatggcgtcatgtgagtcaggtgtgggaacctcatgtgacacatcgtggtgttcaggggacgcctggaggcttcgggagttaccgtctgcataacagaggaaagccctagaaaccgtgggacagacatgaaccctagtggagccatcgaacaagggcagattctcctatcccgatccagtgacatgaggagctatgcangggtagaatacccgaatggttgagcatatcgcatgaccatgtatggctggtcgatcgagggcgcagtgatcccactggtagctggtgattgaccaggaggctacacgtaaaggctaactcctttgcagggcctggccgagtggctctaggtgtggacgctcagcgaaaacgtagccgtggaaacctgcctagtagtcgaagtcagaggactcgccaactggagccctgttgttcttgctgaatcgaggatgcgggatagtcccataccgatacttgaatcgggagagtacacgaagcaccggagctcgatgaagcacaaggctggaacttccccaatgagttcctgtgacctctagtgcactggggggacgttacaggtgctacaagtcacagggcttcttcgcatacctgcaggtgaaacccgagtgaccacgtggagtcatag

SEQ ID NO: 719124 - DNA, 714 bp, Homo sapiens
  misc_feature (346)..(347): n is a, c, g, or t
  misc_feature (351)..(351): n is a, c, g, or t
  misc_feature (355)..(355): n is a, c, g, or t
ccttcccacaggacacgggtgtctcgcagagcacggcacgggcagttctctgggctgcactctgtgacttttcctgctgtaattgctgggcttatcacacagcatgtcagtgggaggccgggggccgggctgcctccactgaaccccttttgctcattcactcggctctgattgggagcaagctccagtgacctcccagcttcagcttccccacctgtagaatgggctgtcacaagcccaagtaaggcccaaatgaggtgacaattgcaggtcgtgatctttctttcttttttttcttcttttttctgagacagagtctcactctgtcgcccaggctggagtgcannggcncganctcggctcactgcaagctccgcctgccgcggccacgccattctcctgccttagcctcccgagtcgctgcgactaccggcgcccggtaccaggcccgggtacattccttgcgttcctggtcgatatggcgctccaccgcctcagccaggatgggcccggtctgggcgcgtcatgctccctacggctgcgattccacgcccttgggacttctcccgggtccgcaccctttcgcccggacgcgttaccttctcttcgcaccctggtgcccgcgctgctctgtcacagtgcagccatctttcgcgcgcccccctgaccgtgccgtgctactgcactctcttcggcgtcttgccgctaggtccg

SEQ ID NO: 719125 - DNA, 711 bp, Homo sapiens
  misc_feature (8)..(8): n is a, c, g, or t
  misc_feature (81)..(83): n is a, c, g, or t
  misc_feature (85)..(85): n is a, c, g, or t
  misc_feature (92)..(93): n is a, c, g, or t
  misc_feature (96)..(96): n is a, c, g, or t
  misc_feature (104)..(105): n is a, c, g, or t
  misc_feature (110)..(112): n is a, c, g, or t
  misc_feature (116)..(116): n is a, c, g, or t
  misc_feature (251)..(252): n is a, c, g, or t
  misc_feature (254)..(254): n is a, c, g, or t
  misc_feature (269)..(269): n is a, c, g, or t
  misc_feature (290)..(290): n is a, c, g, or t
  misc_feature (299)..(299): n is a, c, g, or t
  misc_feature (306)..(306): n is a, c, g, or t
  misc_feature (338)..(338): n is a, c, g, or t
  misc_feature (376)..(376): n is a, c, g, or t
  misc_feature (386)..(386): n is a, c, g, or t
  misc_feature (399)..(399): n is a, c, g, or t
  misc_feature (403)..(403): n is a, c, g, or t
  misc_feature (414)..(415): n is a, c, g, or t
  misc_feature (418)..(418): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (465)..(465): n is a, c, g, or t
  misc_feature (467)..(467): n is a, c, g, or t
  misc_feature (470)..(470): n is a, c, g, or t
  misc_feature (476)..(476): n is a, c, g, or t
  misc_feature (488)..(488): n is a, c, g, or t
  misc_feature (499)..(499): n is a, c, g, or t
  misc_feature (516)..(516): n is a, c, g, or t
  misc_feature (698)..(698): n is a, c, g, or t
caaaaaantttcatgttagagatcaagaaactttcatgttagagatctagaaactttcaagattcgaaatgtaacaaaggnnnanggggggnnaanaaaatccnncaaannngggnggcacatgctgatactgctcattatttcattataacagcccttccaaatcttgaatttgcatttttaaccagtgttagcaaatcctgtatttccctctttgggaaatatgggaagcatgagccagggcatattcnngnggcgaaatctcaggncatcaccccccacaaacaagngatcaagangctttcngtatttatttaaaaaaaaaaaaattccagaanggggaagagaacaatcatcaagggtgtaggggccaganacaggggggnggggggggggggngggnggccttagggnngtnaaagggctagcctcattccaancnggntttaatagggggacctaatntnaanggcgangtttcccatggntctagattccnctgccccacctacaaanatggcacagccagcttgacttgcaaggcctcagttgaaggaccccatgtacatacaggccagtacagcagtactaggctaactagaaggatctcatccccatatgtggtctcatttcaagtctatggatgactaccttcattgctgtgtgcgagatggtttcaccccttgaaaatatggtcncttcagcataaaa

SEQ ID NO: 719126 - DNA, 154 bp, Homo sapiens
  misc_feature (12)..(12): n is a, c, g, or t
catcatggcggnccttggagcttgagatatcagagactgcgaggcaggtggttagcgcctttacctaacagactctgatctggtactgaatcaaagactgactaagactagcagcttgagatattcttctgaccctatcccctagaacaggaaa

SEQ ID NO: 719127 - DNA, 1192 bp, Homo sapiens
tccggcactgccatcggtacggcatccgggcagcagccacatgatccatgccccagtctattcagctgccacctgggcagagcctcatccgatgggggccccccgaaggattcctcacgcccgggtcccagccgccagtcctgaacaccagcagagagccctctcagcatggagatgcaacaggcttccacgtttgccgacagtaaaccagaatgtcccttcaggaggccccagtgccatcgccacagcacctacaggcaaaaccacacgcagtggatgagaaacccagcctgggagccgtgacagctgcaggcaggcccccatcggcatgccatccacagcatgcaagcgcaaccgggcagcgatcaaagcctcgcggctgtccaacagatggagaggagagtaaggcctgacaagctgccatggcatgccaccatcgaccatctcccatactgaggcacaggatgccagacaatgccggcctcgacaacagccgacaacatacgggcagccactcaccagcatccacccgtcccaaattgcagtggcaccaagaacgtgagagaccctaccacatccatactaccacatccacgaagagctcccgaatgtacaaccgagacatatgcaccccgatggactatacatggcccatttgcacccaccgaatatggcattcttgacccaacgcaaacaccaaaacaagagacagacactgacatcactttccatacccaccatcatgccatcactaaacagatgaactgctgagatgatgaaagccatccactagtgtcaggtggcagagacatatggcgacatcacattggactttcatcacacttgctacatgacagcgcacaaacacaggggcagcccttcatcaaacaagaagcaatgacgaggccacaaacctgcaacaactccacttgggcacacgagcatttcgacagccatggggtccaattaacaccattgcacggactgagtgtaagaaaacaaactgtcagcccacggactattcaccctgtgtcacccggtaacgacaaaaccaaaacagcaaccccaccgagcacagccacaaccaaccaagctaacacacagcaacacagagacaccatcacaactaccacggccgtcacagccggacagaacacgcaacgacaaacacccagcagcgcgcccacaccaa

SEQ ID NO: 719128 - DNA, 275 bp, Homo sapiens
  misc_feature (152)..(152): n is a, c, g, or t
gtaccaatcagtctaactccaggtggtagaagacggctagagtctttgccaagcggcagtgggtgacacttttctcagctcccaactactgtggcgagttgacaatgcgtggcgccatgatgatgtgtggacagagacccttcatgtgctcntttccagtatcctctaagcccgcgcgacaacgaacaagtgggaagtactgggcagttccagtggccgtgaacccgtggagtgtcgcagcagattgggagatccatctagacgtcgaccgtgca

SEQ ID NO: 719129 - DNA, 135 bp, Homo sapiens
tctagaggatccctgagagacctgtttgaatggagctgccatcacattgggagcagaaaatgggatgaatgtgagcatgagcaatggtgggagttgatgaacaatgaggggagagagtggatgcgggaatgtggc

SEQ ID NO: 719130 - DNA, 249 bp, Homo sapiens
  misc_feature (65)..(65): n is a, c, g, or t
  misc_feature (87)..(87): n is a, c, g, or t
  misc_feature (96)..(96): n is a, c, g, or t
  misc_feature (99)..(99): n is a, c, g, or t
  misc_feature (112)..(112): n is a, c, g, or t
  misc_feature (211)..(211): n is a, c, g, or t
  misc_feature (225)..(225): n is a, c, g, or t
atttcgtgagaattcactctattttgaggacagcaccaagaagatggtgctaaccacttcaaganaaaccgccccatgatccaaatnccttccgcnagncccaacttccacnattggggataccaataaaccattttgaatggagacacagagccaaaccatatcacgctccttccctgagtccttgacctgaagtagatgcctgggttgnctccatttttcaantgaggctgggactgacatcaggcc

SEQ ID NO: 719131 - DNA, 179 bp, Homo sapiens
ccgctgtaccagttgcggtatagcgggtgtaatcatatgtatacatattgcgctcagatggattgtctaggactcaaatgtgcatctccctaaccgtaaggtacttcatcctgtatccacatcaaatgtgagttgctgccagcaggtggagtcccccctgaaaaatggtacggcggtca

SEQ ID NO: 719132 - DNA, 628 bp, Homo sapiens
gtgagcatcaaactcaaactacgccctgatcggaggatggagtaacaggagtccgcacaaatcggtcatatgaagtaacctagacattattctactatcaagcattactaataagtggctccttaacctctcaatccttatcacaacacacgaacacctctgattattcctgacatcatgcaccattggccgataatatgatttatttccacactagcagtaagaacatactcgaacccccttcgacacttgccgaagggggagtccgaacgtagtctcaggcttcaactatcgaatacgccgcaggccccttcgccctattcttcatagccgaatacaacaaagacattattataataaacaccactcaccatacaatcttcctaggaacaacatatgacgcactctcccctgaactctacacaacatatttgtcaccaagaccctacttctaagcctccctgttcttatgaattcgaacagcatagccccgattccgctacgagcaactcatacaccctcctatgaaaaaacttcctaccatcaccctagcattacttatatgatatgtctccataccattacaatctccagcattccccctcaaacctaagaaatatgtctgata

SEQ ID NO: 719133 - DNA, 427 bp, Homo sapiens
attcagctcgagagtcgcttcgagagaacaggtgcctaggatgtaaattgaggcttaccttctatgattctgtgttccacactacattgttggttgggctcataattccagaaccatagttctctttctactacattcttcatagttgtttctgtgataaaagccattgtgatttctggatatcgtgtgtttttttagaccggaagattttaggatctgtatctctacctgagtttggggatttcatgataatgctgtggaatagggtctatttcattcattatgctgagtgttttgccttattaaaatcggagcttgtaatttaaaaaaattctagagtaattgaaaatattagtgctctagaattggctaatggtttctacaagaactcttaaggcttatttagacataaataaaaaataccaga

SEQ ID NO: 719134 - DNA, 478 bp, Homo sapiens
  misc_feature (145)..(145): n is a, c, g, or t
gcaacgcgcgatagcctccgaagctgggattacaagcgtgcactaccacgccggctaatttttttaatttttagtagtgatggggtttcaccacgttggtcaggctgatctcgatctcctgacctcgtggtccgcccaccttggnctcccaaaatgcccggcggcttattctgtttttaaataacagctttattgagatattaatcatatactgtaaaagtgaacctgttaaattatccaattaaggggtttttagtatattcacaaagttgtacgaccattgccacagttagtttgatgtttcaaggttcatctgtgttgtagaatatatcagtacttacttcattcccttttttttctttttttgagacgggagtcttgctttgttgcctaggctggagtgcagtggtgtgatctcagctcactgcatcctccgcctctgggttcaaacgattctcccacctcagcctcccaagta

SEQ ID NO: 719135 - DNA, 180 bp, Homo sapiens
accagcgcactagcctcatgctggagagggacaagtgcaggttagaattacagcttatgttagacagatactgtgtaaagcatagtgccggacacacggcattagcggttattttatgagattccatcagctcggcctcggtcctctttcttctaacatgaaggtatcatgagaagagaa

SEQ ID NO: 719136 - DNA, 371 bp, Homo sapiens
ccagcactcccagtggtaccaccaagagttaaaccaatggaagagccacaaatgagattcgttggtaatagcctccagtggcccccacagtattggagccattgtgccacccgtaaagcctggaggtgcttttcaactgaatggcgtccgtggctgacaaatggaataaaagagctatgctgtggtgctcaaaatagacacagaaaaaaaaggatcccaaagagagaaagagagagagagagagaaggccaagaagaagaagaaaatggcacacacatgagaggatagcttgtggaaccctctaaaaagcccaatgttaacacagacccatgtatatgactctcacatcctgtgtagaattttttttttct

SEQ ID NO: 719137 - DNA, 243 bp, Homo sapiens
tacaagctcactgacaccctctcggccacggcccaggtgatgaccaagtaccgcgccaccggcgagtacaagcctgatttcgactgggcctttgccaaatggcaggccgctcctgccgtggctgtgcgcgtgggccgcatcggtgccccgttcttcatggtgtcggacttccgtgacgtcggttacgccaacaccactgtgcgccccccgctggacgtctatggccaagtgcctgtgagttct

SEQ ID NO: 719138 - DNA, 141 bp, Homo sapiens
gcatttcctgatagccgtctactagagtttgtatgtgtaccatggagtcatctaaattgtcctaaaatgtgttctttccaggagaatcatctaaattttcctaaaatgtgttcttctaaggaggtagactaggacattatt

SEQ ID NO: 719139 - DNA, 223 bp, Homo sapiens
catatataaatcaagttaaccttctacatactaacatcattttgccatgcaagagtcaaattataagactcacagaatgttaaagccggatgccattaaatagttataactggaagaacttcggtgaattcaccaaaaagtaccaggtattacataatgtgcaggcagttaataggttaacgggataatatgcttaggtggtaatgtgacacaaaatacattg

SEQ ID NO: 719140 - DNA, 175 bp, Homo sapiens
tttttccgggggggggggccccctttttccctttccccccccccccccccccggggggggggagttttttccccccctttccttttttgcccccccctgtttccctttttccccccccggtgtttttcccctttcgggggcggggttcccttttttttaaggggggggtttttta

SEQ ID NO: 719141 - DNA, 307 bp, Homo sapiens
  misc_feature (65)..(65): n is a, c, g, or t
  misc_feature (71)..(71): n is a, c, g, or t
tatttaaaagctgttatggattttctgagccatcagggaaattttctagataattttattggtantgactnctactttaattctattgtgatcagaatatgatctctgatatttcagtcttttgaaatgtactgagacttactgtcttagagacttatggactggcacatggtctatttggtcaatgttctatatgcatgaaaaaagtatattctgtagtttggggtatagtgttgtataagagtcaattaggtttattagttgataatgtttggatcttctataattttactgattcgtttttgcc

SEQ ID NO: 719142 - DNA, 223 bp, Homo sapiens
  misc_feature (210)..(210): n is a, c, g, or t
  misc_feature (218)..(218): n is a, c, g, or t
ctgcctggatgttttatccattattgaaaggggagtgttgaagtctaccgctattgttgtattgctgtcggtttctccattcaggtatgtcaatatttgctttgtatatttaggtgctctgatgttgagtgtgtgtatacttataattgttatatcttcttactgaattgatcattttgtcatgtgatgacctttatctctagagacaanttttcaanattta

SEQ ID NO: 719143 - DNA, 211 bp, Homo sapiens
  misc_feature (67)..(67): n is a, c, g, or t
  misc_feature (97)..(97): n is a, c, g, or t
  misc_feature (165)..(165): n is a, c, g, or t
agcgggaacaatcacttaaaaaagattaagacgtaaatttatgttatgtgttttttgtctgtgtttnttgaatctctactttgggagcccaaggcangagaatcacttcacaccaggcgttcaagacaagcctaggcaacaaagcaagacctcatttctccaacnaattaaaaaaattagccaggtgtgaagtgattgtccccgctgcacc

SEQ ID NO: 719144 - DNA, 741 bp, Homo sapiens
  misc_feature (168)..(168): n is a, c, g, or t
  misc_feature (184)..(185): n is a, c, g, or t
  misc_feature (213)..(213): n is a, c, g, or t
  misc_feature (250)..(250): n is a, c, g, or t
  misc_feature (264)..(264): n is a, c, g, or t
  misc_feature (325)..(325): n is a, c, g, or t
gaatgataccctgaaaactttttgacacttagacgctcagcttgacactaggcattattacacagggaactacaatccatatttggatctgctaagccggcgctctataactacatggattccacaccctgcaggacttcacctcggaaggcctgtctgaagcatcanttctgtggtgctgctnngggatggactccatgcacagtccacttnttgacacattctcacactgtggctggagacccatttnttccatcccatgtngaatgagaatcttgagttgcccacagacagacttgacctttgtgccagaactgtccagagntgtgagttttgttactgaattgcctgtccctgagcttggcctgctggagcatgatgctggaggctgtgtgctggcaggcttgtgctccccttggagaatggctgctacttaacaaggaagtcctggccacaggagtcccctactggctgcacaggacgaagcatgaagcatgccgtggatcccacatgcacttgggcaaggcagccaggttccatagcatcatgcatgtgcattatgggtaccaggtggccagttaaggcccgaggaccactcagcagaattccccacgtgccttacccttaatactcataggatttctgtcaggccctaataactgtgttatccggacaaggttggctggccctaaaatcttaggaactgggacctccttctttagggacccattgtaactttta

SEQ ID NO: 719145 - DNA, 102 bp, Homo sapiens
ggctaggtctttgacctgttagagcagattcaggagagcggtgcctctacacgtagcctccttatcccattcgtccaggtgtacgctatgtgaggtagacca

SEQ ID NO: 719146 - DNA, 112 bp, Homo sapiens
  misc_feature (59)..(59): n is a, c, g, or t
tcttacccacagggtataccctatgtaaatggtgattgggaaactgggaaatactcgtntttataaactacaaaaacgagtacttccaagtttccattcacatttacatagt

SEQ ID NO: 719147 - DNA, 392 bp, Homo sapiens
  misc_feature (237)..(237): n is a, c, g, or t
gcgggcaggcagagactctgcgtgctaggccaagggcgagccctggagctgtttcgttgttgcgtgagagcctctgccagtctggaatagttcgtgctttctgtgctccttgaccagtcccaaggctggcctaggctccccgctcagggtcaccacatcaggtcgtgagtgagagtggctgtacgacagtgggtggtttggagaccttcgacagcctcacggacctggtggagcatntcaagaagacggggattgaggaggcctcaggcgcctttgtctaccttcggcagccgtactatgccacgagggtgaatgcggcttacattgagaaccgagtgttggaactgaacaagaagccggagttggcctttttcgcgggttaccaagtcgaa

SEQ ID NO: 719148 - DNA, 369 bp, Homo sapiens
cagaagcacatgtattataacagagattggtacaagcgcaattttgccatcaccttcttcatgggaaaagtggccctggaaaggatttggatccagcttcaacagaatcacaagaagagcagcccctagtagtcctctttgaaccagccagagtacaggtttccacatgtagcagatggagctcctgttcacaggggctgtcacaaaaactgtagctgatctcgtttagccccacatcttcttcagtggcgccatggcctgtctcgcggcacggtaggtcctggggcactgttgtgcgcctccatcaggtttggtttataggtcagcctgttttctcgaacgtgctgtaaaataaagcccaagcactag

SEQ ID NO: 719149 - DNA, 1371 bp, Homo sapiens
gagatggtgtcagatggcagatgacggaacttgtcgggaactagaacaaacggtgaactccttgctatacttttacaaagagactagatggactttattgccccatgacctaggagctctgatggaacttttaacttgcagacgagactgacttctgcgacgctatctgcgcagcaggcaacatttctaacgcaagcaaagctgcttcacacatgctgaccatgcgctacatcgtctacaacagtgcttcacgctctctactagccattcgacaacagcagactggatctctgcgaactctggcaaccttgactgctcttaacacaggcgacacgcacgacgccactacaacacgctcttgggaacacatctggaccagccgcttcaaccaagtggcccacttcacacacacacgcacaaagacccacacttattcctcttcggcctgcacacctcccagacgaccttagcccctgccagcacaccactctcctgcccacttctgcgggtcacacttgcacgcaaacaaccgcgaaccacatggggctaaacttcgagccttaaaaggcaccacaagtaacgacagacaaaccacttggtaacatcaccgggagcccccaaatgcgttcgacgtaacgcgcggccgttgtccaagccaagccccatagtcgctcccctcagttcaccccgccaaactggctatcctcaaacaggccctcttaaagggaaacgcggcctctgactcaacgctacggaaatggcacacagcgactcacaaacagcatttatcgcttccaatcaccggactttgagagctggccattacagatatgcgcactcccccaccacggcgtcgtccctttcagcgcgcatttggcgctttctcctaagatcggtccaaacggcacctctcgcttccccgaccagcaacaagtctcatcgattccccgagtttgagcccaccccccgtatcaggccgcacagtatcacccgaacaacaaacagcagcagcaacaacactatggaacagcatctctaatatcacacaacccacaaggctcggggtgccagcactccccacctcaacactggtggcctgtaagactcaaacaggccccacctacccaacgggagcaccatcatgaaataagtacgaggaaatacaatcgccacacctggagacaaagcggaggagattgtgcctacacaatggtggtgaccgaccgccaaaccgcccctacgcacgtttgtgactagcctcaaggaggcacctcagcatagccgaccactgaagctaatagacgcacaagagccaataaagacgacaagacgcacacatatcacaccaacaagcagccacttacacgacaa

SEQ ID NO: 719150 - DNA, 3985 bp, Homo sapiens
ggagggctggccagtgaggctcggcccggggaaagtgaaagtttgcctgggtcctctcggcgccagagccgctctccgcatcccaggacagcggtgcggccctcggccggggcgcccactccgcagcagccagcgagccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgagcaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccgttgacgtagctcgag

SEQ ID NO: 719151 - DNA, 729 bp, Homo sapiens
cccttcccgggccatatggattattgcgccgggctttgagggcctggagtcatccgtggctgtgccgcggtagggggcctgctggcactgtttttgccaaggcgtcgcgggtggccgcggtgctaccgcagacaccggactacgtgtggtgggcaccgtcgcccgtaatggcccattccataggatcgtgtattttccacactatagagccctccattcacggaggtccccctctttttcacgggacaccccttggcgccaaccttcgcccgaatcgccgttgtgcctatctatattctctccgtgcgtggttaattcgtacgctttgtttcgccccgccaccaacacgtttttcagcgcgcctatctccgggatgcccccgagcggcttactttctcgggacgtatcccgccgatggcgcattacaccccctggacatccctcatcattctctgagtctccaatcacattctctcaccaccccctggataattaataaaattttccatagaattgagaaaacctcttcgcttttcgaaacgaaatttcctctatattagagagaaccccccctaaaccctcggaggtggaactatatggatgcccccccccctctcccccacctttcggagcacccgtatacattaaattcttagacccaaaaagggagggatcgacccccccaaacggggttcacaacccaaccccaggccccccagacttttccca

SEQ ID NO: 719152 - DNA, 2545 bp, Homo sapiens
ggagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgtggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgtcttttcagtcatgccccctgctcttttgtatttggctaatagtatatcaatttgcactt

SEQ ID NO: 719153 - DNA, 775 bp, Homo sapiens
cagatatttcaagtcaggtatccatgtcccctttgagaattctctaagctaagtatggccaagtccctcaaacgttccttatatgatatggttttcagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgtggtttctgcccatcacctgaacctactgaagttgtgtgaaatcctaattctgtcatctccgtagccctcccagttgtgcctcctgcacattgatgagtgcctgctgttgtctttgcccatgttgttgatgtagctgtgaccctattgttcctcacccctgccccccgccaaccccagctggcccacctcttccccctcccacccaagcccacagccagcccatcaggaagccttcctggcttctccacaaccttctgactgtcttttcagtcatgccccctgctcttttgtatttggctaatagtatatcaatttgcactt

SEQ ID NO: 719154 - DNA, 228 bp, Homo sapiens
  misc_feature (127)..(127): n is a, c, g, or t
  misc_feature (167)..(167): n is a, c, g, or t
ctaagcactgtaccagggcaaggcaaggccagcctggccgacctggggtggaggggaaggaggctgagggccaggtccttgtcccagtggggagctgggggccagcatccctgtgcccccaacaccntcaaccgagcaaactcgggggctcaaggctttcgggtgcncccatccgtagcccctgcccttcctcgctttgtgggtgcgtgctcctgcccccgccactcc

SEQ ID NO: 719155 - DNA, 430 bp, Homo sapiens
gcatggggtctgtttcccctcttcgtggtggtgggagctctcctgcttgctctgaggaaatggagctgcagaacaggatgggggagagaagaagggcctctgtcctttcccagatatctgggctttttcctgatttctccgtagagttagacagttctgggtcttttcaatctgagagggcctagagcatgtctggggcttaggggtaaacttacggagtccccttattcccctgctcctgctgatgtctaatgccagccctgtgctctgcctgcagccccctgactcaggatgacagacaggtggaactgccagtgtagagggaattctaaggtaagattctgactttgatctccactcctaaaacttacctatacccttttccagtcacgttcacctgttggtgacaccaattcccctgaggccacca

SEQ ID NO: 719156 - DNA, 646 bp, Homo sapiens
atctggtgatcaaatttgcatgaatgaggaattgcttcttacggatgagcaaagtaagtggtttcttaagtaggaatgtactcctgatgaagaagctgtgaacattgttgaaatgataacaaaagatttagaatattacataaacctagttgataaagagtggcagggtttgagaggattgactccaattttaaaagaagtcctgcgagtaaaatgctatcaaacagcatcacatgctacaaagaaatctggtatgaaaggaaaagtcagtcaatttggcaaacttcactgttattttaagaaattaccacaactgcctctgccttcagcaaccgccatcctgatcagtcagctaacatctacgagacaagagcttcaccataaaaaagattgtaacttgctgaagactcagatgatcattagcattttttagcaataaagtattttaaaattaaggtatgtatattgtttttagacactactattgcacacttactagactacagtataatataaacataacttttatttgcactgggaaaccaaaaagttcatgtgactcacttcattgctatattttttatttcttgtggtggtctggaatcaaacctgcaatatcttaaaagtatgccttcattcaacaatg

SEQ ID NO: 719157 - DNA, 159 bp, Homo sapiens
gcggccgttgaagcgtgcgggggccgcgcgctgcttctctgaggcaggacggcactgccggaggcgcgttaacaacgacggcggtggtgacgggcaccgggctgcgcgggtgagacacagtaaccctgtttaaactctgcattctgaaaacgtgaaaga

SEQ ID NO: 719158 - DNA, 3679 bp, Homo sapiens
ggagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactgggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgagcaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccgttgacgtagctcgag

SEQ ID NO: 719159 - DNA, 478 bp, Homo sapiens
tggtatggcgggatgatatgcaggagctgaggcagtatgtatagtaagttgaacaccttggcatgaagaatagtagcatggtcttgctgaagtgtcccccgatgcccaccacggcaaaggtcatgccagcgaagtaacagaaggtatctcccacaaacacccgtgatgcggacctctgtaggggaatatgtactccgagcccgttgacagaggcattaacaatcccttctctcacattacaccctatgtgccctgggacctagccctgatcctaggttctgactcagaggagaccccatgttgtgcagcaactctgcaggatccaaggccctaaattcatctattccttgggcctccacgcactcatcccttactactactgggtagagagaaatttcagaatacgaccaactgaagacgcagaaaactccatagaggtatgcgcaggtatagcttcaccaccaccaagggtgggtta

SEQ ID NO: 719160 - DNA, 3132 bp, Homo sapiens
ggagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgagcaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccgttgacgtagctcgag

SEQ ID NO: 719161 - DNA, 95 bp, Homo sapiens
tgatactgccagggatgctgcctgacccaagaacgtgcacatttttgtgagctggatgattgcccagagtgtgtacggcatgcaggggcttggtt

SEQ ID NO: 719162 - DNA, 269 bp, Homo sapiens
ggcccctgctggaccgtggatcccgggcgggcgtgcgggcggcacgtacgaggcccttctactcgcccgggtttccggtgcctcgttctccctgggaccctttcgtcaacatcgaggcctgccaattaagcttttaccatcatggacccatttttttcgggcgcccgaagacgcaaaagacctacttcggcaaaaccaagaggcccttaaccgtcccattcgggacttgcccgcaccaaaaacctagacccacagagaaacatcataca

SEQ ID NO: 719163 - DNA, 3024 bp, Homo sapiens
  misc_feature (1)..(2): n is a, c, g, or t
nnctgagggtagggcagagctgtagcattgtagattaggccttgtttttctgcgttgagcagggcatggggatactggggagagtgagacctggggagaaatgacaccctctctgtcacagacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgagcaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccgttgacgtagctcgag

SEQ ID NO: 719164 - DNA, 4120 bp, Homo sapiens
ggagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgagcaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtccttaattctattaaagaatggagccgctttttttatataagatggcgtggaaaaaaaaaaagggggcaagatccaggccagtgcgtccgttgtgaaggccaaggccataaagaagcggggacaacgggggaagggttgggaaccctggattgacccaacccggtaatttggccggggaac

SEQ ID NO: 719165 - DNA, 222 bp, Homo sapiens
gtctcacatgttgcccaaggctggtcctgaactcctgggctccagctaattccccccgtgcttggcctcccaaagggctgggataacaggtgtgagctccttggacctggtccgaaatgctgcttttgatttccgagtactgttggaagtgtgagggggaaccacgcctatttgttaattgtgagcttccagatgtttctttgctctttggtattctaagat

SEQ ID NO: 719166 - DNA, 517 bp, Homo sapiens
  misc_feature (32)..(32): n is a, c, g, or t
  misc_feature (91)..(91): n is a, c, g, or t
  misc_feature (176)..(176): n is a, c, g, or t
aaagacggggcccagcagagctaggctggganagggcaaacaggtggagcccagaggaccttagggtgatgtgtggccgtgacacttctgnaaagcccaagtgtacatcgagtgacccccatgatgtgaactattgacttcgggtactatgacagaacctgtagtattagaagtgnccatgatttttaaaaatctaaaatatgaatattgggttcaaaagcagagacaaaggcactgcacgaatgtgacgtgttactgacaggggagagggcagatctctctgtacgtcctactcaattttcctacagatataaaactgctctaaaaaatgatattaacaccaacaaaattccatgtttgtagtgaccgtctgggcatttctttacgtttcagaagtaccaggaggatcacggcgcccacagcctggcagctgctccaccacaccttctcacccggtgccgagtgcagctgttcctgtctgaggaggctcagtttggaagcagcccctcttgggact

SEQ ID NO: 719167 - DNA, 4132 bp, Homo sapiens
  misc_feature (3460)..(3460): n is a, c, g, or t
  misc_feature (3509)..(3509): n is a, c, g, or t
  misc_feature (3615)..(3615): n is a, c, g, or t
  misc_feature (3634)..(3634): n is a, c, g, or t
  misc_feature (3649)..(3649): n is a, c, g, or t
ggagggctggccagtgaggctcggcccggggaaagtgaaagtttgcctgggtcctctcggcgccagagccgctctccgcatcccaggacagcggtgcggccctcggccggggcgcccactccgcagcagccagcgagcgagcgagcgagcgagggcggccgacgcgcccggccgggacccagctgcccgtatgaccgcgccgggcgccgccgggcgctgccctcccacgacatggctgggctccctgctgttgttggtctgtctcctggcgagcaggagtatcaccgaggaggtgtcggagtactgtagccacatgattgggagtggacacctgcagtctctgcagcggctgattgacagtcagatggagacctcgtgccaaattacatttgagtttgtagaccaggaacagttgaaagatccagtgtgctaccttaagaaggcatttctcctggtacaagacataatggaggacaccatgcgcttcagagataacacccccaatgccatcgccattgtgcagctgcaggaactctctttgaggctgaagagctgcttcaccaaggattatgaagagcatgacaaggcctgcgtccgaactttctatgagacacctctccagttgctggagaaggtcaagaatgtctttaatgaaacaaagaatctccttgacaaggactggaatattttcagcaagaactgcaacaacagctttgctgaatgctccagccaagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctctgtcggggccttcaaccccgggatggaggatattcttgactctgcaatgggcactaattgggtcccagaagaagcctctggagaggccagtgagattcccgtaccccaagggacagagctttccccctccaggccaggagggggcagcatgcagacagagcccgccagacccagcaacttcctctcagcatcttctccactccctgcatcagcaaagggccaacagccggcagatgtaactggtaccgccttgcccagggtgggccccgtgaggcccactggccaggactggaatcacaccccccagaagacagaccatccatctgccctgctcagagaccccccggagccaggctctcccaggatctcatcactgcgcccccagggcctcagcaacccctccaccctctctgctcagccacagctttccagaagccactcctcgggcagcgtgctgccccttggggagctggagggcaggaggagcaccagggatcggaggagccccgcagagccagaaggaggaccagcaagtgaaggggcagccaggcccctgccccgttttaactccgttcctttgactgacacaggccatgagaggcagtccgagggatcctccagcccgcagctccaggagtctgtcttccacctgctggtgcccagtgtcatcctggtcttgctggccgtcggaggcctcttgttctacaggtggaggcggcggagccatcaagagcctcagagagcggattctcccttggagcaaccagagggcagccccctgactcaggatgacagacaggtggaactgccagtgtagagggaattctaagctggacgcacagaacagtctctccgtgggaggagacattatggggcgtccaccaccacccctccctggccatcctcctggaatgtggtctgccctccaccagagctcctgcctgccaggactggaccagagcagccaggctggggcccctctgtctcaacccgcagacccttgactgaatgagagaggccagaggatgctccccatgctgccactatttattgtgagccctggaggctcccatgtgcttgaggaaggctggtgagcccggctcaggaccctcttccctcaggggctgcaccctcctctcactcccttccatgccggaacccaggccagggacccaccggcctgtggtttgtgggaaagcagggtggacgctgaggagtgaaagaaccctgcacccagagggcctgcctggtgccaaggtatcccagcctggacaggcatggacctgtctccagagagaggagcctgaagttcgtggggcgggacagcgtcggcctgatttcccgtaaaggtgtgcagcctgagagacgggaagaggaggcctctggacctgctggtctgcactgacagcctgaagggtctacaccctcggctcacctaagtgccctgtgctggttgccaggcgcagaggggaggccagccctgccctcaggacctgcctgacctgccagtgatgccaagagggggatcaagcactggcctctgcccctcctccttccagcacctgccagagcttctccaggaggccaagcagaggctcccctcatgaaggaagccattgcactgtgaacactgtacctgcctgctgaacagcctgcccccgtccatccatgagccagcatccgtccgtcctccactctccagcctctccccagcctcctgcactgagctggcctcaccagtcgactgagggagcccctcagccctgaccttctcctgacctggcctttgactccccggagtggagtggggtgggagaacctcctgggccgccagccagagccggtctttaggctgtgttgttcgcccaggtttctgcatcttgcactttgacattcccaagagggaagggactagtgggagagagcaagggaggggagggcacagacagagaggctacagggcgagctctgactgaagatgggcctttgaaatataggtatgcacctgaggttgggggagggtctgcactcccaaaccccagcgcagtgtcctttccctgctgccgacaggaacctggggctgagcaggttatccctgtcaggagccctggactgggctgcatctcagccccacctgcatggtatccagctcccatccacttctcacccttctttcctcctgaccttggtcagcagtgatgacctccaactctcacccaccccctctaccatcacctctaaccaggcaagccagggtgggagagcaatcaggagagccaggcctcagcttccaagaaccaagaagaaaccaccacagaaaaaagccagaccgagaaggagagcgcaagggacctaaaacgatcaaacgaacatatacagcctgatgaccccgatataaaccgatatatatcattgaagatanccacctactaggagccgcgctaaatagcctccacgatgaaatactccancgcggaagcctaataccatatgaacccctgaaaactagaactcctgatcgctagcccgaaaaagaaatataaccgacgagatccctcacgcaaccctatatccaanaaaacccgatgattcaaantatgaattaatcaantaaagcataacaaaaaattagctaaagcgcaatcagattacatcgaatcccgacaattatgagaatagcaacgatgaatgtgcgacataagagaaaacatgtataaatcaataaaagtatcaaaatcccccaatcatacccccccaatcataggtcaaataaagaaagataatgggaggcaaataagggcaaaactcatgcctcagctaactgaaatcacaatgaaaatcacaaaagattcatagcttaacatgaagaaagccccaaaatgcatcacaaaaaaccccccccagactgacgccacgacggtaaactcgctaacaaaaaaccaccaaagaacttctagactaaaaaccttgagaattacaactcgactattaagaaatatgggtgaaaccatggcaagtaggtgaacgtagagttaaagagcttcctgtgtaaatgaaccaagtgtcaaaaaaacagcggtaagaaagacgacga

SEQ ID NO: 719168 - DNA, 260 bp, Homo sapiens
attttccctgctttttttttttaaagggggttgttttgcagtggagaaaaccttttgggggccagacttttggttaccctttcctattttggtgcccatttttggtttcccccccttttataaccataaacctgaaaatgagtaaaactggggggttttttattaaaccaccaccaaaacagcagtttgtgatataacagagggtttaatgggccccccccttttatgcccttcaaaaaatttaattttttttagaatga

SEQ ID NO: 719169 - DNA, 100 bp, Homo sapiens
tctgggctccagaatggtgacgcgcatgaactggatgaagcgagattcccactgatcctacctaccacccagcatgacgccctgtatgccccccagcatg

SEQ ID NO: 719170 - DNA, 394 bp, Homo sapiens
  misc_feature (265)..(265): n is a, c, g, or t
  misc_feature (285)..(285): n is a, c, g, or t
  misc_feature (358)..(359): n is a, c, g, or t
tctcatcttctgatcccaaggtggctctggggtcttgggaacagagagaggtagacaagattaaggtcaaaatgaggattatgaaccgctttctgtaacagctaagtacatagtaagacatcaagaagaggtgtcattagaaggagttttcataagatctaggaaagggaacaacgtgatgatcaacgtttggcagatgaacagttgaacaacacaaaataacacaaggattatagcgaaaatggaacagaagcaaacaaactangaagcttaaaatgctaccancttaaaagtccacagcgtaggtggtccacggcatggcgtttccactagggtcacagaacccgcagttcttctnnttctggctgtctggccgcgcttggctttcattcca

SEQ ID NO: 719171 - DNA, 903 bp, Homo sapiens
tcataaatatacaggtagaaacaaccgtggtgtgccctctacacctaaccagctacctgtcgctcactaatacaaatttccttaaacccactgcgacattgggtgtccctcaccaggttaaccacgagagatgtgtcaacgccaattcttctgggaaacatcaccttggctactgttaattggttacccctgttctcaagccaatagatcgttgttcaagcccttaagacaaattctgtagaacggctattggatgccaacccagtcgcccctcccttcccccaaaatcacctgggtctttcttgagcagattactatgattccctctcccttacgagatcttcgacccgcttttccaaacctttgccaccccccctagcgcccaattttcgaatcatggaaatttgctggaaagtttcaacctccgaaccctaatctcttaacatataacagccatggttagattaaagcgccccttggaagaaattttttataaaggaaagggaataccctcccccatcaatggccaggtactcttctacttaaacacctctttctcactatgatttgcaatatcgcaacataaattttattataattgaggacaaattttaaatattgcgacctctttgaataatcatacaaatataatacgccccgtggacaatatatacgccacaaagtttggggccctaaccaccggaaaacaccccttggagaaaatgttcagtgaagattatacccccccgaccacggacaccattgggttcgattcttttgaaacttttcccataggactggataagttctttaattgtatatataatgacttttttcccaaaaaaaaaaaaggcccaaatggtggacacaaagggaaaaaaaaccctttttttaaaacccaca

SEQ ID NO: 719172 - DNA, 1051 bp, Homo sapiens
acggggaaagaatttcttggacagaaagctccctgattcatcagaagttcaccggacgcgaggggaaacccacagaggtgtcaacaaaccgggcccctaaggggtaagagagcgccctcccctcggggggggcgcgccccccggtgcgcctgcaagggcttttgcacggggcgtgcggttaaacacaggggtttcgccccctttaaggccccttcacggggggtccccttccccaataccgtgggcttctttggcctctcgtccccgtttacccccccattccctttctgactacctggcccctgcaactggcccgagccccagtccccctgagggcccacagcgggggagaacatctggcccccgcctgccccccgggaaactccaaagttgcgcgttggggacccccccgatcattgcccttgttgggaagggcccgcttgacactttccccttggcaccggggtttttggggccttgggggttcgggaacaaaaccctgagcccccccttcccacccccctaaagattgccccctcccccaccgagtcctgaggcacacggtgccctccggcaagaatgtttcaagcgaagcacaggtatccggggacgaatgccttggaatggaagagcgaatgaccctgggtgaatcgaacaatcccggaggtgagaccggtgaacaatcacacgcacaatgcccacaccaccgggccccgccacggcgccctccccgtgccacgcaacaacaccgaggtccacgcttcctcggagggtgtttaattgaatgcccacagctgccacatgctccggccacctgaacaccacacccacgagaaaaggggtaaaacaatgcaccgggtgtcccccacggagggtggcacggggccctgccttcaaaccccggccccctcacacaggggacagttaatttaaaacgagtggccgggaggcatctgccacacctgctggggaggcagagaccctgcaatggccacctctttaaaagggcagctgtacagggctaggttttttcaatgaagtttctgtatta

SEQ ID NO: 719173 - DNA, 981 bp, Homo sapiens
  misc_feature (534)..(534): n is a, c, g, or t
cacagactgttcatgaaaagtttcctttttctagagggtacaggaggtataattgcatgcttctgggtcaagaatgttttagcatattaggagtctaacatagtaggacttcattgcattatgcaaatcttgtatcgtcaccgacccttcctcccatgaaagaatagagataaacagaacatcatgctatgctgagttgcctagtcgcttctatgatgtagagttaatgcaaagaattcacatagcccagcaagtccttttagcagggcattgaatggtcaccaagcgtggtgaatataatttattatacgaagggaattattatcagtgcaattctacaattggaagaagaaaatcattattacttcctgggaagcacccaattcgtctctcttaaacagcgatcacctcttagcacctgagttgaggttctctactcctcttcctagcagtcacaagtagtatttctatataataaatatgctaagggtcccacttaaatttcagagtttcgcgccaatatcagctttcagnccttggagttccgtatatgaaagaaaagctggcaagattttaactcttgtgttaccttatggcgtactctcagaatattccgcggtagaaactttcctttcaaggggataaaagacgggctgatttgtcaactgttggcccactgtattctaggaaatataaccatagcgacgttgaccatttgctttaaaacctcaatgaaccccgtgtgctcaggcataggaatctccacctgggacccggggtgttttccccactctttggttcgcaatttggctggtccactcacattcataaaaaaccccgtgtccatgaaggcttcccatggcgttgagggcaagtagagataagagacataccctgaaataccaaggccctttacaaaatggggctgagaaatctgacagacccccttggctcggcccaatgcttggtgtccctcctata

SEQ ID NO: 719174 - DNA, 267 bp, Homo sapiens
tagaggatccgtcctagctcgcagtgacacatgcttcaggaagccactgtgctgaagcgcattatgctgcttccattactagcagaactcttcatgatcccttaatttctagaaaagctgcaacgtgggggggctacatcgcgctgcagtatgcagtgtcagggcaagtttatgtgtactggcgaactagaaaaaatgtcccaagtttccttccaccatttcctgacacaaagtacagttgcattgctttcttgccttcgcaatccc

SEQ ID NO: 719175 - DNA, 155 bp, Homo sapiens
tactttcttctataaccgccgctttagctatgtaggagaaattctggtatatttagtctttgtcgtcatacaatttcaaggatttaaaaaaaaatttaatacttatgccttaatttcattctttaccccaaagtctttcaagaagcaggaactgg

SEQ ID NO: 719176 - DNA, 81 bp, Homo sapiens
ggcacgagaagaagagaaagagtcggaagacaaacctgaaattgaagatgttggttctgatgaggaagaagaaaagaagga

SEQ ID NO: 719177 - DNA, 255 bp, Homo sapiens
cgttcccgttcctgagtttcttgacttcgccagcttgggtgtctctcccgaggccgacgttctagttgtggctcatccagctgacgctggaacttctcttgttccttctgtacccgttcttcgggcggaaggccgagagcttgtcaagggcttcagctcgggtcgactcgctcatacacgtcagtgccgagatggactgacgatatgccgccagcaagatggcgacgagggtgtccattcgctctttggctgctg

SEQ ID NO: 719178 - DNA, 199 bp, Homo sapiens
cttacctgaattattatgtaatgccttatatttgatactagctacattagctacagattacatcacttttcagagttagagtaacataataccttgtaaaactatagcaaacagcttgaccaaagcaagagtactttaatttcctacattttatcctttaattcttaagtgaccacattttctttgtttcaggttgtaa

SEQ ID NO: 719179 - DNA, 967 bp, Homo sapiens
  misc_feature (727)..(727): n is a, c, g, or t
gctagttctatatccaagtatgttgtggatctttattactgatctctattgtaaatgtgatccaatcacaagattcgggctccaagtcggtctcatatctcgagagtttatttagtaatattatccgtacgttcttgtatggtatatctagatgacccttgcttattcattgcgcagtccatttccaacactgccatctctatacgctctgccgtgatcatcgtctcgataaatgtcgtacaagcatgtatgtatgcatatggttaaggctgtgtcactcatgcaaattctcgtcttggagtttggttgcttacataattctatatatgactgaggtgtagagtgacggtaatctagaaagtccatcgtgttggcatgagtttttttggttccactatacgttggtagctgcaagtagtgttaatggcatactgatgttcggcattgaattgaattcttggatagagtcctataatacaattgagcaatgtatacccacacttggcttcagaagcattcttcatacaggttggttccttaacccgattcatggtaaatgacacagtttgtttcatctattggtactcatgtacttctggcaccgtgggacattcattgcatatagtggtatggcactccgccagcacatgtgggaccctgttgagtttcgttaaacctcactctcctttataaattacccaggctaggggtaaaggggttaatcagncagcgaataagaacagacgtaaatacgaataatggtctcagtggactctccgacgtcgagctattctcgggttcatggaataatttccaggaacctctgatgtccagagacacggtctcccagcaggaacctaaatggcctccaacttacgtcgagaggcactttctggggctggaaagaaatgttgtccatgcatagggagcctgggaccttcaggttggaaacctcgatcctggcggc

SEQ ID NO: 719180 - DNA, 194 bp, Homo sapiens
gccgcgcgtagttctacgccgccggctatggctggattccggtctaccccgtccgacgttcgcaaggtcatgctggaagtagcccccgtgagcgaattgccgctgaccgacgcgaaggtgcgcgccgcggcgcgatcatgctagtttgcgcgcgtgggaacatgaactgggttcgcgtacaagcacgtgccacg

SEQ ID NO: 719181 - DNA, 124 bp, Homo sapiens
tgccttcctatattataggaagtctccactgtgctagatttccataccatcctttaaattcacttcaattttagctccctctcccctcattccctccgtctacccccatcttctgagtcgacgc

SEQ ID NO: 719182 - DNA, 328 bp, Homo sapiens
acacagggaggcagcaccctggcatctgctatactctgctgcagcagccataccttggtcccaccatcacagtgggctgctaaccttgaggagccagagaacaaagttggggcccactacaagtcttgcagagttacagcatgcagaccaggagttgggagctaagtgttggccccctacagtctttcagaaatgaagccagttggtttaatcaaccttatgccacaatcaaactctcaaggtcatcaaataggataaaaggggcaaaaaatccaaaggtcagcaacctcaaagattgaagatagataagctcacaaagatgagaagg

SEQ ID NO: 719183 - DNA, 217 bp, Homo sapiens
gcaggcctccgcagtcacggcttcaacctccgtgatgcgcagcagcgcataattcactggccgcgcaaaggttcgggcgtcgagcagcgtctccgccttgaacttgagcagtggcggcaggccgaggcgctcgtgctcgagcatgtttcggcgccttggcggagcgtgtcccagaagaggatggatcgttcgctgaagtccctctggtagctcaacc

SEQ ID NO: 719184 - DNA, 481 bp, Homo sapiens
aaaaaaaaaaaaaaaaaaaaaaaaaaaaaaaaaaaaaaaaaaaaaaaagggggggggggtttaaatttttcccggggggggccaaattttgggggtcaccagttttttttgtaaaggggggcccaaagggggggggtttttaaagaaggggggggggggcggttaataacacaggcggagcggtgggagaaaaggtgctgctgtgggactttttgggggaagagagaccccattcattgtgtgggggggggggcgagacatattggtggggacacatactcccactaagagagaattattaaagcgactctagggggaaatatatttacatattcagagggtgttacatgggggttacaccaacagcggtagtatattgccagcgcgggacagaagattgtcgatctacgcgggagtttattgattttgatgcgaaatattttatttcaccaggaggagagtgtttttgatataacaaggc

SEQ ID NO: 719185 - DNA, 750 bp, Homo sapiens
agcgggggttacgtgcgcgcgggagcgcccgggcgtacttttgcgtggttgctccaccccctcagccttgccttcgccgccgttggggctggaagttcccgccagggtcccgtgccgggcgagagagatgctgcccgtgccgcctcggctttgaggcgagagaagtgtcccagacccatttcgccttgatgacggcgtacagagcctggccagacattgtccacagggttctccttcgggtccgggacctctgggctccagcacgttggccgaccggccgggaccagcacaggcggcgtttactccttcggaaccgggaacgtctagcaaccccttctgtggggctcaatatgggaaatctgtggacagtacttcaagctccaggcaactacatctggtccttcaagtgggtcttgggaaccgggctctttgggctctaaaccttgccacctgggttcacctctaggaggaaccaactacacggcaattagccaccaactataacttacagggattaactcctgggaaacgccagccacctacattctgcagctacaacagggccttcaggtcttaaggcgatctcagcgtaaagcctgcaagcactactggccaagccatttggctcttacctaatttaccctctaacctcagctaagggtctcggactcatatcggccgggctctgacattcaactccaggcagcaatccaccaggcatatattctagataaatttggtgtgggacca

SEQ ID NO: 719186 - DNA, 623 bp, Homo sapiens
ggctgtacggccggaattagggattcagcaggcggatcggcgtgctgcttaagctggggcgcaggagtgcgatcgctgcggatctgagctgggcacggcgaacgcccgcccggacggtgggactgaagggactcctgaatgtccgcgggacgtgttgcggggcgcccagcacggaggaggcaggcagggagggaataaaggctcaggcaccggcagttctactctggagcccaccagctctcagaggctccggtgactggctctgtgtctccccctggatggacatgtggacggcgctgctcatgctgcaaggcttgtgtgctacccctccttggctgatggtgccaccccatggctgcgctttgtaaccgtgggatgactggggaggggtcccaatgccccattccacacggcccgggaaatggccaggtgccaagtgagatcgctcggactgtgcatatcctgggtggcgagacttcatcctgtctctacgggacaattgtttacttcacgtgggtgtgcaagacatcaatgacaagaggttccaggagacctttgaggacgatattctctgaccgtcccttcgcaagagtgccctggtacgtgctaggcggaaaccatga

SEQ ID NO: 719187 - DNA, 113 bp, Homo sapiens
acctccacagtattcggtggttcagttcacctggatagaatcatctaagctccatgtattacgcactccctcatcattcgactcatcttgacaaagctccatcgctacgatct

SEQ ID NO: 719188 - DNA, 1163 bp, Homo sapiens
  misc_feature (1161)..(1161): n is a, c, g, or t
agcggaggcggggccgggagcgggccctgggcggcccaggagaagcagttcccgctcggctgcgtgatgagtttgcttcatcataacaagcgcgggcttcgggccgcgcagagggacaggaggaaaataagatgtttatttgtatcatccaaagtgaggtagaaaaagaatgagaagattagaaatgtcggacttgtgtgacgctatgtgtacagtttacaaggacatttaagcccatcaaaacctgcaaaatctttacatacacagaagaacagacagttcttcaatgaaccagaagaaaatttctggatggtcatggtatgtcggaatcctataattgaaaaaccagagtaaagatggaaaaccagttattgaatatcaagaggaggagttgtgggacaaggtttatagctcggtgctgaggcagtgctacagcattgtacaagcttttaactggtacatgtctgaaagcatggaagacggaggggtaaagcttctgaaggaacaggattagagaaattcttccatcgggtattgtgaaaacgctaacatttgggagttcatggtgacctaacttgaccatttggggtggaatcaagttcgttcacgttggataaagggacttatttgacaatccagtcctttattaatagaatggagcgaaagcctgaatatagtcaaattaacactggttgtctctaataacggatcaagtcatctgggagtggagatagacaaagattgcctgggaattttatacaaattccttaggaactcctttttccaagggcaattgagacctgagctaacacggaggagagtccccataaagaagcgacattgcgaggagacacttcacacatgagagagattctacgggagctgtaaaccacgagtcataggaggaagatagagattccccaaaatttttggaataaaggaggctttaaagagaacgtgacatgtttaaacagaaaaggagaggggggatatatgaggtgtggacttagcaggtgtgctcacataaaagcatgttgactccaacgtaatgaatcatgagactagtataaatagtgaggcgaggaacttaatattcatgatattcatcacgcaggaagattcataatatatagcatgttgattgtcatgatgatgtggagngc

SEQ ID NO: 719189 - DNA, 1626 bp, Homo sapiens
  misc_feature (1626)..(1626): n is a, c, g, or t
taaatgtaaaaccattggtttaattctaaatcaaatcactttcacaacagtgaaaattagtggactgggttaaggggtggtgccacgtgtacattattcactcattttctcgtgacgtggggtctcaggaaccgtggctccatagctccacaagggtgtggcaggaaggaggggtgagaggctaaaacacacagaaaaacacaacaaaaaaaaggaaagcgtgccttggaaaaaggattgagggtggatagacgcttgccgaagagatggttggagaagggggcctcccgtgttgggggccgagccaggagttcccaagttcagctctccgtgcctatactatagctccgtggcgagaaggggtgagtgtggggcacctcacgaagggttcaaaactcaaatgtggccattgtggccaagccgtgggtttatactataacaggtttcccgagaagagtgccctcgtggtgggcagtgaagactcctcgcgtgggggcactcacactcccattatctcatttgtgagaaaaagtctcgcgaaatgtgtattctccaattattgcctataaccacaacaaagcttatttacaattgttattttctctctgtgggaaaacccccatatttcgtgggtgtgaggtttccacatcgtggagctcaaaaagatccatcatacataccctacacatcataagtttcggggggccgcactcgtgggcccgttagatggggggggggttcccccaagcacaaaatatcctcctttctcagacagcacagagagcaaccatctccctagaaagtggccccccgtgtgcaaaccttttgtggccggggacatttttcccccgacaaacggcgggtgcctccaacagacagacgaaggcacacgaatcccctgctgagcacggggggcgcgtatgccccccacgtcgcaccatgatgccttcttcacacacagaccccctacaactcaccggaggccacgcgaactctaaaaaaaacagggcagcggcggcgggggggaaaaccaacatgctcgcagatcacccccaagtgcgggtggacaactccgcgcgaagcaatatctgataggaagcccccccgctataatacaacagcagacacgtcaccaaattcacacggcgggccctcggcgtctcaaacgccagactggaagaaccaccccgtgggccgggatcgatgcacacaccgcggatccacacgatcagcagacggaaacaagagcaataggcgtgggctcaccatgcaaccgacagcgaggcgagagagtgatccccccacccattgactcctcccaggagcgcccgttgtggaccccccacaaaacacgcggaggccacagtggggtcgacaaacgacctcccaggcgggagggcccacaccccacagcgggcgggacagagcagggggggacgacccacactgaccgagtagtctagagaagcgagtcatagcgaaaggacagcacacagaggacaaccaaccacccggccgcgacaggcagctgcacgccccagacgatgctctgtatgacgaccatcggaacgaagacagaacaacacagacgagctcaacggacagactgggcagcacaaacgacgn

SEQ ID NO: 719190 - DNA, 125 bp, Homo sapiens
  misc_feature (21)..(21): n is a, c, g, or t
gtgagccaaggattggcggcnctttgcactcctcagcctgggcaagagagcaagactctgtctcaaataataataataataataaagctggagacttggccacacctgggctaaaggaaaaaaaa

SEQ ID NO: 719191 - DNA, 217 bp, Homo sapiens
agtgtggtgccccacggagacgttcatggcccagctcccaggacccgcgaatgcggccttacggaaaaaggcgtctttgcagatataattaaggatctcaagatcatcctgcatttgggctgggtcctaaatccagtgacatgggtccttacaagagagagaagtggagaggagcacagaggaggaggccacgtgaccccagagcagattggagtca

SEQ ID NO: 719192 - DNA, 1374 bp, Homo sapiens
ctcaagacaccttccgagcgtcatgtcactccccttccaccctctagctccaccctcagacagatgataatatcaaagacacctgtccgtagcagtctgcagtggagagccgcttcctccgaccctctaggccgatgagtaatctcaagcacacctccgcttagctactacacggaggctgagcggcagaaaaaaccgacgcaaaacccaagaggcagagggcggctgcgtatggaatcctaccttctccgaatcctcaatgcaggcggaggcgctcggtgacgtggaaccggtcacgcgaacccaagtaggcggagggccgctgacgtggaacctatcatcacccgaaccctaatgagtgcgtgaggcgtcggtgcatgtgtgacagccggtgcaggcaagacccgatcaggcgtgaggtgcctgcgtgtaccgtggtggagacccatgcatcgaaccctgaagccctgaagaggctggagagagtcctggatcactgtcgagaacccgttcaactgcaacagccctaggacgtgccgtgacgcgtggcggctagactgtcggtaaccatcgattaccgcggcaacccaacgacccgcggagcgtttgcacgcttgacggaaggacgtgcctaagtgacaaactcaaagccctgcacggcaagtagggtacataagaccctgcaggttgacgcacactaacatattaaggaccatttccgagaagagaaccattgaaggaaaaaagccccgatcacatccgaaggaacactcaactatagaggaaattgcagtcaagctccattttatgacagagtattgacaaaatgccgagcgtctcgagcagagccagaatcggagcttcgtggaaccacgaagcttacttgcgaacccaattgaaacaccatagagaacaccactaggcagacgcgacacacacctctgtcgtgacagaggcacacggacggttccagacgagtgggccccattgaaagaccaaaagaagctatccgtttggggagaatgacagcccttagagccccctttgtgaccgaacggaaccacggaacccgtcggccacgaacatgacacaacgacatacgggaaccacggcacccatgaacaaccgggaagcggaacagcatagtggcaaacagcacacacagagacgggaccacggacaccccaatgcaacgggaaccggcaaccaaaattcgaataggaatagcacaaggagaaacgcgctcctagcaccgacaggagtgaccacaaattacgatgcacaagagacggacagacagtgaattggcgaagagagacaacagtcagagtcatagcaggacaagaacagcacacagacatcacaacgacgaac

SEQ ID NO: 719193 - DNA, 215 bp, Homo sapiens
cctgtgcacccggggtattcttaaggaaaaactcatcgcaccagcttgcggaaaaagaggcaacaggtgccaaacaagtaagatcactgtactgggtgttggacaagataggtatggcagtgtgctatccagcatcctgggcaaacgtctctaggctgagtgaacattagctctgtgtgggagtgttattggcaaggcaggtttataagtacaca

SEQ ID NO: 719194 - DNA, 224 bp, Homo sapiens
acgcgggcaggacgccggagtgggtcccctctccggccttcccgagggcctcagctgcctgctcggcgcctggcccggccgcgggcgggtgttctctgacgtggtggtctgtgaggggttgttgatcaagcatgtcttgagtgtggtcggtgacgccagttagtttgcagcgagaaggttcacacaccccctcttttcattcctcttccacaggtgtgcggccg

SEQ ID NO: 719195 - DNA, 847 bp, Homo sapiens
gaggcatggaggcagccagcgcaggggcttctggctgagggggcaggcggagcttgaatggaaaccgcagataagttgtgttgctctttgaaagatagagactgactacaactacttagaaaatatagtcaactagggttactaagatatgcttagcgtcatagctccgggtaacgtgaattctataaagtagcgttaaggatttttgagagaaaaatgatgaagagtgtagaagagtagcatggggaaggaaaagataaaaggtttctaaaagatgacggaggttgagcatgaagggttcttcatggagtaaagaaatgtattgtaaaagaaaattgagagaaaggactacagtagccccgaattaataccgaagatagagagggcatatgcttggagattaaagtgaaggtgatttaaacggtttaaagtttagtttagaaagtcgtgaggtgattaaaactaagtttgagggcgatctttctaaggagagattaaatcgaaggtgattaagagaccttgtaaatcatatgacgcagggagaaatggtcaatttaacagcctagtgaaggcatttggctaaatcgcagacgaaatgtggaaagattcaattgggagtggtagggatgagacccattgggaaagatagaagtttgaacgtggggaaactggaatgactgtagttcgggaaggcggaggatgcgcattagcagaagatggggaacttagatgataacaacgtgctttaggagataataggttaattaaacctgaaaggttggagggacaacaaaaaagctagggaccaaatgtagggaatgtcacctggagaacttggagttgaaac

SEQ ID NO: 719196 - DNA, 183 bp, Homo sapiens
agctgagtgtgcgctgacgtgtgactattctctacaaaccaccaagacacttggcaacactatacctattatttcggcgcattattctggagtcctaggcacagcatcttacgcctccttattcgagtcgagctgggccagccaggcgaccttctaggtaacgaccacatctacaacgttatc

SEQ ID NO: 719197 - DNA, 262 bp, Homo sapiens
aaagatgagaaagacgaaagcagcttcctctacaagatgagggattctccgagcatccaaggaacagcgtggtgcgctaacgcaccacgttttactattcagcttgaagaggcggtatctgagtttacattgggctcacagactgcttggatcagctatgacgtttacctggttgtcgccaggaaggctggtctccccaccctcttcttctcatgcgacttgacttcccagttcacctgcgccatctcttctcttctcttta

SEQ ID NO: 719198 - DNA, 184 bp, Homo sapiens
cattctggctgcatgcatgtgtatctgtgtgtcgtcgtcttctgcttgtgtgtgcgcgtgtgccatgtggtgcgaactagtgtgcatttgctatatacatgtccccgtccgtccatgtttgcacatggtggccgatggggggtggctgggaggcctaggcagccactgagcctaggtgtgcagg

SEQ ID NO: 719199 - DNA, 323 bp, Homo sapiens
ctttgatgagttgagagaagaaggcttcagaagatcaaactactccaagctaaaggaggaagttcgaacaaatggcaaagaagttaaaaactgaaaacaacattagatgaatggatcactggaataacccaatccagcagaagtcccttacacaggaccctccatggcagctgcaacaacccaccagccaggcagcaactaccgtgcatgcacatgcaccacagcctccagtcacacctgcatgcgatcacactggaacaacgggtatccagtgatggaagacaaaatgcaatgaaatacacagtgagaagagaagtttagag

SEQ ID NO: 719200 - DNA, 115 bp, Homo sapiens
aatatatagcagctcacttcaagctcatgtatatagcaaatcccgagaaatagcagtagcacacaaccagtcctgtgttcagcaatcaggaatgtggtgatcttgtagggagctt

SEQ ID NO: 719201 - DNA, 174 bp, Homo sapiens
ccccccccctttttttttaaacccaggggcgggggtttgcccttttttcccctgttttaggccccccttttccccaaaagggggccggggggtccccaaaaagcaaaaaaaacttttcccctttttccccccccccctttttgttggggtttgcgggaaaagggtttttaaata

SEQ ID NO: 719202 - DNA, 184 bp, Homo sapiens
acatacagcagtatcacgacaggtaatatatagctgtactgtatcagaaatgtgttatacctggctttacacacagtgaatttttaatgagtgtactatatgtgaggtgatgttatttgccaaggagaaacgtttcaaaaatgaagtgggacgggcacggtggttcatgcctgtcatcccagca

SEQ ID NO: 719203 - DNA, 913 bp, Homo sapiens
  misc_feature (3)..(3): n is a, c, g, or t
  misc_feature (84)..(84): n is a, c, g, or t
  misc_feature (130)..(130): n is a, c, g, or t
  misc_feature (232)..(232): n is a, c, g, or t
  misc_feature (265)..(265): n is a, c, g, or t
  misc_feature (269)..(270): n is a, c, g, or t
  misc_feature (277)..(277): n is a, c, g, or t
  misc_feature (283)..(283): n is a, c, g, or t
  misc_feature (290)..(291): n is a, c, g, or t
  misc_feature (295)..(295): n is a, c, g, or t
  misc_feature (300)..(301): n is a, c, g, or t
  misc_feature (308)..(309): n is a, c, g, or t
  misc_feature (319)..(319): n is a, c, g, or t
  misc_feature (322)..(323): n is a, c, g, or t
  misc_feature (337)..(337): n is a, c, g, or t
  misc_feature (341)..(342): n is a, c, g, or t
  misc_feature (349)..(349): n is a, c, g, or t
  misc_feature (363)..(363): n is a, c, g, or t
  misc_feature (366)..(366): n is a, c, g, or t
  misc_feature (372)..(372): n is a, c, g, or t
  misc_feature (375)..(375): n is a, c, g, or t
  misc_feature (389)..(389): n is a, c, g, or t
  misc_feature (420)..(420): n is a, c, g, or t
  misc_feature (429)..(429): n is a, c, g, or t
  misc_feature (438)..(438): n is a, c, g, or t
  misc_feature (446)..(446): n is a, c, g, or t
  misc_feature (529)..(529): n is a, c, g, or t
  misc_feature (548)..(549): n is a, c, g, or t
  misc_feature (556)..(556): n is a, c, g, or t
  misc_feature (594)..(594): n is a, c, g, or t
  misc_feature (599)..(599): n is a, c, g, or t
  misc_feature (610)..(610): n is a, c, g, or t
  misc_feature (626)..(626): n is a, c, g, or t
  misc_feature (634)..(634): n is a, c, g, or t
  misc_feature (650)..(650): n is a, c, g, or t
  misc_feature (733)..(733): n is a, c, g, or t
  misc_feature (757)..(757): n is a, c, g, or t
  misc_feature (762)..(763): n is a, c, g, or t
  misc_feature (839)..(839): n is a, c, g, or t
  misc_feature (907)..(907): n is a, c, g, or t
tangactataaatctctttagttaaatatgtacacattacatggtatttgtataaagaatggaaatggataaagtttttcaggnaaatctaatgcacaaatacaccatcttttagagtataatgtcagtntatcattcgttaacagctgtgttagacagtggctctgctttgtgcaaaacgtgataaacaaaattaggaaaaattctgcaaaattatttagttccccaaggnaattactaaaatagaaaatggcaaaagaaaaanaggnngcgcacnggggcntgattgnntacncaggnnacaatgnncagcactgangtnncccccatatctgcnaagnncttgggnagctttagtctgangtnaaaacnggngtcctagcaattgngctttttatgcagccacatggccaataaggnagatattgncataaaggngccctacnaaatcttcactaatattttgggcagcgcggcggggatttcggataaattccctttttgacattttattcttcacatgagggcnagtgagggcaatgggaagnngaatcanagagtagcacagtacatagacagcatcagggctaaggncaagngctcgcattanatcagggtggcgagcncagaatcnatgtgagagctttgtnataagagtgtcaagatactctccacgctcttcaggggcatggatatgacgaaaaaattctctcagtgcatttggcaagaactnatttctaaaattatgcaaagttanaaggnnaaaaaaaaaatctctcctttcatcaagatagattctcagttttttccaatttagtgttcttgtacagaagataaantttgctatttcctttggcgaatcatccaggatacccttggacataaagtagttcactccctcatctgnggttgg

SEQ ID NO: 719204 - DNA, 667 bp, Homo sapiens
ctcggatgtgtcatatcttgttatcccatcgcttaggttacgagacccatggcgtggctgatcattcttgatgtgtcatgtttgagtactctatgccttatccatacttgcattgaaaacctgaaatctgaactggattaagagagacgatggatggctcacactatgataattcccagctatcttttgggaggctgcagcgctggccccattgcctgaggctcaggagttggagatcatgcctgggcacaccagtcatgaagccccattttctagctaccacatacattagagacacttactctgggcatggctggtgtagcacccttgtaggaccctagcctgtctgaggaggctaaaggcaacgagaagttgcttgaacccgggaggcaggaggcttgcagtgagcccaagatcatgccactgtcgactccaggcgttggcaacagagcaagactcttgttctccagaagatggaggagataaataacattgtgattaacatcctgcatagtttatctgtcctcagtacctagcaagcaaagaaaatgttgaaccatctctcaagaagagggtcatcccaaaaggcctcttaaagatcatgtttgtccccagtgcttaacacacattagtatgttcgatctgcggaaaatggactaagaaatct

SEQ ID NO: 719205 - DNA, 139 bp, Homo sapiens
ctcacgtgatcctcaccgaggggcagaagcaggggaggcgggagatcatcagaggggggaggtgaacccagatgccattgagattctgcacgtcaaaaagaagaaggcccggcggtggtgagccaggtccacccggatg

SEQ ID NO: 719206 - DNA, 328 bp, Homo sapiens
ggagacgggggtctcacatggtgggccggggccagtctcgaactctggaggtcaagtgatcttccggcctcgattccggatatcaaggtgatcttcccgcctcggcctcccagagtgctgagattacagacgtgaacccatgccgggccaggaatttggtttttaaggaaggctttctactaatgggaattcctgggcctgtgagaggatgttactttagaagggaaagggatttttttggttattaaacagagccaccttaagctgaagattccctgtgagaacaaggtacggtccctaagtttcccagtggctgggaatatagaaa

SEQ ID NO: 719207 - DNA, 363 bp, Homo sapiens
gtcgcgtccggttgcggcggctgacggccctggctggatcccgctagctggtgttgcggctgggctggcggtggcaggcggataacaacaaaccccggagccggagccagggaggctggacgggacgggatgggcgacagcgggcgggactcccgaatgcccagacatgctcctcccctaaagtccccttcccgcagtggtagatcccgtcgcgcattctcttcgctgtgtggcacctattctaagggcatacaagtagagacgagtcgcggcagtgcatgatcagggggaggttgtaacaggtaccaaaaggacaggacgagtggaacgcgagcaacggaagtcctagtataggcaggcgca

SEQ ID NO: 719208 - DNA, 391 bp, Homo sapiens
agatgatgctccaagaacaatagcttctttaatttttcttggcttcattctagcaaattctgccagttgtttgggatctgagaggtcaatgccaggtattcctccaggaggaatacctggcattgacctctctgatgccataatcaggaggtgagttcgtctccattgatctgtcttcaaccaatgtctcgatggtcgagtatctttttattcatgcgtgattgaccacagtggtgaccgagaactctgccctccagggtcttgatctgctacctgcttctgctcccacttcttgattgcccgaaaaaaggccgcccgctgccgccgcgccggccccgccgctgaggtaactcttcttgccgcatcttcttgccgccgcccttcttgagcg

SEQ ID NO: 719209 - DNA, 645 bp, Homo sapiens
ttcacgatgcagaaagaccatgagaacgctcaaaccccgcctctcggagccaggtatgtgaaatagtgagtggcccgtatacaagggcaagatgagaatataccgagttagctctggggtcaaaaggctctgaacctcctctctaccagtggtcttctctcccggcctccgaatctacagctcctaggccgcttctagctagatctttaatttttacagaatgtcgcttgattgcgaccaggccatcgagagctagcacataggcgccatccaatggctcacatgcacctccaccttccgggctccaaagcgattctccagcactcagctctcatgtagtagcataggaactgcaggtgcatccacacacgcccggctaaatttcttgtactttaatagtaagacgatggggtttccccaggtcgaccaggctggtctcgaactcctggcctcaggtgtgatccgccggcctccgcctccccaagcgctgagatgtacaggtgtgagccaccgtgcccaggccctcagtaggtatgaaggagtccccagccatcctcccttctgggcctgaccagcttagtactggtccatcttccccggctacatgccccgccaagtactgacaagggaccccccacccaggta

SEQ ID NO: 719210 - DNA, 112 bp, Homo sapiens
gcttcgttaccatggtggagcgagaccgttcccttgggccaccagaagccccattggagggagttccgttttgacctgaccagatcccgcttgggaaggccgttaacagctt

SEQ ID NO: 719211 - DNA, 882 bp, Homo sapiens
ggagagaactagtctcgagttttttatgtttttttttcaataaattgaaagcttttaagaaaaaggcacgttttccttgaataggtaaaaaaagctccccatctgtcccctcccttttggagggagcagcccctattgggaactcgtatgggtaccccagaaactttcagcaaagcaaccattagcctcccgtgacccctctccccgtttccccagcagctaggatgaaggcaacatattcctcacaggtcattgtgatcttgaggtccttcaaggctgactccaagcttcttcacattcccagattacctcatgtgccgccattccagtgccaggtggttgcaagaactgggagcacgtgtggcactttgccgcgcgttgagcaccgagattctggctgacgctgtcctgtgtgcagcgagtctataggcccgcggcccgcagcctgtgccaccctcggagctcgccttcttggtccaggttctggaagcgctcggagggccagtcaagccagcgctgcaaagctctagttaggaacgtccagccgcccgccgaagctcagcatccccggggcgggcgtacataggtgaacagacaccgggaagcagtcgtggcccgttgccaccaggctgttgtctgtgatgaaggtcagcgccagcagtggtagtgttccagaggccaaagtcgcgacggccatcttcttgtcaggcatcgagccaggcagaccggtgctagtcgtgagtaaccccaggcacacgcgggtccccgctggctgacgaaacggagccttgtacccagccgcagttaatgtgggaatcgaacatacagttcccaaagcgcttcttggagccccaggggatggttgcggccgtcccaccttag

SEQ ID NO: 719212 - DNA, 1405 bp, Homo sapiens
atacgtagttgtgtttggtgtgtagacgccgtcactagcaccacagtggagggagtcaccctcagtctgatctgcttattgtcgctctaccatatatagtgcggataccagaagagtgtttcacctcggggggactttctgtatattagtgcctgcacaaacgctgattagttgtcaacacacgggggtatctctgcctgtggtgtgtgctcgcatcacacgggggggtctatccatatggttccaaggtatagtttgttcccccacaggttgcttgtcccccactccactaggggggtagcccctgttcttttcaatagggatataaagtgtgtgccccttttttaattgggctgtgtgaatacacccacggggaaattacccctgttggtatataatcgggggtattcaacatctatattgcaactgtggggggcgcgcaaaacggaatccacccggggttgcaaagaagcgcctaagggtgcgtaaactttgtctgccccctcaacttgccgttgccttaagcccacgccctttctcacgggagtattctttctttaaccgcactctgtggagagctctaaggaatggtgatatattctcgttgtctgggtggcatcttttagaccccctctgttgctcagcacatagagaatgttttcggggtcttcctctgtgtgtgtcctcggtgggtgttcctttatacctcacacagacgcccagtgagaagtgtagcccgcatctgccgacatttggagaggtggggttttatcgagagcgagtgaacataactccgagctctcaataggctgccttctgggttctctctagagaagtaaagagagtgtgggaaaggagaagggggtggggccctcaaatagaagtgttgagagcttcttctggaaacctggcataaggcgtcgcttgggaccaagtgatcaccctggttctttctctctagagattgcgcacgtgcacctggagagtttccactgtgtctttccacaaggttgatatttttcttcgtgcgcctctctgaatagcccacagaaatgggagaggttcgatccacagattctcgacacactgattccctctccttgtttttgacacctcgcttggggtagtgcaacatatctctcttgcttgaagtccacgcgtttggaggtaagagaggcttaagaagacagattgggtgagaaaccaacccaaatctttatcatggtctctcagtcagtaatccattaggcgggaacctctagacccaaatgggtgttaacagttcgtgtccctgtggacactgtgggattgggctgggccaggggaaaggtgatatccattttttttcgataaactagactcggtactgagaagcttttgaataccaactcttggcttaatgaga

SEQ ID NO: 719213 - DNA, 974 bp, Homo sapiens
gctcagcggctctcgggtcccagcgtcccagcgcgcggcccgcgctcctccgccccgctcctcctcctcctcattccatcctcctcctccatctcataggcacccccgatccccatcacatatccagcggctgcagccccacagccccaacatcatccgacgctatacatccatggagacgcgcgatccatcgcccccagtcctattgcatatccatataccatatccattacactatactatcacatatacacatacacccacatggacaatccacgaccacatcaccatcatacacagggatcgacacacatcacacgaggaggaaacaagaaataagtcaatcgaggtgacaccacacgacaacacatggaacacgaggaaaacaatgaacaacagggttcagtccagtcgcacgatatgagccaacagtgacaacaaatggaagggatacggaccacagcgggccggaagtcggtgcacaggagacagacaaaagaaaacaatcagaaccccggacacgcggagaaggacccacccaaacggacaacaaccaagacagagcgccaggaagaacacccacgagacacaaggagaccaaacagcgggcacaccgccgggggacgtaccaacgaacggactcgattccgcaccataggaaccctcactacaaatacaacaggccaacccccggacaaggcgacacagagaaagccacccaggagacaacaccatgaacatgaatgaagcaacagggatcaccagccacggaggagagaaccagcacacgatcaggcgagcggagcgacaacgagagacatatccacaagaggagatatgagagcaaggaccacaacaacaggactgcaagcggcacaaccagttccaggaactcacaaaagtacacagcacgcacaaggagcaaggcaccaccacacaaggagcagccacgttgagcaccccagaggtgaccc

SEQ ID NO: 719214 - DNA, 166 bp, Homo sapiens
gactgtaggaggctagaagtagagatgaaggtgttggtagggttggttccttttgagggttgtgaggaagaatctgtcccatgcctctcctctagcttctggaggtttgctggcaatccatggcgtggaggagcagagtcccagtctctgccttcatcttcatata

SEQ ID NO: 719215 - DNA, 858 bp, Homo sapiens
  misc_feature (100)..(100): n is a, c, g, or t
  misc_feature (106)..(106): n is a, c, g, or t
  misc_feature (108)..(108): n is a, c, g, or t
  misc_feature (112)..(113): n is a, c, g, or t
  misc_feature (151)..(152): n is a, c, g, or t
  misc_feature (156)..(157): n is a, c, g, or t
  misc_feature (165)..(168): n is a, c, g, or t
  misc_feature (170)..(170): n is a, c, g, or t
  misc_feature (172)..(172): n is a, c, g, or t
  misc_feature (188)..(188): n is a, c, g, or t
  misc_feature (194)..(194): n is a, c, g, or t
  misc_feature (210)..(212): n is a, c, g, or t
  misc_feature (219)..(219): n is a, c, g, or t
  misc_feature (223)..(223): n is a, c, g, or t
  misc_feature (225)..(226): n is a, c, g, or t
  misc_feature (234)..(234): n is a, c, g, or t
  misc_feature (240)..(240): n is a, c, g, or t
  misc_feature (254)..(254): n is a, c, g, or t
  misc_feature (257)..(257): n is a, c, g, or t
  misc_feature (263)..(263): n is a, c, g, or t
  misc_feature (267)..(267): n is a, c, g, or t
  misc_feature (269)..(269): n is a, c, g, or t
  misc_feature (273)..(273): n is a, c, g, or t
  misc_feature (276)..(277): n is a, c, g, or t
  misc_feature (285)..(286): n is a, c, g, or t
  misc_feature (290)..(290): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (305)..(306): n is a, c, g, or t
  misc_feature (311)..(311): n is a, c, g, or t
  misc_feature (313)..(313): n is a, c, g, or t
  misc_feature (317)..(317): n is a, c, g, or t
  misc_feature (319)..(321): n is a, c, g, or t
  misc_feature (323)..(323): n is a, c, g, or t
  misc_feature (325)..(325): n is a, c, g, or t
  misc_feature (327)..(327): n is a, c, g, or t
  misc_feature (330)..(331): n is a, c, g, or t
  misc_feature (333)..(333): n is a, c, g, or t
  misc_feature (335)..(336): n is a, c, g, or t
  misc_feature (340)..(340): n is a, c, g, or t
  misc_feature (345)..(345): n is a, c, g, or t
  misc_feature (355)..(355): n is a, c, g, or t
  misc_feature (373)..(373): n is a, c, g, or t
  misc_feature (376)..(376): n is a, c, g, or t
  misc_feature (383)..(383): n is a, c, g, or t
  misc_feature (395)..(395): n is a, c, g, or t
  misc_feature (399)..(399): n is a, c, g, or t
  misc_feature (405)..(405): n is a, c, g, or t
  misc_feature (407)..(408): n is a, c, g, or t
  misc_feature (418)..(418): n is a, c, g, or t
  misc_feature (420)..(420): n is a, c, g, or t
  misc_feature (427)..(427): n is a, c, g, or t
  misc_feature (468)..(468): n is a, c, g, or t
  misc_feature (480)..(481): n is a, c, g, or t
  misc_feature (529)..(529): n is a, c, g, or t
  misc_feature (551)..(551): n is a, c, g, or t
  misc_feature (728)..(728): n is a, c, g, or t
  misc_feature (815)..(815): n is a, c, g, or t
ttcccgggatgggtctgtcctcgggaactgcaaggccctgtgagcgggaggactgggatcccggccgcggctgctggaagcgtcgaagctcagcggggcngcgganantganntgtgcttagaactcatcctggcccgcagagcctgccgnnagtnnctggcgtnnnntntngcgggctcttggagcnactttnccgagcggaagtcagnnngcggctnggantnnggcggganctgctnggaggaatggcgcngcngggttnaagnantgtnttnntgttggcnntganaatnatagcnagnanntgggntntgangnnnantnantanntnannaagnatgangtggagagantaaaagcctcgctggatngcnctttcanaaatttggaatntgcnttctantnnatcgtgggantnagcagcnttggtgctcaggtgccagatgcaaagaaagcatgtacctanatcagatctaannttgatcccagcaatgtggattccctcttctacgctgcccaggccagcnaggccctctcaggatgtgaganctctatttcaaatgagaccaaagatctgcttctggcagctgtcagtgaggactcatctgttacccagatctaccatgcagttgcagctctaagtggctttggccttcccttggcatcccaagaagcactcagtgcccttactgctcgtctcagcaaggaggagactgtgctggcaanagtccaggctctgcagacagcatcccacctgtcccagcaggctgacctgaggagcatcgtggaggagattgaggaccttgttgctcncctggatgaactcgggggcgtgtatttccagtttgaagaagga

SEQ ID NO: 719216 - DNA, 131 bp, Homo sapiens
acccttctacctctctgtgggtttgtcttgacctgtaaacttgggcttaaacttagaaaaaattcttacatgataactcagtgatgctttactcatagtttatggagctccttatagataagatacaaacg

SEQ ID NO: 719217 - DNA, 291 bp, Homo sapiens
atgggagaaattttttgatttaaaatgggggggggtggagtttcccccccgaaatgatagaaaaatggggaagataaggccttttttgggggttccgtggggtaatatttgcaaagtacctacaatgttctggcccctagtaattaattaagaaaatcgggccccccttatttcccagaaagcaggggtgttagttttttggttgactttttttttgccgggcgttcccccctgtttttgtgtcctttaataaaaaatagtaacaataaaggtttacatttttttagtgga

SEQ ID NO: 719218 - DNA, 117 bp, Homo sapiens
gcggcaggtatcacacatggttccatcatgcttgatgcctggaagcatcgtttcagcccattctccatgtcctctttgtagacgttaaatacgtcccaggtcataacaaatttgtac

SEQ ID NO: 719219 - DNA, 308 bp, Homo sapiens
aacgctgatataataaaaaagaaatatacttttatcgaaggtgtatcagaaatccaagaagagcatttacatttttttttaaagccgggcatggaccgggcacagtggctcacacctgtaatcccagcactttgggaggcgaggcaggcagatcacctgaagtcaggagtttgagcccatcctggccaacacggtgaaaccccatctctactaaaaatacaaaaaattagctgggtgtggtgatgcacgcctgtagtcccagctacttaggaagctgagacaggagaattgcttggacctgggaggcg

SEQ ID NO: 719220 - DNA, 263 bp, Homo sapiens
gagacagctgcgctgccataagaagacctacgccttgagcggaataccctctgcccacagtgtagattgccatccgtaacacgggcgatgcgcaccagtgttgcccactgctggagactctgacagacgctgagatggagaagaagactccgcgaccaggacaggaacacgaggcgaatgaggcgctctgcaaacacggccccggaatgaataccagcccattcagcacacggctcccacggacgcatctcagacagattggg

SEQ ID NO: 719221 - DNA, 1857 bp, Homo sapiens
  misc_feature (8)..(8): n is a, c, g, or t
  misc_feature (249)..(249): n is a, c, g, or t
  misc_feature (1847)..(1847): n is a, c, g, or t
caggaagnttgccaaccctgcctgtatagccagcaagaatttctaattatagcaaacagaaacacttgcagaaaaaaaaaaaaatgagaacgggaacatgataattttcaaagaaagagtcttctttcaaggaaagtcaggttcatggttacgaagctgctgaccccaggatcccagcccgtgggagagaagggggtctctgacagcccccacccctccccactgccagatccttattgggtctgagtntcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagcactttgatctccatttaagcaggcacctctgtcctgcgttccggagctgcgttcccgatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgattttttttttttttaacccanaaaaaaaaaa

SEQ ID NO: 719222 - DNA, 1689 bp, Homo sapiens
tgcggaggccggctctgcgcttcgaggccgacccactccgcacaccgaccccggtcacacccggcacttacatatcaggcatgtctccgactgccctccagcggcagacgcagctcctcaggcgcccggcggtacttagtcgggtcggcggccgtcagggaattcgccagtggactgtggattggcgtcgaaccggccacatgagatgcagcccccgacggcagagcagacgctcacagcatccatgtccccacggcctggataccgggagatcatgaggacgccagcgatcagacaagagcagagacatccgccagcgacgcagcaagcacacggcgcacagacacgacccagtggccacacagacgacggccacatgccactacactgacgcgcccaccactggccgtctcacatcatcatgccaggacgagagctcacacgatagcgctgcagagaggaccatttcagagccacaggcaggagcatcacacacgccgagcaccacgcgcgccaactcacgcgcaacaaggaccctcaaccacacacaccagttgccacgacacaccggtgggctcagccactcaaatcctatccaagccctgcaccacctcatccccaccctgcgcataactccaacacatcactcgccgccacgggcgcccccagccgcctcagcgaccacgccggccccgcatcgccgcacgagctaccacgcaatagccgcacggcgaacggacgccacctcgcacgcacctcgcgcaccacccaccaataccactcccacacacggcacactacccgccacaccaaacagacccggacgcgcggacacacacccagagacttacgtcccacaggcacactgcacgcgccttaccaacagccggcaacgcggcacccccacctaccatggagaggccacacacctcccgcttcgccacagctggctctgcgcccccccgcacacggctacggggacgccaaccacacagcgccaggccagccccccgcacaccaaacgacacaaccctctccggccaccaccatcacaccgcacgcccccccacccacctcacattcaccacacggcgcacacactcccaccacggcagacacaaacacggcaaacaacacagccactacagggcacagcccgaccgctccgcgaggcatgcgcccacgcgcagaccacaagcgcgaacaaacagcgacaagcgaccgaaggaaccagcagacagccgctaccccgccggacaaccccagacgaacacccacacacaacaacgcagacacacacgctgccgccccaggaccctgccagccaccaagcagcgataaccacacaccgatacacagcctagccacagtgcccgaccaccaccgaccacaacgacgccaacccacacacggccccagaacgcacacaccctggcagggacggcaggcgcagacgcagaccacccaccaacccacaccgagcgcagcacaccaccgagcgcacgcgagacaccaccaacggcagcacaccatccaccccagaccaccaccacacacctggacgagcgacacagacgcacacagcccacccagcgccagccacccagcgcacgctcacccaccacacagagcaacaagcaccacacacaccgacacgagcgacccgacaaccacgacacagccagcccc

SEQ ID NO: 719223 - DNA, 541 bp, Homo sapiens
  misc_feature (106)..(113): n is a, c, g, or t
tgctgggatgacaggcgggagccactgtgccgggcctcaatttaattatttttaagtttaatggatttccggggagttacgccgagtcggaaaaaaaagaccactnnnnnnnntgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctcacgcctgtaatcccagcactttgggaggccgaggcgggcggatcacctgaggtcaggagttcgagaccagcctggccaacatggtgaaaccccgtctctactaaaaacacaaaaattagccgggcatggtggctcacgcctgtaatcccagcactttgggaggccgaggcaggcggatcacctgaggtcaggaattcgagaccagcctggctaacatggtgaaaccccatctccactaaaaatacaaaattagccaggggtggtgg

SEQ ID NO: 719224 - DNA, 1544 bp, Homo sapiens
  misc_feature (548)..(548): n is a, c, g, or t
  misc_feature (631)..(631): n is a, c, g, or t
  misc_feature (633)..(633): n is a, c, g, or t
  misc_feature (659)..(659): n is a, c, g, or t
  misc_feature (681)..(681): n is a, c, g, or t
tgggaccccgaacatttctggagccgggggctggagcgagctgcggggagccgctccgggtgccctacccccgcgcgcctcagtggtgcctgtgcctgagggcagtgctcgcggttgcggggctctgcgcctgctgtcagtgctggggggcgcgcgagctggcgccagctcggggcagcggaacccagagaagctgatggtggggcggtagctggctggcgacggtgacgacttgacgactcccgcttctgtgtgcccagcctcttccctgccgccagccgcccttttcctccctcccttacgtcccctgagtgcggcagtaccgcctccttcccaggcgctgctggttcctccagacctctcggcgcgggtgagccctattcccagaggcaggtggtgctgacccgtgtagacccaggaggaggaaacagctgtgtaagctcatcatatggtaactggtgggcaccatgtccttgaagcttcaggcaagcaatgtaaccaacaagaatgaccccaagtccatcaactctcgagtcttcattggaaanctcaacacagctctggtgaagaaatcagatgtggagaccatcttctctaagtatggccgtgtggtcggtgttctgtgcacaangngctatgcctttgttcagtactccaantgagcgccatgcccgggcagcntgtgctgggaagagaatgggcgggttgctggccgggcagaccctggatatcaacatggctgaagagcctaattgcctgacagaacctcaaggggctaaagaagagagcagcaatctgccatatacacggctcttcagactatcgggggccgtctgatcgtccgtgcccagtgcccatggcggtccctgtgaagcgaccccgggtcacatgtctgctttggtccggcgtgtcaaaacttaacgtaccctgtctaagtctctttgcccgctcatatacgatttgttcacccgagcgcacactcatgacctaaaggatcaatgttataatgacgcacgatgacgctgacagtgtcgcatcaagaccgtgagtctgactacagatcaagtccaagctattcgatgccctgctgagccgcttggagcagatctgctgcggagacatacggccagtccttatggctagaagaaccggtgatggaggtggcgcctgatggctgtgcggcggcggtggttggtggcagcgcgctgtcggattgcactggtggtgcggtggctgtggttgcagccttactacagccccccaggagactccatttgatgcttgcctgtctcctggggtgagctagacccgatactgacgggactggtagggtcccgaccatgtgccggagagctgcttaaccgttcccacgccgtcggggctttccaataggctgaaggtcggcccccgtaagggtggcccgctatggggcacccggtagcccccgttttgaaaggggggcccccgactttgtcggggtggtttccccccttccgggggtcccccccccttttgcagccgcccctaacgtattttttttttcc

SEQ ID NO: 719225 - DNA, 314 bp, Homo sapiens
tagccgggcattggtggagtgcacccggaaccccaactactggggaggctgaggtggaaggatagcttgagcctgccaggaggaggctgcgttgacctgagacggaaccactggactccagcctatgcaatatagccagaccttgcctcaaaaataaaaagaaaaaagaactcgagggggggcgccggtcccaattcgacctatcaggagtcgtttgacaattacactggcctggcctacaacaccgcattgactgggaaaacgcgtgctttacccatcttaatagccttgcagcagattcgcctttcaccagc

SEQ ID NO: 719226 - DNA, 818 bp, Homo sapiens
  misc_feature (200)..(200): n is a, c, g, or t
  misc_feature (463)..(463): n is a, c, g, or t
  misc_feature (484)..(484): n is a, c, g, or t
  misc_feature (506)..(509): n is a, c, g, or t
  misc_feature (512)..(513): n is a, c, g, or t
  misc_feature (516)..(516): n is a, c, g, or t
  misc_feature (518)..(518): n is a, c, g, or t
  misc_feature (520)..(520): n is a, c, g, or t
ttcccactgacaagacaccccctgggccttggtaataaagaccgagccgggcggattcacaagtccaggagatcgagaccatcccggccaaacacgggtgaaacccgatctccgggcgtgttggcggcgccctgtagtcccagccactcgggaggcagggccaggagaaccgcctgaacctgggagttggagtctgtganccgagatcgtgccactgcactccagccttgccggcctgctgggcacagtggaagtccctggcgctccccgtgtcccgagcaccaggcagacagggatccctggtggtctttccgctcccttagggttccagactggggctgggaggtccggaagtcgctcccggtcctggtactcaggtggcctggcggacgtcgctgctgatcgcgctggggacgctgctggccctggtctgtgtcttcgtgatctgcagaaggtgagcccncgagggcgtccgcgagcgtcncttgtttccagtgtgaccctgnnnnttnntcncngnaggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagccttcgaagaaggccttgcccccctcatctctgaagatcttcctcccacagtcgcacggtgcccgt

SEQ ID NO: 719227 - DNA, 361 bp, Homo sapiens
ctatgaaatccagttcgaaagaatgtgtgtttcataatgacttttaactggctacaaatatttacttgctagggaaatacttgatgtatggttatccttatatttcagagtaactctggatgtgttctttgtctaaaaatagtctgttctgtcagtccttcaaaatattatttattctgaagattgtccctcttgcacttggcagtttattttcggggatacattgtcgggggagaggggtttctgccactctttccagattgagtctgtgctgtttaaggaggactaccatcctgcaactctttttctaattggggctcagaggatgtcgctaaagaaaagttgaagagccctttcagca

SEQ ID NO: 719228 - DNA, 507 bp, Homo sapiens
  misc_feature (106)..(113): n is a, c, g, or t
tgctgggatgacaggcgggagccactgtgccgggcctcaatttaattatttttaagtttaatggatttccggggagttacgccgagtcggaaaaaaaagaccactnnnnnnnntgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctctttcatgtttgtgaacccaggtgggaagccttgggcaggtgcggagaatctgacctgctggattcatgacgtggatttcttgagctgcagctgggcggtaggcccgggggcccccgcggacgtccagtacgacctgtacttgaacgttgccaagtaggtgtgcccgtgggcagaggccgggctgtccctggtgcgggtgccatccgcgtgggggtcgtcccccaaccttacc

SEQ ID NO: 719229 - DNA, 360 bp, Homo sapiens
gcgttttttagtataaccaacacatagacagacaaagcaagtaaccatcggctagtctatggcatcaagcgtgagcttcaactcattgtctgccattttctgaccatggaacacattttgtcacgggttagatccatgccattggaagttagtccggcatgttttgaccctgtaacatcttcagtaatcagcttgaattttctatatgcagcttcatcattctgcaaatcagctagactcacttcaaacatcagcgacccttgagaccatcagatgctatttcggttccttgggtcctggtgacgagcgtcttgcccatatttcttatatcgaacatagcacgtgctttcacatccttaa

SEQ ID NO: 719230 - DNA, 1623 bp, Homo sapiens
  misc_feature (8)..(8): n is a, c, g, or t
  misc_feature (249)..(249): n is a, c, g, or t
  misc_feature (1613)..(1613): n is a, c, g, or t
caggaagnttgccaaccctgcctgtatagccagcaagaatttctaattatagcaaacagaaacacttgcagaaaaaaaaaaaaatgagaacgggaacatgataattttcaaagaaagagtcttctttcaaggaaagtcaggttcatggttacgaagctgctgaccccaggatcccagcccgtgggagagaagggggtctctgacagcccccacccctccccactgccagatccttattgggtctgagtntcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagcactttgatctccatttaagcaggcacctctgtcctgcgttccggagctgcgttcccgatggtcctcctttggctcacgctgctcctgatcgccctgccctgtctcctgcaaacgaaggaaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgattttttttttttttaacccanaaaaaaaaaa

SEQ ID NO: 719231 - DNA, 1462 bp, Homo sapiens
  misc_feature (1452)..(1452): n is a, c, g, or t
ttttgtctgtatgattccatttattccctatgtccagatacaagcaaatccacagagacagaaagtggatgagtggttgccacaggctggggaagaggaaggacgggtctttaatgggtctggagtctccttttggggtcgtgacaatgttcaccgctttccctccagaagcagctccttctgctgtgagcaccaggctctggaaggggcaagcgtccttcattacccacaacccagtttcacagccagtccccgctgcctgactctcttaggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgattttttttttttttaacccanaaaaaaaaaa

SEQ ID NO: 719232 - DNA, 811 bp, Homo sapiens
  misc_feature (23)..(23): n is a, c, g, or t
  misc_feature (36)..(37): n is a, c, g, or t
  misc_feature (43)..(43): n is a, c, g, or t
  misc_feature (55)..(55): n is a, c, g, or t
  misc_feature (80)..(80): n is a, c, g, or t
  misc_feature (88)..(88): n is a, c, g, or t
  misc_feature (95)..(95): n is a, c, g, or t
  misc_feature (107)..(107): n is a, c, g, or t
  misc_feature (146)..(147): n is a, c, g, or t
  misc_feature (150)..(150): n is a, c, g, or t
  misc_feature (154)..(154): n is a, c, g, or t
  misc_feature (157)..(157): n is a, c, g, or t
  misc_feature (196)..(196): n is a, c, g, or t
  misc_feature (211)..(211): n is a, c, g, or t
  misc_feature (224)..(224): n is a, c, g, or t
  misc_feature (228)..(228): n is a, c, g, or t
  misc_feature (234)..(234): n is a, c, g, or t
  misc_feature (267)..(267): n is a, c, g, or t
  misc_feature (278)..(278): n is a, c, g, or t
  misc_feature (283)..(283): n is a, c, g, or t
  misc_feature (303)..(303): n is a, c, g, or t
  misc_feature (305)..(306): n is a, c, g, or t
  misc_feature (317)..(317): n is a, c, g, or t
  misc_feature (351)..(351): n is a, c, g, or t
  misc_feature (355)..(355): n is a, c, g, or t
  misc_feature (365)..(365): n is a, c, g, or t
  misc_feature (381)..(381): n is a, c, g, or t
  misc_feature (386)..(386): n is a, c, g, or t
  misc_feature (405)..(405): n is a, c, g, or t
  misc_feature (416)..(419): n is a, c, g, or t
  misc_feature (429)..(429): n is a, c, g, or t
  misc_feature (432)..(432): n is a, c, g, or t
  misc_feature (439)..(439): n is a, c, g, or t
  misc_feature (447)..(447): n is a, c, g, or t
  misc_feature (797)..(797): n is a, c, g, or t
tagtgccttagattccagcgagntacgcaaacaatnntggtcnagccgagcttgnttccccaaatcccgtaatccttgancttattcncccaaanaagcggtctccngggaaaggagcgccctggcggagaagactcgaacggatnncanaganggncgttggggtaaaggccactcttcacctccaccatgagcntggacatccagagcntggaaatccagtntgangagctnagcgacgctagatgggccgagctcctccctctnctccagcagtncaaantggtcaggctggacgacttntnnatcacggaaanacggtgaaaggacatcagctctgcacttcgagtnaacnctgcactggnagaactaaacctgcgnacaancgagctgggcgatgtcggngtgcattgcgnnnnccagggcctncanacccccncctacaanatccagaagctgagcctccagaactgctgcctgacgggggccggctgcggggtcctgtccagcacactacgcaccctgcccaccctgcaggagctgcacctcagcgacaacctcttgggggatgcgggcctgcagctgctctgcgaaggactcctgggacccccagtgccgcctgggaaaagctgcagctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactcccctgccagctggagngctcaagctggaga

SEQ ID NO: 719233 - DNA, 1370 bp, Homo sapiens
  misc_feature (106)..(113): n is a, c, g, or t
  misc_feature (1360)..(1360): n is a, c, g, or t
tgctgggatgacaggcgggagccactgtgccgggcctcaatttaattatttttaagtttaatggatttccggggagttacgccgagtcggaaaaaaaagaccactnnnnnnnntgacacacacagtgatttcattaatacaactgtcttgaaatggcaaaattttacaaatagaaaacagtctcctgggttgcagggatataagcaggagtgagagctgagagaggtgggtttggctgtaaaagtgctccttggggaggccgggcgcagtggctctttcatgtttgtgaacccaggtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtatctggtgatgcagagactctttccccgcatccctcacatgaaagaccccatcggtgacagcttccaaaacgacaagctggtggtctgggaggcgggcaaagccggcctggaggagtgtctggtgactgaagtacaggtcgtgcagaaaacttgagactggggttcagggcttgtgggggtctgcctcaatctccctggccgggccaggcgcctgcacagactggctgctggacctgcgcacgcagcccaggaatggacattcctaacgggtggtgggcatgggagatgcctgtgtaatttcgtccgaagctgccaggaagaagaacagaactttgtgtgtttatttcatgataaagtgattttttttttttttaacccanaaaaaaaaaa

SEQ ID NO: 719234 - DNA, 1660 bp, Homo sapiens
  misc_feature (8)..(8): n is a, c, g, or t
  misc_feature (249)..(249): n is a, c, g, or t
  misc_feature (1473)..(1473): n is a, c, g, or t
  misc_feature (1494)..(1494): n is a, c, g, or t
  misc_feature (1516)..(1519): n is a, c, g, or t
  misc_feature (1522)..(1523): n is a, c, g, or t
  misc_feature (1526)..(1526): n is a, c, g, or t
  misc_feature (1528)..(1528): n is a, c, g, or t
  misc_feature (1530)..(1530): n is a, c, g, or t
caggaagnttgccaaccctgcctgtatagccagcaagaatttctaattatagcaaacagaaacacttgcagaaaaaaaaaaaaatgagaacgggaacatgataattttcaaagaaagagtcttctttcaaggaaagtcaggttcatggttacgaagctgctgaccccaggatcccagcccgtgggagagaagggggtctctgacagcccccacccctccccactgccagatccttattgggtctgagtntcaggggtggggccccagctggaggttataaaacagctcaatcggggagtacaaccttcggtttctcttcggggaaagctgctttcagcgcacacgggaagatatcagaaacatcctaggatcaggacaccccagatcttctcaactggaaccacgaaggctgtttcttccacacagcactttgatctccatttaagcaggcacctctgtcctgcgttccggagctgcgttcccgatggtcctcctttggctcacgctgctcctgatcgccctgccctgtctcctgcaaacgaaggaagatccaaacccaccaatcacgaacctaaggatgaaagcaaaggctcagcagttgacctgggaccttaacagaaatgtgaccgatatcgagtgtgttaaagacgccgactattctatgccggcagtgaacaatagctattgccagtttggagcaatttccttatgtgaagtgaccaactacaccgtccgagtggccaacccaccattctccacgtggatcctcttccctgagaacagtgggaagccttgggcaggtgcggagaatctgacctgctggattcatgacgtggatttcttgagctgcagctgggcggtaggcccgggggcccccgcggacgtccagtacgacctgtacttgaacgttgccaacaggcgtcaacagtacgagtgtcttcactacaaaacggatgctcagggaacacgtatcgggtgtcgtttcgatgacatctctcgactctccagcggttctcaaagttcccacatcctggtgcggggcaggagcgcagccttcggtatcccctgcacagataagtttgtcgtcttttcacagattgagatattaactccacccaacatgactgcaaagtgtaataagacacattcctttatgcactggaaaatgagaagtcatttcaatcgcaaatttcgctatgagcttcagatacaaaagagaatgcagcctgtaatcacagaacaggtcagagacagaacctccttccagctactcaatcctggaacgtacacagtacaaataagagcccgggaaagagtgtatgaattcttgagcgcctggagcaccccccagcgcttcgagtgcgaccaggaggagggcgcaaacacacgtgcctggcggacgtcgctgctgatcgcgctggggacgctgctggccctggtctgtgtcttcgtgatctgcagaaggtgagcccncgagggcgtccgcgagcgtcncttgtttccagtgtgaccctgnnnnttnntcncngnaccatcctgagaattatcattattatttttgtgatggagtctcgctctgtctcccaggctggaggcagtggcacgatctgggctcacagcagctctgccatcccgggttcaggcatactggtacaagctc

SEQ ID NO: 719235 - DNA, 838 bp, Homo sapiens
  misc_feature (71)..(72): n is a, c, g, or t
  misc_feature (94)..(94): n is a, c, g, or t
  misc_feature (97)..(97): n is a, c, g, or t
  misc_feature (132)..(133): n is a, c, g, or t
  misc_feature (540)..(540): n is a, c, g, or t
ccgtgctccatctccctgatggtgtgggagatgcgtgtgagcgagacaccctcagctccaagggtggcacnntgctccgtggaccaggctgtgnaancaatgcctgtcaaatccacacatgtatattctctnnatgccaggcccatctgggggagggcagcccagagacacgtgtgcacctgtgtgggctgacctatgcgcagtgtcaccaatgtctgtgacattgctgtaatggcaacaaagctggaggcaacccagatgcccgtggaaggaagaacagccacaggaagacccagttctggcagctcagcatgcagcccagaaacagaagaacaaagctgcagatacacagctgggaaaggccaccgagatgctttgataagtgagaagaggaaagcccaggagccggcatagacttttcattccttttgtattaaaaatgcagtgttggggaggtaacgctgtatatttctgtttgcaagcaatctttggagggtgttgcataacagaagatgtatcaggtctttgtcctggatcctnggaggaagcttctaaaccctgggggtttctcagaagtgtggagcgtctgcattagtcctggcgggcccctgggaccacacctgagtttatgctaatgaggtgactcagggtgggttcctactgaatttcaggatggggactgtctgctgaaagacccgttattagagggttggggctttgagccacgggatgtcagcccaacctcccagcagtcagagaagtgggcttcaatcacctaaccaatcactccaccgatcacgttacacagtgaaaccccaataaaactctggacaccaaa

SEQ ID NO: 719236 - DNA, 314 bp, Homo sapiens
gcagaggctcccctggacacagcacgttcatgttcctgtctgcacatccctgccactggggaggaggggcagctcctacagaggcagccctggccctgggccctttcaccctctgagcgcctgccctctgtccgacatcgtcccacctctgtgtctgcacttgggcacgtccctggggtatcctccccttcctctgcctgtctaaaatccagcccaacctcccagcagtcagagaagtgggcttcaatcacctaaccaatcactccaccgatcacgttacacagtgaaaccccaataaaactctggacaccaaa

SEQ ID NO: 719237 - DNA, 211 bp, Homo sapiens
cggagtctaccgactagccgacagcccccccgagtatgcgtccaggctggacagggcttcaccgctgagcttctcgatggctcggtgctccccgctggctgcagtgctggggggaggcagaagccactggatgctgtggcccgtgcgcacccgcgagctcagcactgtagttggggtccaggtcgtcgccgccctgtcgggctagtcgggg

SEQ ID NO: 719238 - DNA, 164 bp, Homo sapiens
  misc_feature (16)..(16): n is a, c, g, or t
  misc_feature (116)..(116): n is a, c, g, or t
catcatggggtcctgngatacacgatattaattaaggagtgacttctgttagcaagcacgtagacattcatacatactccggtggtaagactggtttctgagatgctgattgcgcngtccaaagcgcaaatgcttggatcttgcgagtcaggagtaatggtccc

SEQ ID NO: 719239 - DNA, 1204 bp, Homo sapiens
  misc_feature (906)..(906): n is a, c, g, or t
ctcaaactgggcctggagggccttcagctcctcagtcgtggcactgatggtggcctgcggggagaagggagcccacggtggcaccagggagctgggcccagcagtggagggtgaggctgctgggatgaggagacgtccacggcccctgacagctgtgatgtcgccctctcccgctgcgcagtgccctggggatggggcacaagccctccatcccggctccgagtcaccgagcgtcccccaaggccccgctgcctggacgccccggccccccagcaggcggcctgcgtgtgcctctgtgcagtcagtgagaagggctcccgttcagaatgggcagagaagggggctgcctcccgcgcctggcaccatggcctgtgttctgttcactgcacactgaaccatacattccgccagtcaggactcaatgtgggtgtcctttcctgccgagagtttcctctggtgcagggccagccgcctcgggttgtttctcctttggaaggatctctctggcccatctgggggagggcagcccagagacacgtgtgcacctgtgtgggctgacctatgcgcagtgtcaccaatgtctgtgacattgctgtaatggcaacaaagctggaggcaacccagatgcccgtggaaggaagaacagccacaggaagacccagttctggcagctcagcatgcagcccagaaacagaagaacaaagctgcagatacacagctgggaaaggccaccgagatgctttgataagtgagaagaggaaagcccaggagccggcatagacttttcattccttttgtattaaaaatgcagtgttggggaggtaacgctgtatatttctgtttgcaagcaatctttggagggtgttgcataacagaagatgtatcaggtctttgtcctggatcctnggaggaagcttctaaaccctgggggtttctcagaagtgtggagcgtctgcattagtcctggcgggcccctgggaccacacctgagtttatgctaatgaggtgactcagggtgggttcctactgaatttcaggatggggactgtctgctgaaagacccgttattagagggttggggctttgagccacgggatgtcagcccaacctcccagcagtcagagaagtgggcttcaatcacctaaccaatcactccaccgatcacgttacacagtgaaaccccaataaaactctggacaccaaa

SEQ ID NO: 719240 - DNA, 1150 bp, Homo sapiens
  misc_feature (852)..(852): n is a, c, g, or t
ctcaaactgggcctggagggccttcagctcctcagtcgtggcactgatggtggcctgcggggagaagggagcccacggtggcaccagggagctgggcccagcagtggagggtgaggctgctgggatgaggagacgtccacggcccctgacagctgtgatgtcgccctctcccgctgcgcagtgccctggggatggggcacaagccctccatcccggctccgagtcaccgagcgtcccccaaggccccgctgcctggacgccccggccccccagcaggcggcctgcgtgtgcctctgtgcagtcagtgagaagggctcccgttcagaatgggcagagaagggggctgcctcccgcgcctggcaccatggcctgtgttctgttcactgcacactgaaccatacattccgccagtcaggactcaatgtgggtgtcctttcctgccgagagtttcctctggtgcagggccagccgcctcgggttgtttctcctttggaaggatctctctggcccatctgggggagggcagcccagagacacgtgtgcacctgtgtgggctgacctatgcgcagtgtcaccaatgtctgtgacattgctgtaatggcaacaaagctggaggcaacccagatgcccgtggaaggaagaacagccacaggaagacccagttctggcagctcagcatgcagcccagaaacagaagaacaaagctgcagatacacagctgggaaaggccaccgagatgctttgataagtgagaagaggaaagcccaggagccggcatagacttttcattccttttgtattaggagggtgttgcataacagaagatgtatcaggtctttgtcctggatcctnggaggaagcttctaaaccctgggggtttctcagaagtgtggagcgtctgcattagtcctggcgggcccctgggaccacacctgagtttatgctaatgaggtgactcagggtgggttcctactgaatttcaggatggggactgtctgctgaaagacccgttattagagggttggggctttgagccacgggatgtcagcccaacctcccagcagtcagagaagtgggcttcaatcacctaaccaatcactccaccgatcacgttacacagtgaaaccccaataaaactctggacaccaaa

SEQ ID NO: 719241 - DNA, 269 bp, Homo sapiens
tctactcggctagagtcaataagagccagagtatatgcatacagctacttgaactaatacatccaaatgtactgaggttaccacacacttaactacggatgtgatcaacactaacaaggaaacaaatacaaggacaacctgtctttgagcctgggcaggcctcagacaccctgcctgtgggccccgcctccacttcatcctgcccggaatgccagtgcttcccgagctcagacagaggaagccctgcagcaagttccattcaggctgtt

SEQ ID NO: 719242 - DNA, 129 bp, Homo sapiens
cccgggggggggccggggttaaattttgggcccccccccaagggggaaaaatggaaaaatttttttttaaggggaaagggtaaggggggggttttaaaaacttaaaaaaaaaatttttttcccggggga

SEQ ID NO: 719243 - DNA, 342 bp, Homo sapiens
ttcgacggtgtctgataattctgtggctaacaatggaaattgttttgctttcagtgaagcaatgacatatttattctcacacctgtaatcccacccccttgggaggccgaagtgggcggatcacttgaggtcaagagttcaagatcagcctggccaacatggcgaaatcccgtctctactaaaaatacaaaaattagctgggtatggtgccaggtgcctgtaatcctagctactaggtaggctgaagcagaagaattgcttgaacccaggaggcagaggttgcagtgaactgagattgtgccactgtactccaggctgggtgacacagcgagactctgtctc

SEQ ID NO: 719244 - DNA, 175 bp, Homo sapiens
agctgtcactaattgcatggcaataagctactttacctaatgacactttttcattcattgatgtattttcaaagttcgtcatactgtacacattgcttaaaacacatgataccagcatgcaactgaaaatgaatgccgaatttggtacacatgtgttatctacgctcaaggtaac

SEQ ID NO: 719245 - DNA, 389 bp, Homo sapiens
gaatcacaaagccaggttaatgtgttctgggttaaccctgtgaagccagcacttggaaaggggcacggggccagatgaagttagtgcctgtatcttcctggtcattgctgggttctcagcacccttggcccccactagagttctaggtagagcccagtgctggggcacagggtcctcttcctgacagtacagcctgtggaatcacttgcaaggtcccatatgaaggtagggggtggaatgttggcctgcactggggccagcgtcctcagaaaggtgtcttgaagaaggtggcgacagctgcccctttcttcttgtctggggccttcaacagtgacagcttcttggacagtctgctgctggctttcatcaccgcgtcatgctcgatcttc

SEQ ID NO: 719246 - DNA, 366 bp, Homo sapiens
aatctctctgatttcaaccagtttcttgctaaacaggcaagccatgtacatgcataggcaaggaatgccagtgtcatgagatggcatgaatagggaaggtatattccttttcaggcctgcggagtgtccctcccgttggctccagaacgaagatccacacttgaggactactctcagtcgctgcacgccagaactctgtctggctctccccgatcctgttctgagcaagctcgagtcttcgtggatgatgtgaccattgaggacctgtcaggctacatggagtattacttgtatattcccaagaaaatgtcccacatggcaaaaatgatgtacacctgatagcaagaagctaattcatatgcttta

SEQ ID NO: 719247 - DNA, 253 bp, Homo sapiens
atttttaacccccgggggaccccccatgccccggggtggcctaatttggggccttcccgggattcccaaaaaaacccttttcccccaaacccaaaggttttttttttttattaatccccttaaccccccgggtttcctttccgggaacccgttttttaaaacccaatgggaaagcccccctaagcccccaaaaaaaaaaatgtttttttttccttttccccaaaaacgggggggggggggggggtttttccta

SEQ ID NO: 719248 - DNA, 369 bp, Homo sapiens
  misc_feature (57)..(58): n is a, c, g, or t
  misc_feature (70)..(70): n is a, c, g, or t
  misc_feature (75)..(75): n is a, c, g, or t
  misc_feature (87)..(87): n is a, c, g, or t
  misc_feature (92)..(92): n is a, c, g, or t
  misc_feature (191)..(191): n is a, c, g, or t
  misc_feature (198)..(198): n is a, c, g, or t
  misc_feature (253)..(253): n is a, c, g, or t
tctacatcacgggcagctggtgaccagcttatgcctatggctgctcttagaccatgnncgggaaaccgcnacgcntggctccagganctgcngaactggtgtatgcgattgccaggggatgagctacctggaggatgtgcggctcgtacacagggacttggccgctcggaacgtgctgcgtcagagtcccnaccatgntcaaattacagacttcgggctggctcggctgctggacattgacgagacagagtancatgcagataggggcaaggtgcccatcaagtggatagcgctggagtccatactccgccggcggttcacccaccagagtgatgtgtggagttatggtgtgactgtgtgggagctgat

SEQ ID NO: 719249 - DNA, 188 bp, Homo sapiens
ctatatatctgtatgtctgtactcttcagaaccgagaagaagccgcttatcagttagaagcaggagaatctagtgctcctctcaggctgaactcatctgcaacacagtaggatggaagcggactctgtgagactctccagagtgcagttgaccttcccgcagcctgcgtcccaaagcaaaggggttag

SEQ ID NO: 719250 - DNA, 807 bp, Homo sapiens
  misc_feature (1)..(1): n is a, c, g, or t
  misc_feature (133)..(133): n is a, c, g, or t
  misc_feature (147)..(147): n is a, c, g, or t
  misc_feature (276)..(276): n is a, c, g, or t
  misc_feature (282)..(282): n is a, c, g, or t
  misc_feature (297)..(297): n is a, c, g, or t
  misc_feature (302)..(302): n is a, c, g, or t
  misc_feature (334)..(334): n is a, c, g, or t
  misc_feature (349)..(350): n is a, c, g, or t
  misc_feature (446)..(446): n is a, c, g, or t
  misc_feature (477)..(478): n is a, c, g, or t
  misc_feature (510)..(511): n is a, c, g, or t
  misc_feature (594)..(594): n is a, c, g, or t
  misc_feature (648)..(648): n is a, c, g, or t
  misc_feature (664)..(664): n is a, c, g, or t
  misc_feature (782)..(782): n is a, c, g, or t
ncaactttttaatggtaaacaaagattttagtacaaaacatcaaaatacgttatcagtagttctaaacagccatagtagtgacagtcccagaagtgaggtcactcacatttttaaggaaatataattcactcnatttcagctcgcgnatccatgttctggacagttggaagagacaacatggtggagcgcgttactcttgtgcaataatcgttattcactttattcgaaagtcagctttcttttctggttccttgcttggcatttctaaagaaccngttcanttctccttttttgtnaaaancgctctaagaactaaaagggccgttccttacnggaataaaattaacnncacatgccatacatttctgggtcaatgttggctggttaaattccctcagaattagcaattcatagaaaattaattgtgaagttatcgcactttcangccaaaagtacaatttagagttcacaatacnnggccctgtggtataaagtgcctatgagcagcnncccatcatacactgagcgctacagaacttccttggcagaacagacccattgttggcataaactgtagtcactgtaggcttctnagatagaatgttctggatgcggagaacctctgacgagggaggattgttcgggtnatacacgaagagcttntggccattaggatgacagcctacccagatgtcccccgaggaaggatcaatagataaattatccaccagtgtatccagctcaagtaccttcaactgagtgaaattcatattagtgtgtntttccaaaacatgaatttcatgagc

SEQ ID NO: 719251 - DNA, 404 bp, Homo sapiens
  misc_feature (12)..(12): n is a, c, g, or t
  misc_feature (348)..(348): n is a, c, g, or t
  misc_feature (372)..(372): n is a, c, g, or t
  misc_feature (384)..(384): n is a, c, g, or t
aacctgtatttncagagtttatcaaatctaggatgtcttgggaagtatgatgcttactcagacatcctagatttgataaactctgaaaagcagcatttcctttgtggagaagtgggattatagttggatttttaaaggactgtggaacatatttaaccaccaaataccacttggcataatatgctgccaccctaaagagaccacatcaacaaaacccgtgttcgtttcagaagtatgctttagatatatttacattcacttatctaaatctaaattctgtagttttaaaatatcacataattttgagttaccagggaagttagtagttgtacagtaactggtcctatnaaagataataaatttttatccttnaatttgattttntgtgattaaaataggtatca

SEQ ID NO: 719252 - DNA, 667 bp, Homo sapiens
  misc_feature (570)..(570): n is a, c, g, or t
tcacgccaacttctaatttcccttaaattggtaaatttaaccacagaacggtctcgatttttataaaaatggatcccaagatccacctttcggccggggcctgccacagtccaggttgagcttttcctcctggggagccacacacgtgtgttgtttcccgtccagcccaagggggagaggctgtggggcggcggggcgggaaggcgccctgttgcctggttggcacgggacacgggtgctcactctgcaggagtggccacgaagacaaagggcacagacgaaagacaacagcaagacacacgagccgggtcttccatcctcaggactaaaacggcgctgagagcaattcacataatctcgtgagaacgggcttccttactggtgcgcagcgtgagccggtacatctggggtctgtgcaggttcggctccaagcgcagaggccatccacatcgggggggtttccgtgtggatgattccacgctcccacgaaattcgcaggattaggatcaccttcttcaagaagtgcagaccaaatccaatgatctgggctgggggacttctgtgtccatngggtgcttgcttggacgatgttctgcccttcctgctgtggatggctcactgctttccaaccgtggagaggacattctgagaagccattcgtcggtgg

SEQ ID NO: 719253 - DNA, 470 bp, Homo sapiens
  misc_feature (359)..(359): n is a, c, g, or t
tctcagagagttgttctcagcccagaggagggagttcaggcagagggaacagcgtgtgcaaaagcccagaggctgggaaagaagcagaaagaggactgtggggctggagcgtggtgggcaacaggagagaggtgtggtgggcagacagattgtctgagacccagccgtgcaggggcagaggagatagaggatccttgcaggcccccagctggggctgaggcacagagacaatgcaggtgggcaaagggaggagacatggagaaatattttggaggcatgtcctgatgaatgagcccaggatgcacccttagtgtcagtgtggagctcctttcttggctgtgtgataagctgaacccggnggtattttctggacatcgaagtgctacacccagagtccaggacagactaagtgagcaccagcagctcctggcccacctcaaaagcaggaaagacaggggagactgtggagg

SEQ ID NO: 719254 - DNA, 400 bp, Homo sapiens
caggtagtggaatacattcagcaataaatgttctggctgctttgcctcctcaggaactcaatacccaggaatgatgtgctgcagaggacacaggttccattcatgtatttaaaactctcaataacttttctaaacttactatttagctaaaagattccaggtttgtgaagtcctaagccttcctctcctctctattttgaggctgcaggaccatggaaaacactgatagaatttctgggcccttctccaccctgactgcacttgtggagatctgagaaatactgttgcccagaccacaccccaaatccataatatcagaatttctggaggtgggacccaggcacgagattttcattaaaaaaaagagaaaaagtttccgcaaatgtctttttgtcttatg

SEQ ID NO: 719255 - DNA, 1143 bp, Homo sapiens
ccagagcagcaccgaaagcgcaaaatcgacgcaggtaccatggcagagccctcggcttcgcccagcaagcgccgtgacagcggggacaacagcgccccgagcggccaggagcgtgaggaccacggtctggagacaggcgatccgccgctgccgccgccgcccgtactgcctggggcctgggggaggagctcccgggcgcccggctcccggtggggctgggtggcgacgacggggcggggcgcgcaggacccccgcgggtgagactgggggggtcgcatcgcgccagcacaattgaacgaattttggcagtataatacctttccagctactggaggaatccttttgcctcctattgatctgcgcagagcattgacacgatttacagtgaaagacaaccccttgacaagaaggcaaacaactttcaggggcaggaattgaagggggcttgaggttgacatggagtcctgatgtagggagccgaagcaggtggggattggctgatttgaggagaatgtctctaagtgaatctcgtattcttaaggggaaaagttattttccatactttgaagttatattccaaaacctgaggaaatgaaagaaaagattgttctgacattaaaatacctacagttactactgaagcctcttaactaagggattgtcaagggataagagtacagttgtaggggaagtattatggtatgcatttcttagagcaaaaagtttggttaaaattctagaaattgaagggttactgatcttataagagaagaaaattctaggaagtttagaaataggtggggaacaaatcaaagtatccttcctatttgaacgaaaaaggttaatttgtggtattatagcattggatatagggtatagtacgttgttcactaaagtttgatttgctaattaccagaaacagaacaacaaggggggcgacggtgcttaggagatttttcgtccggagggggacgcagacttaagggcggtacccaggcgtttttggtcaaaaggtgtgtcacttatagtgggggcgatatatagagaatgcagattgcgcgtcgttgttgaacattggtacttggcaaacggcataccggggcatagatggagagggaacgactacttgtggcgggtgaacaa

SEQ ID NO: 719256 - DNA, 275 bp, Homo sapiens
tgtgagctgcattacatgctcatatatgcctacgtttctatacagcagaggaaaccattgtccacaagactgatgttcttttggggttttatgtacagacttgtccaatcatgtgtgtgtgtatcctgcgagttgcatgatgactccgcatatgaagctctctgagttctttgattttaagtatgggtttatggactctattcaaatgtaggaaggcgtgtggttctatcctgccctccctccccttttggaaatatgaaagcacatgtatagaa

SEQ ID NO: 719257 - DNA, 275 bp, Homo sapiens
caatcccagaacacttggagggaatcggacaggtgatcccatcagttcctgctcctctgtcagggaagacaggcagagcccacagagcatggtccatccagagtgttccttgagcccccaccaccttactggaacccctattcagtctaggaagtctgaaatgggtgctaattcccttgctcatgaaaccagggccctcttccttcatctaatgcaaacattcttaggtgaagaagtgggaataattggaaataaacatcagttctaatcgttca

SEQ ID NO: 719258 - DNA, 434 bp, Homo sapiens
tctcgtccagcatccccccttctgcacgccgcttgtgcttactcgttagtggcgctgcgcattacctgcgccttgagctgtatcgctcggtctatacctggcgtcaaaccgatttcggctggaacgccaatctgatcacggcaatatactcatgacgtatgccatcgaccagaccaaccccgaagggactccaggcgccattgttgtcagttgggagggcgttgaggttgcgactttcactcatcgcgacagcgctgagtatttcgtggatcgtgacttagcgaatcgtcgcgaatcggatcagcccgacgcttaggaataacccatgcgttacatgctcagcgttgctcgccactacctgacaggaaaaatcacgactgagcacgcggtttatgcgcttcgcgatcgacctgttgccgtggccagtaaaggtc

SEQ ID NO: 719259 - DNA, 142 bp, Homo sapiens
tcgtgtagaccgattcatacaggtccctcgttaagggacaagtgattatgctaactttgcacggttagtggtaccgcggccgttaaacatgtgttactggacaggcggtgcctctaattctggtgggacacgaatgttcagt

SEQ ID NO: 719260 - DNA, 113 bp, Homo sapiens
caccgcggcaagctggagaccgcccgcgcccgcgctgaaaaggtgaccggcgagttgtccgatctcaccgtgcagatcgatgaactgcaggagcaaacgcgtgacgcccgcgc

SEQ ID NO: 719261 - DNA, 148 bp, Homo sapiens
attctagaggatccctgctgatgcttctcacctgtggtctgcgcgtcagcacaagccacgcttcaccaccaatgaggcccaacaccttcttctaggtgcagtgccctcgtccgtggtgtgccccaaataaactcaggaacgccccggt

SEQ ID NO: 719262 - DNA, 438 bp, Homo sapiens
tggtttgtagaggcagaggagatggtactaagttagggcggtggatgggctgatttacagtttgtggaatatgtatctgttctgcccaggttttcaggttgaattgtacacgatagtgtgtattaactctttcatctagtgttacttgcatctctttacttttcttgattaatcttgccagaagttggtctatcttataaaatcttttgaaataactagcctttgattttgttcatctatattttgttgatttattctctaatttctgcccatatgtttattgcttccctgggttattttgtcaatcttcctaagtttctttttgagtactattttagctgtatctcacaagttttggcatgtagtgttttcagtgttatacatttataaaatatttggtaatttccttggtgattggtttaacctgaagaattacag

SEQ ID NO: 719263 - DNA, 642 bp, Homo sapiens
  misc_feature (84)..(84): n is a, c, g, or t
gcggggccgcccagtgggtcaggcacaggagcccccggtcctatcttagagcccctgagcttcagggaaggggcgggcgtgtcnccgcctctggcatccctccggttgccttacacacgccttcacctgcagtcgcctagaaaacttgctctcaaacttcagggttttttcttccttcaaattttggaccaaagtctcatttttgtgttttgcctgcctctgatgctgggacccggaaggcgggcgctcctcctgttttttttgtgctctttttaccgcccccgcgtcctgtcccgggggctttcctaggatcccctttccgtaaaagggtgtaacaagggtgtaaatatttataattttttatacctgttgttagaccccaggggcggcggcgcggttttttatggtgacccaaatgtatattttgctaacagcaattccaggctcagtattgtgaccccggagccccaggggaccccccgcccattccgttgccttacccgatggcttgttacccggaaaaaaccgattaaaaccgttttagaaactcctcccttgtttagccctgtgtttcctgtggaccctgtaaaggcaggttggccagtttggacctgggcttcgaataaattttttgtatcccca

SEQ ID NO: 719264 - DNA, 174 bp, Homo sapiens
ctcgtggcgcgggccagaacattggtctctgtttttcccccccgggccccgtcccccggacccgggggacacccctcccccgttctctttcccccccccctcttttatggtgttttacaattccctttttgaaataaaaaagggacccccgcctcccctccctttttttcccca

SEQ ID NO: 719265 - DNA, 225 bp, Homo sapiens
ctatctcatcgacggtttctctatctgatacctcttctcattatgctatagtgtattttttttttttaaaccccagaaatctcttaaagtcttaaccaaaagtgtaagacggtcctgtgcatacatgggtactggggtccctgaacccaaccaaccacagatcaaccatattggaggcaaaacaaaatccacaaagtcctgaagagtcacaactggaattggccc

SEQ ID NO: 719266 - DNA, 125 bp, Homo sapiens
tgctgtaggccagcgatccccaggtctcgcgaattccctgcgctttgagaatggtgctctttataacgttccccatccagacacacacacagacacgctacacacacataccccaaacatacaca

SEQ ID NO: 719267 - DNA, 895 bp, Homo sapiens
  misc_feature (1)..(1): n is a, c, g, or t
nattctagctcgcacgggtaattatgagggcgcggtgtccgttggcggcctctgttttcaaaacctgttgtgcccctgatgtatccccttgggtcacttctgcagatcactgtggtcctgagccctctccgtctttgctatttcgcccctgggggccacaacgggttttccaagagcacagtggtctgtatgacgcggcccccattaggtcgccaacttatctctacggggcgattgtaaccccccggcctgtgatttgtttcaatagcatttgaaaacttttctttcgtaaacaccttaaccacgcaatttcctccggggaccaaacccccctgtgaataatgtccggccaagaaactttccagatatccccaaaatatttattcacagttaacatctccccttatttcaattcttttcccagcgcccccccagtcatacaattaccccctcgccgtgaggattaagtagtcctgctcgtccctatctccccccccccaaaatcgggaaattaatctcctcgtgatgacatataatacgccccccttgtgaacaaaacaattgtcttgaacgacccccacgcgacttgtaatagtaaacaagggacaccccacgcaataagggtttttaggcagaacaaaccccgtcacgcgagtgacccccggtcacaagtagctttggcaaaggccccaaggctttcccccacgccacagtaggaaagaaaaacaatgtcgccccgccaaaaactcggtggggtacacagactatagtggtagggacttctaaattccgtaaggcccacatactactacctcgcatccacaacccccggatcaaatataaggggcttgacaaacccccccccgaagcaccggcccccgggaagcccacatca

SEQ ID NO: 719268 - DNA, 364 bp, Homo sapiens
aaaacaccaccaggccgtaccacagcctgcccagtgaggcggtctttgccaacagcaccgggatgctggtgtcggcctttggcgtgctggtgctctacatccttctggcttcatcttggaagcgcccagagccggggatcctgaccgacagacagctgctgctacactgaggcctggatccggctttccctgtgacttagtgtctgtcacggagcagcctacaaatcctggtgctgtctccaagaacagagcctgtccaatgtcccatagcgatgagtaacagaggtggctgtggacttcctctacttctccttgctggatcagggccttctgctcccgctggcaggtctggcttgctctcttg

SEQ ID NO: 719269 - DNA, 724 bp, Homo sapiens
agtgggtgcaacagagggcaaggctgaaggggggcatccgctttgggggcagagatttgtctccttggcccacccaagcactggtgcgttggcccaagccccacagaaccgaaccaggtctcttctgtcctctcattttcatataaatcattcaacaagacaaggggtctccactcctaggcaggcgccaagacttgggagttggcaatctgttgttgcatttggggctccaagctgatatcttcccaacatccaggcgttcccaacagcccttgggcattacctggcagttgagcccagtgttgtcccaggcgtctttcgttacaggtttacaacccagttgttgggccattccaattgcaaggtggaacattgggccttggtgatgctgtgtgagtcctttggtgaccatgtctcaggcgcatttttcagcagtcaagggttctgggtacacaaccattgggtttaacatttgggggccctaacccccaagaaccgtccaaattcctctcagggccattccaaggcaacaagcgcggaatgccttgggggtgtcgcgaattctgtaattatgtgcttccacacgtgtaaaccccgtctggcacgggtttgtaccacgggccgtggttgttgttggatccatgcttggttatcacatggactatttgggcaggctgatgcaggtgggctaatgaaggcaggagttagactcccctggctgtgt

SEQ ID NO: 719270 - DNA, 418 bp, Homo sapiens
cattgacgggatggcggcgctccggtttcatatccgcaagcagattgttgcgaagaagacgagccctgtccatcaaaagcttggaggatgacattcacttgcaggggcagattagttcattctatgattgcgacgatcaggccaagatttctggacattggaatctgttcgaagaccgaaccgctttcctgaacacgggaggctaaaatttgaatctcgtggaatgcgttctcgagaatgatcatgttcgccttgagccgctatcagaagggcaccgtgaaccgctgcgcgaggcggcaaacgctgatcgcgatatttggacctcaatttaccctttctcgcttgagggagatcaattcgaccccacgtggacccgcatttaacgggatcgcgaaacgcgaacgtggatttccttttc

SEQ ID NO: 719271 - DNA, 144 bp, Homo sapiens
aactgttgtcctaggcacagtctaagcctccttattcgagccgagctggcccagccaacgcatcttcagtgataacgaccacagtctacgacgttactcgtcacagctcactgcctttgtaactactcttcttcatacgtacta

SEQ ID NO: 719272 - DNA, 292 bp, Homo sapiens
aacacaactgacagactgacttcgatgctgtgaacgcattagtatcctgccaccatctgacacaacataccatttgaccttaaccgttacaatactgcacacattggtagcgtgatccgcatgatgatggatgagttagaggcgaacatacatgtcccgccacctgagctgcagtctgacatcatcgacatcacgggcctctctgcaaatttgtaccgggccatggctgtactgctgaagcgtgtgaaggagctacaggccgagcaggaggaccgtgcttgaaggagtttta

SEQ ID NO: 719273 - DNA, 172 bp, Homo sapiens
cctgaggttatgtgtgacgcttgcaacatgtaacagttcctccttcacttctactttctgggcacgtgtcctgggccgtctctttgagcttgttgcggtgtcttctagttctgtgtgatgatttgcacgggtattttagtaggtttttgtcatcatgtcatttgattcttca

SEQ ID NO: 719274 - DNA, 104 bp, Homo sapiens
atataaaatcgctgttcgatttggtagctcagggaagggtctgaggcctggcatagtagtaggagttggtgtaaatgagtgaggcaggagtccgaggaggttag

SEQ ID NO: 719275 - DNA, 179 bp, Homo sapiens
ggatcaagtcccatagcctttattcagggggcctatcaacccttccagttcttgccccagggttggcctgctagcgcttcaaattcccaggtgtccctaatttcagaagtaaccttttgaatagcattagaccctggctgtcccctccccaccaatataaacatgatatttcattctca

SEQ ID NO: 719276 - DNA, 2039 bp, Homo sapiens
  misc_feature (206)..(206): n is a, c, g, or t
ggttcacgacccggcgcgtgtccgagtgtagcgtccatgctccgaaatacctagaatatagtgaggacacgtatcttacggtggtcccagagactcgaacatctcacgtgacaatccaagacatcttctctaaggtggactggaagcactgagcgacaatgcttatcagattgatctttccatcaagtctcttccctggggtgatntcgagtcgaatatatggcacgtggctattaggcaagagctgagtatgcctggagcattacattgcttcttgaccacgactcacaaagatcgacctcatatacacgatcccgcgactatgtgatcattcctacatactcaatagagtccacaagtccatgaggagtgtgccttggtgattgtgcccagtgatgcagctttggccgctgtgatcgacttgcttgtgtaattccagcgatgaccagttcgcgaacacaaccacaactgtggtcaccatcacatggacaaatgtacgcaatgcgacgccagggtccgcacaccgtttactgcgaagacacggattggacaacaagcaggaggtaactcgaaaaaccacgtgggcagttacgagttccagcgatgaaagctcgctttggtctcgcggttctcattaccaatggggccccacaatatgagtatttctataaccaagctttgttgccgacgcacaatggctctctctccttgagaggagcccccaactttgtgctactctatgagcccatatggcgtctctctccatagcctgggagattatcttctcacccaaatttctatccacaggagcgatcaaaggggcacctctgggagattgtcgcagcgataagctcagagctttccggtaggacaggcggactaaatcctaatcgttcaccatacccccaagggtgggcgacaccaaccttctccgacacctctgtgactacccattctcgaaccagcggcacagcgcagcaacaggcggacacagccgcgaactttaggcacccctatcgattactcttccatttcagacgcgcacatacagcagacggcaacttaacaacatcttggaagccgaagacaacgagacacgcgcagccgcacaccgagactaccctctctggcctggccactggaaggtacccacgagcacaccacgccgcatcccgcgtcggcgtatcaaccacattaccacaacccaaccatcaggacagcacgacggcaaggagaacacaaacacagtgcgaacgacagcatcatccgctagaccacagcgccgaccaacaggcctacaccaccgacacggcgacgcacaacaagcgcgtacgagcacgcccaacatatcgacgctgaccacaacaagcgaagcgcgacccctacaaccatgccacagcactccggctacacgagcccaaccacaaatacgtgcaccccggggcaacccaccgcaacacccgtggcgacgacacacacacacactcccgccgcggaacactatcccccccaaactataagcagcgagtcccaccagacgacaatgcaccccaccgacaacaccacacacgctcccacgcaagcgttagacaacggcgggcgcaaagcaccatgactcacgatcaacatcccacacacatgcaccgccacatgaccccacggcacactaagggcacggcacaccacttacctccacccccacacacctgtcctttatcacctataacccgcggctacctgcaccacccactactcacacgagaacaaaacattacactccctctctcacaaacacaaccacctcctaacctcaaaaacaaccccccaccacacacacaacactccacatcccaccacaccatcactacactgaccaaatcataacacacacacagcccatacgacaccaacacaaccataactaatcccccaagcaacaacaacaatacacacacaacaacgcaccacacacacaccaacacaacctacacacacctccttaccctcaactagctccactacctacataccgcttcata

SEQ ID NO: 719277 - DNA, 221 bp, Homo sapiens
aagctcggtacccctctactagccaatcacttcattactcctagccgcatacctcctcattctaacctgaattctggaggacaacccagttaagctacccttttaccatcattgtacaattatcatccgtactatacttcacaacaatcctcatcctaataccaactatctccctaattgaaaaccacatactctaattggcacatggccctgtactcgag

SEQ ID NO: 719278 - DNA, 120 bp, Homo sapiens
gagccagaggttaggtaacctgtgcgaaaatggacacaactagtatatgactagtcctagcttatagccggtttcatactgacttcaaagcctacattcactactagtatgctatacagg

SEQ ID NO: 719279 - DNA, 346 bp, Homo sapiens
gaggcagatgagggacagtagataatggataccagatacatacaggagggtgaatgaacaacgacttggaagtgtatgtggagaaggcaagaggaatgaatgatgatatctgaagcagcacaactcacaattgcgaagatgtggaaccaacctaactgcccatcaagcaatgagtgaattaagaaaatgtggtatatatacaccagtggaatacttactcagtccacaaaaaggaactgaaatactaccttattgcaggaacttggacggagctggaggccatatatcctaagtaaagtaattcaggaatggataccaaatatcatatgttcccacttatgagtag

SEQ ID NO: 719280 - DNA, 409 bp, Homo sapiens
caagcaaaaattcctcacttccatagggattaaatgtgcaaggaaagttgcagaaaataaaggagttcagtatttatgcctgtaaagatggaaaaaacattgtattttacaaccatagccacattggtgtctttacatacaaaagtagatcttaaaatagtcatatcttagcggaagtcaatatctgatctttctgtggttcttataaattatgtaacatgcctatcatcaattattttccttccattctctcagtttatttccagagtcctaaaaatgccatatattacctccagaaagctgctacagactttgttgtagaaccttccctctattttttgattgttggttggtggatcgctaacagtatagaaacatcgtacgtcagaagtaatattcacgatctagg

SEQ ID NO: 719281 - DNA, 768 bp, Homo sapiens
ctgccgcccgagcctcgcgagcagagggacgtggagcgagcgggtggaaaccaggcggccagccagctggaggaagctggcagggctggagatgctggaccacgccgtcctgcttcaggtgatcaaagaacagcaggtgcagcaaaagcgcttgcttggaccatgcagtgatgaatgcttgctgtgctgtgtgatctgagtgagcatgcacaatggatgatccaccatgcagatgtgcatggagtgacgaaggatggataaacccagtgcatgtgtgtgatgtgttgcatcaagaagcccgtgtggcatgcgtgtgcccagatgtgccagtgatggcccctgaaggcaatggccagtggatgactgtgtgtgatgaatcttgcctcccctgcctttgtgaccctgtcctcagatgctcctgtgtgtgtgcctgccctgctccatcccagtgaccttaaccatgcgctccctggagcactctgagtgggcctgtgtggcatgataccctgctggccctcctgactggcggccctgacacatgagcctcgtggcagcccaggccaagctgagagatggccagaaggatgccgaccccagggcagcttggcacttgtgaagggagctccccaatggcccggagcaggtgcccgtgccagaccccgccaggaagccgggggcccagaggagctgcctcgcagaggaattcctgggcaaagtcaggacgttactggcggttcccagacaggaaaactggaagatgtgcagcaa

SEQ ID NO: 719282 - DNA, 238 bp, Homo sapiens
  misc_feature (18)..(18): n is a, c, g, or t
  misc_feature (25)..(25): n is a, c, g, or t
  misc_feature (35)..(35): n is a, c, g, or t
  misc_feature (44)..(44): n is a, c, g, or t
  misc_feature (148)..(148): n is a, c, g, or t
ccgtacggcgtactctanctcgganacgggggtgncatgagggnagcatgctgagaacaatggcagcattcattccatagatcccttttctgcatgttcaccaccgacccatgatccatcctgtgtaggttatctgaacatgtcagcncgattccacggttgttaaagtaagtttgtagaattttcaagtttgctacaccgacttgtatcataccactcggtgattgttttaaattaa

SEQ ID NO: 719283 - DNA, 197 bp, Homo sapiens
tgtagactaacgtcttttcgtgggtacttgcgcttacttagtagaccttcatcaggattgcatgaagactggcggtatataggctgagcaagaggtggtgagagttgatcggggtgtatctgcttacagatacaggtctccatctagcagagggtatgataccaccggcctagtgtccgtttgtatgtttgaaagac

SEQ ID NO: 719284 - DNA, 416 bp, Homo sapiens
atgctgaggtgatctagagatcccactagtccacggttggctactagtccagttggctactagtccacggttggctgggctggcccaggaaagacccttgcaccattctggggtcttttttttttttgggaaacggagtttcactcttgttgcctaggcgggcgtgcaagggcatgatcttggctcattgcaacctccgcctcccaggttccagcgattctgctgcctcagcctcccgagtaccggggattacgggcaagtgccaccacgccgggctaattttggtatttttagtagagagggggtttcaccatgtgggccaggcgggtcctgaactccgggactcgggtgatccacccgcctgggcctcccaaagtggggggattacggtcgggagccaacgggggactaggggg

SEQ ID NO: 719285 - DNA, 108 bp, Homo sapiens
tgcggaaactgcgaccaagagaccatttagcaggaagctagcaggctcttcttcaagagttggagttgacatttggctcctcttggactgggccgactgtcatctcag

SEQ ID NO: 719286 - DNA, 1195 bp, Homo sapiens
gctccggcgcgggttgcgaggcgtagcgctgcgaacccctgcacccctgcgaacatatgctgctgctgagtggtgcggagcgtgctgggcccttgctcgtgcacctctgctgctgcggtccctgttagcctgcctgccgcccgtgccctgactgatggccactgtgcagcttggtgtggttgtgtgcgcctgtcctgtactgcttgcgcacttggaccctgctctgctctcggtgcgtaaattcacatgagacaacacggacatgggtaacaacagaaaattggcattggaacagtgggaatcagcaaattttgcacaggaagcggttgggagatgttgttatcgtagtctccctgaagtcgggacaaaattgaacaaacaagatgagctatggtgcttagggaaagtgtgaaagcttgctagtgaactctattctccttatatcaggacgacagtacctgaaacttaatgaagctacttgcaggaaaatccaggacttgtaaagcaaatcttggtatgaagatggtaggatgatcaaggatgaactgagtaacccttacagaactagcagtgacccattattgacgtgaagcacaagcctactgcagacaatacgtaaccaacctatttgcgcgacgtgccacccatggcacacctcccttacggtacagctcgtcctgcacctccacccgccagccccggcacagcggacttaaacagctcagctggggtaggactaagcaaagagatacacaatagatacaacatttctagacagttagcggaaatgggggaacaaacaaagcttaagtggtatatacgcgagtctattgtaagaaaacatgtcccttaatgtgttcaaaagtagcacatacaaaacaagttgaacacgtgggctttatttacagaattactgcaaagtggtgtggaggacaaatagcgctcccaagtatgacaaacgtctgttggaagttcgccagtgaggcgacaaccacggttataagcagataaagtgcaacaagcagaaaagtatagtctaaagccacaccgaccaatcatgacaccgctaagttccaccagaggggaaggcagagacattcagagtagcatatacgaagaagacgcaggaagcgcaacgacgagagaggaggaaacacgagagaaagctacgtaggagcgcccagggacgaaccgg

SEQ ID NO: 719287 - DNA, 187 bp, Homo sapiens
ttttaaaaggcaaaatttttaatctaattgttttttaaaaaaagttttggggtaggggggtattttaaaaccccccaatttttggactatttgattattaacaaaaatgttttttaaggcccaaactcaaatgtttaaaaaaaatatttactttggactcaaataaaatccccttttgcaattccta

SEQ ID NO: 719288 - DNA, 233 bp, Homo sapiens
gcaccgagaacgcacacatccatacagtccacaccatcacacacactcatctatacagtccacaccatcacacgcacacatccatacagtccacaccatcacacacacacacatctatacagtccacaccgtcacatatctgtacagtccacaccgtcacacacacgcccacacccgcatgccacacatccatacagtccacattcacgtatgcccatatgcatccattcaca

SEQ ID NO: 719289 - DNA, 223 bp, Homo sapiens
  misc_feature (54)..(54): n is a, c, g, or t
  misc_feature (153)..(153): n is a, c, g, or t
gctatgatggcagtgaggggcgcatatgatctatgctatatattcggagtatancgtagcggtaagttacaacgtacctctagaatatagctagcatgcgcaattaaagcgctgatatcgatcgagcgcagatctgtcatgatgatcattgcnatttggatccatatatacggcgcggggttataattaacctcaggtcgacgttccatgggcattcgaattc

SEQ ID NO: 719290 - DNA, 196 bp, Homo sapiens
taagccctaagatgggttgatggcctcaacaagtcctgtccccgagccacaggacttgcgcctgaccgtcaagatggatctctcatcgcagggaaccgtcagctcctttgtggccaagcttttcatctttgtgtctgcagagttctgagcactcgcttccgcgtcgcgggttctcccttcctgttggtttccctaa

SEQ ID NO: 719291 - DNA, 383 bp, Homo sapiens
tgaccacatgtgcccaacttcaataaaagaaccaaaggaccctcatttttttaggtgcttggcttttattcagggctttgcaaggggttaaaaactgactgtaaaaatgggaaaaggccacggaaaacatttatttttcctttggatttttgggaaaacccaaccctggtaaggaaaaggtaagggggattattcccctccatatttcctaaacaggttgtataaggaacccgtggcaagaggaaggctgttttcccaaatgacttgtaatgttgtgattaaaaaaattcctatatttttttgcaaatccaacgtttttttcccatccaatccagccttggttttttttttaatttaatattaaaattaccccttttttttta

SEQ ID NO: 719292 - DNA, 283 bp, Homo sapiens
  misc_feature (177)..(177): n is a, c, g, or t
  misc_feature (254)..(254): n is a, c, g, or t
tcgatctagaggatccctgtaaaatcctcaacaaaaccaatcagcagcatatcagtgggattatatactatgatcaagtgcgtcttattcctggaatgcagggatggttcaacatatgaaaatggttcaaggtaatatacacattaaacagaatgaactgggagaaaaccacatgantggtgtcaattggatgcagaacaaaacattggacaaatattcacgcattctttcagtgatttacaaaaaacactaanaactagaagtaaaagggagccagggtgca

SEQ ID NO: 719293 - DNA, 314 bp, Homo sapiens
  misc_feature (10)..(10): n is a, c, g, or t
tatgcacaantaaggaagggtccccaggtggggagaaccccaagttgagaacaataatgaacaattatgtatgaactatgttagagacagctaatcacaaacaacctgcgggcacaatgacctcattccacacgtagcacccttcagcaggaccctataaaactttcctccagcccttgcctctttgcaggtagcaccttctctgctgagctgcccactgcaacatattttcacaatttctctaataaatctgcccttctttacctacaactatcttggtaaatggctttaccacctgcaaaactgaccctagg

SEQ ID NO: 719294 - DNA, 135 bp, Homo sapiens
ttctagaggctccctcattagcgagcaggcagaatattatcctggatgatatgcacccagcactagaatacacctttcattagaatgaagacaacacaacatacccccagcaggcgtgaccgctccgcttactga

SEQ ID NO: 719295 - DNA, 277 bp, Homo sapiens
agggcatgggaggagtctaccgagattggtagggatcctagagcctccaacaaacttcttcttggttttgtaccaataagaacgcaattagcttgtaaagggactcaccagacctgctcaatgatgttggctttcatgaagactaacaagtttgtcacaagtgtgaaacattagttgtctacattgatttcagaatagaaggccacctgaggtgtatactacttggggaaccgtgcacgttaacgattactaggactatgcagaaaccagagagttt

SEQ ID NO: 719296 - DNA, 161 bp, Homo sapiens
cctcacagaccctggtttaactggcagaagcaggaagcaggaagcggcagaagcaggaagctgatgtgggaagagcacttgagcccgggatgtcaaggctgcagtgagccaagatggtgctactgcactccagcctgggcaacagagcacaatcttgtctc

SEQ ID NO: 719297 - DNA, 127 bp, Homo sapiens
tgtcagaggtacaggtgtggagtagggtggtgtatttggagaaccgtaaatactgacatgcatcacttaacaacagggttatgttgtgagaaatgcattgttaggcaattttacccctgtggaaaag

SEQ ID NO: 719298 - DNA, 494 bp, Homo sapiens
tctctccctttttttttgagacagagtttcactctgtcacccaggctggagtgcagtggcgtgatctcggctcgctgcaacctccgcctcccgggttcaaacgactctcctgtctcagcctccccagtagccgggactacaggtgcccacaaccagacctggctaatttttgtagttttagtagagacagggtttcatattggccaggctggtctcgaactcctgaccttgtgatccacctgccttggcctcccaaagtgctggaattacaggtgtgagccaccgcgcctggcaagagacgctgtttctacaaaaaaataaacaaaaaaaattagctgagcatggtggcatgcacctatagtcccagccacttgagaggctgaggcaggaggaccacccgggcccggtggctcaaggctacagtgttcacaccactgcactccagcctagtgtgcagactggagtgatggagtgagactctgtctcacaaaaaa

SEQ ID NO: 719299 - DNA, 104 bp, Homo sapiens
cggcacgaggcgagctgtggcctcgcccctccggtggatctccgaagttcactgttcggacaattacacgccatgacttttgaaacgtcttaattaagcggccg

SEQ ID NO: 719300 - DNA, 531 bp, Homo sapiens
  misc_feature (229)..(229): n is a, c, g, or t
  misc_feature (311)..(311): n is a, c, g, or t
  misc_feature (363)..(363): n is a, c, g, or t
  misc_feature (434)..(434): n is a, c, g, or t
  misc_feature (438)..(438): n is a, c, g, or t
  misc_feature (520)..(520): n is a, c, g, or t
cggcacgagcttacatctcccatagcagcagcacacatttagacaacaaacagtttatgcaactggcgcctatgagcatgatgctgaatctactaatcaccatgagcccccacctgagtgtgtgctgctaggcatgtctacaggatgcgccgaccaaacctgccggccggccaaggtaactttgaaatgctaacttttgtgcctagagcaatgagacttttaaagaaanctgcctaaggcaaactccttctcccttattaagtgatgcataaaatatccatctatagctttagcatccttccaaaacctcncagagcattgcggtgctgggctcatatcacccgcggggcaggctgagcacantcctacagcacatctctagtctgtgcacaccagaagctgagttatttccagagtctgaaaaaattctgtgncctnaacagagaaaaactccactgtagttctctatagaaaatgacttaactcatttctgcttaaatacactatgttaataaagaancagaccttaaa

SEQ ID NO: 719301 - DNA, 703 bp, Homo sapiens
tgtaagtaaacagaatattatcaaacaatttatttgggctttatggaaaaaagagtattgggtctaaatgtgccaccataggtgtcaaattctcctatctgcattggtctttatcctaatatggtgtaccatttcttttcttaataatttacttggtggtggtgtttctacactttcatccctgtttttaatctggtatatcatcaggaaatggtgattttaatcattaacatgggtttctttggtggatgtgtggtaaaaatcaacactaggctcagggctacatattcttaactcctgctacattggctggttaactatcaacttggtaacctcgtgtttatctactacagtgtgtatatatacttagagcatttcctctaacacatttcacagtgtcagtacttcttttaaaagggtcttagaccagtctagcaaatggtcagtccaacgctcattacttcacatttacacaaagcagtcttctccgggtaaacctttgtgggtattcggtacacctacttcggaagggtcttcaaatttccttccttgggtaacagcggcaaaaggttctctcttaaagttttatagggtgggccatgtgaaggccacaaagctgggtcgattcactctgattcacacccagacattttcccagatcgttaccaagcggccatccagtcacgtactccagtacgcaagg

SEQ ID NO: 719302 - DNA, 3317 bp, Homo sapiens
  misc_feature (219)..(219): n is a, c, g, or t
  misc_feature (3306)..(3306): n is a, c, g, or t
atatcttccctctccctgccccttcacttcccgttcctggcccttcagctgagggaggagcagagcccatggctccccaggctggggggcatttttctccaggggtgtggggtgggcgctcccttccatccttctggaagacaggaggggtcatgagactcctccactgtggaaaatggtgcttccttccagcacagggtgctgtatcgtcccgggaangtgcctcttgttcagcataatgacctgggaccctcggggccagaaatccacagccccagcttccccgtctcccagggaaggcatctgttggctgaccatctgctaaccagtcgctcctgtttctgctctgatacttcccaaggcatcccgaagcacctgtcttagctgccccttcctgtcccacagaggattggcacttggttttgacaggatactttaccagctttgatgttaattctccttcccttgtctcctgtagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 719303 - DNA, 2433 bp, Homo sapiens
  misc_feature (2422)..(2422): n is a, c, g, or t
tgccaagaaaaaattcttcctgggtggggcgcagtggctcacgcctccaatcccaggtctttggaaggcccaggcaggcagatcacgagatcgggaggttcgagaccagcctggccaatatggtgaaactccatctctgctaaaaatacaaacattagctgggcgtggtggtgcgtgcctgtagtctcacatactcaggaggctgaggcagaagaatcgcctgaaccagctttgatgttaattctccttcccttgtctcctgtagggtccagccacagcaggcccggcgtcccggtggaaggcagccctgggcggaacccaggcgtttaacggctcactaggcagccccagatctgctgagttgccactcgcagtgttgtcagttcccgtgttctgagaagaggtcatgcctgggaggaagggatcgtcatgctgcatcgaatcctctctccgccgtgtggcccccaggagagtagctgcctgttgcacctgctccacacctccccacagcctccctgcaggtgctgtgtggccgtgatgtgcagagagcagtgagggagggttcatgaaccaggtggatcctctttaaaaaaaaaaaagtttttgttatatctctagaacatttcaagtcttttcctttttttctgttcctagctatggggttttagagaagtgggaacaggaaggcatttgtctttttcttctagtttactacattttccttccgtagttcttcagctgtgtggaaacgggcatcacaaggacataggatcatagattgggtagggagggaggaggatttctggaacttttctcaaaggaatttggacccttataaatgggactgaaggtcaaaacaacagtgatatccttgcttagaaattgtcctcaaggaataaactctgagagcaagcccgggttggaaacagatgctttaaaatcctctctccagaacagtggttttttgtttgtttatttgagatggagtctcactctgtcacccaggctggagtgcagtggtgagatcttggctcactgcaacctccacctcccaggttcaagccattctcctgtctcagccccctgagtagctgggattacaggtgcccaccaccacacccggctaatttttgtatttttagtagagatggggtttcaccatgttggccaggctgatcttgaactcctgacctcaggtgatctgcctgccttggcctcccaaagtgctgggattataggtgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 719304 - DNA, 2291 bp, Homo sapiens
tttttttttattttgagacggtcttgctctgtcatccaggctggagtacagtggcgcattcatggcttactgcagcctcaacttcccagactcaagtgttcctcccacctcagcctcctgagcagttgggactacaggcgcatgcaccacacccgtctaattattttatttttttgtaaagacacggtctctctatgttgcctaggctggtgttgaacttctggccttaagtgatcctcccgcctcagcctcctaaagtgctagggttacaggtgtgaatcactacatctggcctaaatttaaaaaagtttttagtctacatccagtgacctatcagggatgcttgttattttatacaagctgctttgttatcatatcagcattctcttcagccagctccaaggcagatagtcacccctctctctgtgtggttggggtgggagcaggccccgtggagggagcggtgctgaggacatgtccctggcgttccgatgctgctccatcgaggaccccctggcctcaggaggaaggagcaggcgatgcagccccttagtgtggtcgtgttgactgacaggtggctgatgcctgagcgcgccctcttcttccatcttaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcagggcagggttgaagtggagatcgggaaagagggtctgaagtttgagaatggggccttcacgtactatggagtgtcggccctaactgtgccatcctcggttcaccagtccccggtgtcctcgctccagcccatccgccatgacctgcagcccgacccaggtgacggcacgcattcatctgcgtattgtcccgactacaccgtgagggcgctctctgatctgcagctcatcaaggttacgcgactgcagtacctcaatgcactcctggctacccgagcccagaacctgccacagtcccctgagaacaccgacctgcaggttattccaggcagccagaccaggctccttggtgagaagaccaccacagcggcagggtccagccacagcaggcccggcgtcccggtggaaggcagccctgggcggaacccaggcgtttaacggctcactaggcagccccagatctggggaacagatgagcacgtggggagctggagtgagctgagcagaagttttgtgcccgcctgcccccatcccctccaggccacgttttagatggcccttgtagttgcgggtcctgggtgtcctcagaactagacatcaatgcctggatccttcagccggccctgccctcctttaggagacaggagtcaccagggcacagccctccaggcccgcctcaggaaggaatgaaaggaatgccatcatctctagttcccagggcccagccttccccttctcccccggggcagggacagtgcggcatattcagattcagacctctttgggctgagccaccttgtgagtgcagttactgcctttgtgtggccgtgacctctatttgtttgcttttaatttgccaacctatcgctgctggcagcactttttgagcaagccgagagcacccattttggctgggggttcagatcgatggccttgtccatgttgtcctttctggcttccctgatggtgtcatgtttcagcgcatgcgccccagcctttcccatgtgccaaaccagaagctccactgcccgtaggctgtccctgtagccctgctccctccctggaggctgctcttctgattctgagagctggcctagtggtgctgagggcccctttctgcttctctgcccacctgctgagttgccactcgcagtgttgtcagttcccgtgttctgagaagaggtcatgcctgggaggaagggatcgtcatgctgcatcgaaccctccctcactgctctctgcacatcacggccacacagcacctgcagggaggctgtggggaggtgtgaagcaggtgcaacaggcagctactctcctgggggcacacggcggagagaggattcgatgcagcgtgacgtcga

SEQ ID NO: 719305 - DNA, 1263 bp, Homo sapiens
  misc_feature (1252)..(1252): n is a, c, g, or t
tggaacggtgtctggcacacagcaagcatgcaataaatatttgaatatttattttaaaaagctattggttgtgagctaagatcagggattcttaaccttggctgcacaccagaatcacctggcaaattaaaaatacgtggacctgccaccagagcttgtgatttaatcagagtcggcatcagagttttcaattttttatttatttattattattattattattattattattattgagacaagatcttgctctgtcgcccagactggagtgcagtggtgtgatcacggcttgctgcagcctcgacctccctggttcaggccatcctgccacctcagcctcctgagtagtagggactacaggtaggcaccaccacacccagctaatacttttaatttttttttgtagagatagggtctcattatgttgcctggggtagtctcgaactcctaggctcaagcgatcctcctgcctcggcctcccaaagtgttgagattataggcgtgagccaccgtgcccagattcacagaagtttcatacacctttcacccaggttcccctaatgttaacagcttacatataaccttggtacatttatcaaaactaaaggtgcaatcatactaatagctagagtttatttggattttaccatttttcccaatgtcccttttctgctgcagcagccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 719306 - DNA, 510 bp, Homo sapiens
  misc_feature (10)..(10): n is a, c, g, or t
gagacggggntctcacattcatccagatggattgtatggctgtgaccttggggcccggaggggcgcctcctccgtgggcatgaccatgttctgcctacgagggcaatggattacatctgccctgaacgaggacctgagctcctggaccgtggtggacagcgtggttcagatcacccagcgcaagtgggaggcggcccgtgtggcggagcagctgagagcctacctgggagggcctgtgcgtggatgtggctccgaagataccttggagaacgggaaggagacgctgcagcgcgcggacccccaaaagacacacgtgacccaccagcctgtctctgacccaatgaggccaccctgatgggtgctgggcccctgggcttctaccctgcggagatcagattgaccttggcagtgggatggcgaggaccaaattcagtacattgagcttgtggagaccagaccaggaggagatagaaccttccagaatgtgggcaggtgtggtggttggcttct

SEQ ID NO: 719307 - DNA, 742 bp, Homo sapiens
  misc_feature (731)..(731): n is a, c, g, or t
gcttacagtggcgagggttcaggatgtcacttgttcttcggcctgcctctggctgatcttgggattgggctatcaagcccaatcccaggagaaggacaacgatccgaaccagacggatgaggaagtgttccatttcctgggattgggctatcaagatagcccaatccaggatgccatactgcacttagagctgttgctttcttttttcctaactttatattttgaaataatttcagatgataggaagttgtaaaggtaagggccccacgcacccttcatctagtttccctccatggttacatcttatatggttgtaatgcagtattccaacaaagactctgacactggtgcgatgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 719308 - DNA, 137 bp, Homo sapiens
cgtacttgcgcgggatataaggtacatgggagggtgctgaagactcacaacagccacagaattagttacttgttcgaagcttacagcttgttttccaggcatcgaataactgttgagattgttctactgttgtcgta

SEQ ID NO: 719309 - DNA, 325 bp, Homo sapiens
agcgctgagcaatcatcataaagggtatttctaggccaaatatgcagataattaggttccagggcataatctccgttcttagggggaatagtcaactccatgtacccatgaggaacgtactggctgacggtaatcaaagcgaggttccttcatcaggtgagatctgacagtggaataggctccatcacattcctacaaggaggtcacaagttgacatcttggggaccttggtcagatccaagcacggtgatcattccttcctcgggatttacatttcaacagccgggggctaaagtgcattttcacatgggggtatggcccaggg

SEQ ID NO: 719310 - DNA, 1014 bp, Homo sapiens
  misc_feature (968)..(968): n is a, c, g, or t
  misc_feature (983)..(983): n is a, c, g, or t
  misc_feature (1009)..(1009): n is a, c, g, or t
tttttttttattttgagacggtcttgctctgtcatccaggctggagtacagtggcgcattcatggcttactgcagcctcaacttcccagactcaagtgttcctcccacctcagcctcctgagcagttgggactacaggcgcatgcaccacacccgtctaattattttatttttttgtaaagacacggtctctctatgttgcctaggctggtgttgaacttctggccttaagtgatcctcccgcctcagcctcctaaagtgctagggttacaggtgtgaatcactacatctggcctaaatttaaaaaagtttttagtctacatccagtgacctatcagggatgcttgttattttatacaagctgctttgttatcatatcagcattctcttcagccagctccaaggcagatagtcacccctctctctgtgtggttggggtgggagcaggccccgtggagggagcggtgctgaggacatgtccctggcgttccgatgctgctccatcgaggaccccctggcctcaggaggaaggagcaggcgatgcagccccttagtgtggtcgtgttgactgacaggtggctgatgcctgagcgcgccctcttcttccatcttaggagacaccgtggtgaagaggaagcctgcttctctgatggcccctctgaagcggaaggaggagttctccttgttcaaggtgtctgatgatgaatataaagtaacaatctcgcctcagctgctcttggccacccagcgcttcctgtcccgagaagtggatgtattcagcccgctgcgcatctctgagaaggtcctgctgcacctgttgaagcatcccagtgtcaaccaggaagtgaggtttgacgagagcaaccggctggccacacaccactacctgtaccagcgcagccagccggtggattacttcattctcatcctgcaggtagctgtgggtcccaggcctggagtccctcctgnttcctcaggccaggnaagggtctaggagaagaggggagcangggcc

SEQ ID NO: 719311 - DNA, 231 bp, Homo sapiens
cggagatcgcgccactgcactgcagcctgggcaagagcgagactctgtctcaaaaaaaaaaagaatccttcctcccaaaatgaaactatcattaatatccttaatcatttttattgccacaactaacctcctcggactcctgcctcactcatttacaccaaccaatatcaccataattacccccatactcctgcctcactcatttacaccaaccaatatcaccataaatac

SEQ ID NO: 719312 - DNA, 2101 bp, Homo sapiens
  misc_feature (1307)..(1307): n is a, c, g, or t
ctcataacgttgcctcattgccacttgatagataactcaatacaaccgtctgtctaaaattacccgcgtatgtgtgaagtgattcatatatagaagcgctgccggcatcaacagactcccagcacgttgatcattgaggcacgaatgatccagacgtcatgagtcaagtcaagtcatgagcagtagcgcgctgatgtagcggctatactctcgtccctgcggggcacctcagctggggacaactccttccgtccattgtataacctcgcggtaagtaccgtctcatcatttcaagcacagggccatttcgagtcctgtcccagagtgctggcgcggtagaaaagtttgcagtcgacaggtgcgatcatggggcgcgccaagggacatacttaggctcatgaggtgtaaggattacgtcctcccaatttcaacgcgacgttacagactccattacgggagcgaaagtccgctgttattgtgggggtcctcgctgtcacgcggtctcataaacaaatatctgcacttacaacttgcgatatccagaggtccatattgttgctacagcgagtacagagagtcgctaacttcgtgaagagaaaatattctgggaatacacaaattgagtcggtgatacctcaggcaaatgtgtctgccgcgaatgaattccaccatgtgggggaacagcattcaaaataccgcaatttgttcttggcaagatcaaggagatgaaacgcaaagcgctaatgaaatgggaggttccccgctactgtagcaccaacttttgtgccattaagcggccggataagtaccaggggatgtgaattaccaagtgcggttgcgataccccgcactaattctgtgcccacgtaaaggtccgttgggcactatgcgctaccacgtacaccgagcttgagtgggggtaactcacgtatttctatcatccgatgaggtataggacatattaagagatacacttcatcaacattaacataacaagcgggttctgggccccaacacttcactcgtgggtgttgtggaggaatccgattcatctaacgacaacgagaaagagttcgccaacaatcatcttattgcccggtgttgtacacaccactagacgtgacatttccactgataagatatgccagagagaacatatagccacatcatactcaaagagagcagtcccaagatgtctatatagtgcacactgaggcgtcattgtcacaaccgtgtataaggttaaaattcaacatatcagaaatattacacagaaactaacagaaattgtcgggcggggtgtcccncgagggtctaatagcgggggagggaccccaaataacacgtcgacgagtccaataacaacgggaattgacaatacaaggtcaagcggagcatagaataaaaaagacgagaaagaaagaaagatatatgtgacaccaacaaccaggtacagcgcgggagccaatatgaaagagtgggagaacaagagaaaccacaacagaacactaagaagaacgacgacgaagaggagacgacacacaacaacgaagtgcgcacacgacacagaacaggaggagccaaaagagacgacacgagtgcgatagacaacacgaccgaaagcgagaaagactagggcaaggaggcccagaaagaacagcaggaagagacagaaagagagggcacaacgtagacgaaggacagaacaacgagcgaaagagacggagagacaaagcgaggcgcgagacggaggacgacgcggagagaatgaggaaggagagcaagacagcaaaagaaagggaacaaggaaaacaggaaagaaggacaaaggatacgaaagagagcagacagaggagacagaaagaagagcaacgcacagcgagcgcgaggacgaagtcacgaagcagcggagaggagaagagaagcgagaagaggcagagcagaacggcagagagaaggagaagcagagaagagagaagggaaggaggaggaaaaggagaaagcgacagacagacaagcagagagagaagaagaagaggcaaagacgagacgaagaggaaagagagaggggaagaggagaggagagcagagggagagaggt

SEQ ID NO: 719313 - DNA, 312 bp, Homo sapiens
caggtggttttttcccccaaaaaaaaaatttaagtgtttattgcaggagaaacgtcccttgcccctcccccctctcatcaggccaagtggagggttggccagagggcctgcacatgcaaaatccagtcccctcccttaaaaaagctgaaaagggtcccccggttttttttttcagggctttgcatgggctttattccccctttgcctctcccccccttttttggggcaaggaaaagcagctgttttgggtaacaagctcttttggccagggtttgttcatgtaaaaaaaaatttcttttccttttgcaaata

SEQ ID NO: 719314 - DNA, 541 bp, Homo sapiens
  misc_feature (530)..(530): n is a, c, g, or t
gtacatatctatactgacgcgagtgaaaaaagacaatcccgaatgcttacacactatgctcccatttatacaacattcttgaaatgacaaaataagaagagatgaacgattagtggttaccaggagttagggaaggtggggagggagatccttgtgggtggacagtccaaatcatttgtcacatgtacatctgtgtaactaccactgcaatcaggataaagaagtcccatccccacaaggatctccctccccaccttccctaactcctggtaaccactaatcgttcatctcttcttattttgtcatttcaagaatgttgtataaatgggagcatagtgtgtaagcattcgggattgtcttttttcactcggcgtcattctcgggagatcatccaggcattgcatgtgtcaacagtttgctcctttttattgctgagtggtattccgtggtgtatgcattggccccctgaaggacacctgggatgtttccagtttggggctattccaaataaagctgctacgactatcttngagaaaaaaaa

SEQ ID NO: 719315 - DNA, 97 bp, Homo sapiens
gcggccgcctactactactactgctcgaattcaagcttctaacgatgtacggggacatgatgactcaaggccaataataaagacatttcctacctgc

SEQ ID NO: 719316 - DNA, 256 bp, Homo sapiens
  misc_feature (150)..(150): n is a, c, g, or t
  misc_feature (207)..(207): n is a, c, g, or t
  misc_feature (218)..(218): n is a, c, g, or t
gaagaaagatacacaatgcaaacagtaattgtaagaaatctggaggggctatatttaatatcagacaaaattgacgttaaaacaccaaaaagttactagagataaagagcaaaattttataatgataaaaggatcaatccataaggaggntatagaaattataaacacatatgcaccttaaccacagaccactaaaatacatgaagncaaaaaatggngaaacttgacagagaaatatacaattcaacattaatag

SEQ ID NO: 719317 - DNA, 205 bp, Homo sapiens
tgtgtcatgcactacggtggttgagtcagctcgcccaagatgagctgcagccccccagagagagctctgaatgtcaccaagtaagcaggccccagcctccaggccccaatccgccatgctctccccgctctggatcctgcactactaacactcgactctgctgctcatgggaagaacagaattgctcctgcatgaacagagccag

SEQ ID NO: 719318 - DNA, 210 bp, Homo sapiens
  misc_feature (155)..(155): n is a, c, g, or t
tcaagcttctaacgatgtacggggacatgcacaaacggtaagttcttgtgtgttggctgcgtccactgttcctcttgccacgcctacaggaggaaaaacgcaagggcttacaagaaggcatgttccgttcaggagggaaggcagcacctaaaagncactctgaagtcaacgatgagctgggaaaccatctcaataaacacattttggaca

SEQ ID NO: 719319 - DNA, 764 bp, Homo sapiens
gaacttgaaagaaaaatcatctgtgagtcccttcaggttctcactcatagtcatgatccttcaagagggaatatgcatgcgagttaaagtaagggctatgatattggagggtcccaaagtacggcaggctgaaaaagtagtgaaggaaatgtgtctcaacgtgtctgggaaaaaattagttaggaatttggatgggtaaaaggtacccttgctttactccatcttattttcttagcccccttgtgagtgttaacactggtttcatgtcctagtaggaagtgcatctccatcctcatcctctgccctcccaggaagtcagtgatggtctttcggggcttcccctccaaaggaccttctgcagtgaagtgccacatccagttctttctttgtggctgctgtgtcagataatggaagagatcttgtgtgccacaccaggattttttttttaaaagaaaacctatagttgaaaaatttactaagtgaacgggtgttgtactgtggtctgggggggtggcaacattttaaacaataacagggtaggccccccttaagggaggcttgagaatcctgtggtcccctgtagacaattttcacaatggagtgtggctaattcacttaaccaagaacaaccacccaccgcaacgaacacacataacaatcaacatgacgagcagaccacagatacgcactgaaaaacacaacacaacaatgttggggggcgcgccgccaaaattataacaaccgtttgggcggccaatgatgaa

SEQ ID NO: 719320 - DNA, 339 bp, Homo sapiens
  misc_feature (39)..(39): n is a, c, g, or t
  misc_feature (46)..(46): n is a, c, g, or t
  misc_feature (52)..(52): n is a, c, g, or t
  misc_feature (81)..(81): n is a, c, g, or t
  misc_feature (99)..(99): n is a, c, g, or t
  misc_feature (117)..(118): n is a, c, g, or t
  misc_feature (171)..(171): n is a, c, g, or t
  misc_feature (181)..(181): n is a, c, g, or t
  misc_feature (214)..(214): n is a, c, g, or t
  misc_feature (241)..(241): n is a, c, g, or t
  misc_feature (271)..(271): n is a, c, g, or t
aaagttttattttgagtttttctttttgggcattgtccncaagccngtattntccaggaaacttgtccttttggaaatcanattgaatgatatttttanatccaagtgaggtagggnnggtattaaagtgaaagggaaggtgatgcctttattttgggttatgcttgaagngttaaatggntaagtattaaaattatcccaattaaatccttancagtcagaacccttgcttccctaaaanatgcccactgccaatcatgttgggctgagntaatttgttcctctttttgaaactattaaggtaaaaaattaccaataaaaatttttttataaaggcca

SEQ ID NO: 719321 - DNA, 698 bp, Homo sapiens
aagaagttgattccagccctcatggatgactttgagggctcaggatgtcagtggaggaagtccctgcagatgtggtagaaatcacaagacaactagaattagaattagggccttaaggtgagatgaaattgctgtaaactcatgatgaaacttgaacaaatagggagttgcttcttatggatgagcaaagaaaatattttcttgagatggaatataatccaggtggagatgctatcaacattgttgaaatgacaacaaaggatttagaatattccataaacctagttgataaagcagcagcagggtttgagagggtttactccaaattttgaaagaagttctactgttgataaaatgctgtcaacagcatcacatgctacagggaaatctttcgtgacaaggaacaaacttcactgtcttcaaccaattgacacaggcttccaaccttcagcaggccccacactgattagccaagcagtcatcaatatagaggcaagaactctcacagcaaaaagattatgacttggtaaggtcagatattcattagcatttctaagcacctgacgtattttaacttaaggtatgtacaaaagtttattagacatgctataaaataactaactttaataactattaaataactcattaaaactaacaatatagttaaaggcataacttatataaagcatgtgaattag

SEQ ID NO: 719322 - DNA, 284 bp, Homo sapiens
  misc_feature (25)..(25): n is a, c, g, or t
acttaaaaaagttgggctggatatnagtgtggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgttt

SEQ ID NO: 719323 - DNA, 251 bp, Homo sapiens
  misc_feature (53)..(53): n is a, c, g, or t
tccgacggtaccaacagcatggtggtggaacacccgagttcctcaaggcaggnaaggagcctggctgcagatctggcgtgtggagaagttcgatctggtgcccgtgcccaacaaactttatggagacttcttcacgggggaaggctaaggttaatcctgaagacagtgcagctgaggaacggacaatctgcagtatgacctccgactacttggctgggccaatgaggtgcagccaaggatgagaagcgggg

SEQ ID NO: 719324 - DNA, 348 bp, Homo sapiens
  misc_feature (53)..(53): n is a, c, g, or t
  misc_feature (66)..(66): n is a, c, g, or t
  misc_feature (81)..(81): n is a, c, g, or t
gcagggagtaagcactcagtgaatgggagagcctattcctggagatgagttcncagcaggatcctnatgctgtcagagccnaggggccttgcatctgaaaggtagttcagagctgcagggccttaggctggagctgacaaggtcagaagaggtaggaaggttccctggggtagtatacccaagaaagtgcaggtaaaggtttaggacagagccttgagcagcactcacctttaggctcaggaggaagcaagaatcccagagaggagatagaaagggggaggacggtggggctggaaacagatggcagggcaagaaacccaccactcccaagaagggcggcggcacccc

SEQ ID NO: 719325 - DNA, 616 bp, Homo sapiens
  misc_feature (198)..(198): n is a, c, g, or t
  misc_feature (216)..(216): n is a, c, g, or t
  misc_feature (234)..(234): n is a, c, g, or t
  misc_feature (284)..(284): n is a, c, g, or t
  misc_feature (328)..(328): n is a, c, g, or t
  misc_feature (337)..(337): n is a, c, g, or t
  misc_feature (343)..(343): n is a, c, g, or t
  misc_feature (349)..(349): n is a, c, g, or t
  misc_feature (371)..(371): n is a, c, g, or t
  misc_feature (381)..(381): n is a, c, g, or t
  misc_feature (386)..(386): n is a, c, g, or t
  misc_feature (401)..(401): n is a, c, g, or t
  misc_feature (415)..(415): n is a, c, g, or t
  misc_feature (420)..(420): n is a, c, g, or t
  misc_feature (431)..(431): n is a, c, g, or t
  misc_feature (434)..(434): n is a, c, g, or t
  misc_feature (447)..(447): n is a, c, g, or t
  misc_feature (450)..(450): n is a, c, g, or t
  misc_feature (463)..(463): n is a, c, g, or t
ctgagtacatcttctactatcctattattagcttctatctcttagtgtaacttcaaaacttttaagagcagtgaagttggtcaggtacactgtggccaccgttattacaacctaaagaaaacattcgttccctgttcattgattttaggggccagatctaacattgtagtgtctttcaccagatagacttctactgtntcatcaaactcccttctnaactagacctagactttntactccaatcaggctaatctacttactgaatgtgacatatttattcctanttccatacctttgcacatgccctactctccactaattatacttnaaagtccanaaattntttctntagtaacagacttaggtactgnctaagcagtnattancacaatattccttanttttcatatgtggntattnatatgtctatntanatgtatatttatnttntatgtatgtaacnatgtaaatatggtttgcaggggtcgtacgtagtggcaatctcgtgctttccgtatgagttgtaagctccttgagagcaggatccatgtcatccttgattatataaattattcccctatcattcctttaagtgctagtgctagtcattatgtgt

SEQ ID NO: 719326 - DNA, 374 bp, Homo sapiens
ccacgattgcagtggtggggcacgaggcagtgggggataagctgttaacatgagggtgtttctcgttgtaaatagggcttttactgttgttaatgtgatggtgtgagtcatgccccattgtgcttgtggctaaatatatccagggagtatatggctgtgtactagtatgttgagtcctgtaagcaggagactgatattagatcaggagaacgtggttactagcacagagagttctcccactatgttaatagtggggggtataggcgaggttatcgaggcttgctagaagtcttcaaaaagctattagtgggagtagagtttgaagtccttgagagaggattatgatgcgactgtgagcccaccactggctcgtg

SEQ ID NO: 719327 - DNA, 145 bp, Homo sapiens
gcagtttaattttcttgttttgtatttcgttgttgtggtttctgtagtacaattttaaaagcatcagttaagcctaggtaaattttacctaggaatttggccttgaagggcccaacagtttacttcagcatttttttggaggaca

SEQ ID NO: 719328 - DNA, 605 bp, Homo sapiens
  misc_feature (198)..(198): n is a, c, g, or t
  misc_feature (216)..(216): n is a, c, g, or t
  misc_feature (234)..(234): n is a, c, g, or t
  misc_feature (284)..(284): n is a, c, g, or t
  misc_feature (328)..(328): n is a, c, g, or t
  misc_feature (337)..(337): n is a, c, g, or t
  misc_feature (343)..(343): n is a, c, g, or t
  misc_feature (349)..(349): n is a, c, g, or t
  misc_feature (371)..(371): n is a, c, g, or t
  misc_feature (381)..(381): n is a, c, g, or t
  misc_feature (386)..(386): n is a, c, g, or t
  misc_feature (401)..(401): n is a, c, g, or t
  misc_feature (415)..(415): n is a, c, g, or t
  misc_feature (420)..(420): n is a, c, g, or t
  misc_feature (431)..(431): n is a, c, g, or t
  misc_feature (434)..(434): n is a, c, g, or t
  misc_feature (447)..(447): n is a, c, g, or t
  misc_feature (450)..(450): n is a, c, g, or t
  misc_feature (463)..(463): n is a, c, g, or t
ctgagtacatcttctactatcctattattagcttctatctcttagtgtaacttcaaaacttttaagagcagtgaagttggtcaggtacactgtggccaccgttattacaacctaaagaaaacattcgttccctgttcattgattttaggggccagatctaacattgtagtgtctttcaccagatagacttctactgtntcatcaaactcccttctnaactagacctagactttntactccaatcaggctaatctacttactgaatgtgacatatttattcctanttccatacctttgcacatgccctactctccactaattatacttnaaagtccanaaattntttctntagtaacagacttaggtactgnctaagcagtnattancacaatattccttanttttcatatgtggntattnatatgtctatntanatgtatatttatnttntatgtatgtaacnatgtaaatatggatatagcagttgttttatcgatgtggaataatgtctgttcagtataagatgtaagcatccatgtgagacgcaggattccatggtcaattccgttatatatttactatattattccccctatcattgccgt

SEQ ID NO: 719329 - DNA, 679 bp, Homo sapiens
aagcattcagggcaagcgatggatcaactaggccagtgacccgcaagaatgggtacccgatcttgaccatcactatcactgcctactttatataaaggctaataaggaaggagtataatgtatggctttaccaagctacatcaagaactcagctgagctgtgcctaccaggggtcccctatcttacccaggactccattcttctccttgaatatatatgtccattataacacttcctggttgcaagagtgatgtgcctccattatttcctccacagtattggtatttgtcagacatttgttctgctgtctatcaaatccagccaacgtctgcacaagaagtaggggccatctccactgggacccataagttatacttccttgtcatttgataggatagtatacaaggaaacccctccatatttggccctatctcagaaatggagagctagtcgtgaaaaactgcttcctgaaactttcctgctatatgccttaaagctacgtcttgaacctgagtacggaaaggattcttttccaggaacttacggcgataggctttgacttgggacgttcttccagactcacagttgacacatgatggctggtacgagctcgatcctattctgtctacggatccaagcctagcacttaatcaaaaaatatcctaccacactcgccagc

SEQ ID NO: 719330 - DNA, 337 bp, Homo sapiens
  misc_feature (117)..(117): n is a, c, g, or t
  misc_feature (171)..(171): n is a, c, g, or t
ctgttcctgtcctgggaatgagagcaaggtgggtaccgtgtcacgctcttaccctaagtccaactcttccaaggagtatgtgtgacctgggatctccttgccccagcctgacacgantgggagtgtctagatgcctgacaggccgtgggcgtgagctcagcatgtggcagnggtgcgtgacaaaggcctcctggtcactctgtccctgcactccatgtatagtcctcttgggtccggggcccgggggtgccgttggtgggagagacaaaaagagggagagtgtgctttttgtacagtaataaaaaataagtattgggaagcaggcttttttcccttc

SEQ ID NO: 719331 - DNA, 796 bp, Homo sapiens
  misc_feature (794)..(794): n is a, c, g, or t
  misc_feature (796)..(796): n is a, c, g, or t
aacaaaaaacactttatttataaaaaaataaataatacattttgtgagtatttgagacatagatgatgaataagaggatgtactaaacaaagataagatatcagtaaacatatacagcaagatcgaataacatgcatactacacaacacagtaactcagaataaacatagcatatcaatattagctatactacgctagtataaaaacaacaacacaacacagacacatatcaaacgcaactgaatacaagagtaagaattcagtaacagtatacttataaaaaacaaaacataatgttattgatgtagacatgcaagcgagatgcaagatgaactcgtcaagggatatgcatgtcagtgagtataagagtatattagataggagaccggacggagagatatgacttagtgtgataacgtgtactacagtttcatagtgtagagtttaataaatagcttgaatatagtattgttataggatgtaagaaaaagaatttggtgtaatttattagaagaaagttcaacgtattacagcgagtaagaggatgtttctgccttaattgatgagatcttatgattccacgacgtcgcgttagtaccgagatagttaatctcataatgcaatagacattagatgacagttcagtagtagttagagtcttaatggtaattattccagtttatcttttaactctttctactctaagagacgcgtagctgaacatgagcctcctcttctacatacttcatacacataagctatctgtagatatagcttagatcacactcacaatntn

SEQ ID NO: 719332 - DNA, 203 bp, Homo sapiens
gtatgccgaggctgagcatctgtatatatttgacttccaattgagatgtggcttcatttctttgtttaccccaataaatcgcccaatccttagcacgtgtgactctgtattaagcccaaggagaaagctgagactgtgggtctggcctccattccagacaatatgtctggctcagtcagaaccacctgtcgaagggggtaccg

SEQ ID NO: 719333 - DNA, 116 bp, Homo sapiens
aatgcggagccgtggaggacatccaattcaataccgacgtatggatataaacgatcgcaaaaacatcgatctgagccagtttacgcgcggcggttacattatgccggggacttacg

SEQ ID NO: 719334 - DNA, 153 bp, Homo sapiens
gagctcggtacccaatttggcggggctttaaatcgtttgaacccgggagtggaggttacagtgagccaagatcacgccactgcactccatcctgggggacagagggagactccatctcaaaaagcaaacaaaacaaaactgaggctgcctaga

SEQ ID NO: 719335 - DNA, 553 bp, Homo sapiens
ccagatttaagaaaactaaacggatataacgttagaaaaaattacataaactttattaacaactgctgtttaagcctacctttgacttacctcttttaatatagttaatatgtttaatatatatatttaatatagttaatacaaatacaaaaaaataacagtgtatgagacattaacattaacatgaagagtacatgatcaattttgggaaaatattgagaaacaaagttaaaatcggtagttgccttaatgtcctaaatacctcaacacgggctgggtgcagtggcttacgcctataatcccagcactttgggaggctgaggcaggtggatcacctgtggttgagagttcaagaccagtctggccaacatggtgaaacctcgtctctattaaaaatataaaaattagccaggtgtggtggcatacacccataatcccggctactcaggagactgaggcaggagaatcatttgaatttggaaggtggaggtggcagtgagtcgagatcgtgccactgccttccagcctgggtgacagagcaagactctgtctc

SEQ ID NO: 719336 - DNA, 510 bp, Homo sapiens
  misc_feature (17)..(17): n is a, c, g, or t
  misc_feature (33)..(33): n is a, c, g, or t
  misc_feature (42)..(42): n is a, c, g, or t
  misc_feature (121)..(121): n is a, c, g, or t
  misc_feature (134)..(134): n is a, c, g, or t
  misc_feature (142)..(142): n is a, c, g, or t
  misc_feature (175)..(175): n is a, c, g, or t
  misc_feature (500)..(500): n is a, c, g, or t
ttctgaaccctgctggnatctttgaagtttgcnaggtcatanaatcaagacatgaaaaggcttctcttccaacgtcattggtcccctggctcccttttacagatgagaacacaggtcccanaggtggagaaatnactcctancagggtcaatagaatttgttagtgcagctcaanatgggacttaaactcaggcctcctgatcacccattccccaggctaggaaacaggtctctgctcggtgtggtggttcatacctgtaatcgcaacactttgggaggctgaggcaggagcattgcttgagcccaggagttcgagaccagtctgagcaacatagtgggaccctgtctctacaaaaacttttaaaattagctgggcatggtggcacacatctgtattcccagctactcaggaagctgagacaggaggatcgcttgagcccaggagttggaggttactgaactatggtcgcaccactgcactccaagcttggtgacaagtntgccctcaaa

SEQ ID NO: 719337 - DNA, 133 bp, Homo sapiens
acaaaggcaaagttgaaagaaaaggcacagttaacaaaacaagggtggctagatttatcttgggtgatgtgaggacatccagagaggaatgctcttgtaaaggtggtctgtggatctgtctgaatagaaagag

SEQ ID NO: 719338 - DNA, 233 bp, Homo sapiens
cccaagtaaagtgaagggggtaagggggtgggagggtaaaagtttttccaagttgtggcaaaggaaactaaccttttcctttttaaaaatgtaaataaaaaagtttttaccgggtttatatagatttccctataaataagccttttaagactggcaaatgttgaactggacaaacatttatcagcaaaactgcccagtttttttggggctgaagttctgtaagtagaattcca

SEQ ID NO: 719339 - DNA, 624 bp, Homo sapiens
cggaaacaagagcagaaaaggaagccgatggtccttccccatgggtcgttctgggaagcactggcgtagactttttcctcaaatcacagccgtgtgaaagacagcaccaatcactgccatggatttcctttcatatctcttaccctttgactcaaacagaacaggcaccgaatttagcattctgctcttgagttcatggtgatataccatggctaagagtaactttgggtcaattttctccaggccacagagagcctgagcgatgaagcagctgctggataggtctgtagacgacctcagagcaggaggagctaccctctagcctgtgtggcctgtgagtcaccagcgccagcctcagcagcactggtcctgcccgtgcgggtccctgcgtgagcccctctcaacctgggccgaggactcgacttcattcacaggatggccagtgacctggcacagatgcagagaacttttggttccctggatgctgctctttctaaaacagtgtctttggctgggcacagtcgtcacgcctgtaatcctagcacttttggaggccaaggcaagtggattgcttgaacctggggggacaagaccagcctgggcgacagagtgagactccatctc

SEQ ID NO: 719340 - DNA, 550 bp, Homo sapiens
tctcgggtaccataccccctcggccacgcgcccacacgtcagctgtctccagcccccccgggctgaggaggagatcaggccagatggcactggacccctcatttgcaatacccgggggtgcctcacgacgagagcgagaaggatcgaagagttgcgcagagaataccagacgactcgatatacaccgtgaacgatgctacgcacgcatgacacaagctcgggctacgtgcagagcatgcattcgtggcgacacgacgcagtgcactacctcatccaagcaggcctctgtgccatcacgaccacctaagatactgctcaaaccccgcagagtgagtcacaggacacccatggccccgagcggcctggagttccacgtgcaaataccatgacacaatacgtcacagagcgactgcgcaacgcaaacgggtcaggcaagccaccgcgacataataacctatgcctgcccagaagcagaccattacgtacaaaggaagcgctaccaagctgcatatcctgccggtgagggaccaaagccccagaagaagcctaa

SEQ ID NO: 719341 - DNA, 420 bp, Homo sapiens
  misc_feature (60)..(60): n is a, c, g, or t
  misc_feature (62)..(62): n is a, c, g, or t
  misc_feature (101)..(101): n is a, c, g, or t
  misc_feature (103)..(103): n is a, c, g, or t
tttggctgtgggaggaagaaaggctagcgggcgttggccgtatgtgggtgtcttgaggcngnttttcagttctttcatttaccaaagtgacatgcacctantnggtgccaggtgtttagacgtacatacaaccctctgcaaaatctttcagtgtagtcctctgtatgaaaagtttccagccaagaattgccactgcacctgagataagggggatcctggccattaaggaaaccttgccttcgaaactgagccgtgaggaactatacaaaatgggaaattgggacaaatcccagtggctcatgacactaagaagtaaattacgaactcactgagctggaagtcattcaacgggaattgataggtaagctactatactgggaaatgaaggagtaggaaagaaggaaacctcaagttacaaac

SEQ ID NO: 719342 - DNA, 369 bp, Homo sapiens
ggcgctttccgattggacagcgtcacccgctagaagttcgccgcagaagatgagggcggcgatcacgtccatcgcgtctcgtggcgcgaagccggccaataaatgctgtttggaggcccactttccagccaagaattgccactgcacctgagataagggggatcctggccattaaggaaaccttgccttcgaaactgagccgtgaggaactatacaaaatgggaaattgggacaaatcccagtggctcatgacactaagaagtaaattacgaactcactgagctggaagtcattcaacgggaattgataggtaagctactatactgggaaatgaaggagtaggaaagaaggaaacctcaagttacaaac

SEQ ID NO: 719343 - DNA, 185 bp, Homo sapiens
cgaggcaggctgtgaggaaaaaaggcatgagggctcgtcttcggaatctgtgccacccggcactaccgtttcgagggtgaagctcctcgacaccatgggggacacttttcctcagaagctggtcgccgccgtcagctaccagagattcactgactgctataagtgcttctaccaggtgcagcctg

SEQ ID NO: 719344 - DNA, 172 bp, Homo sapiens
cacggttacttccggactacgaaggctgtgtcaggaaggacacgagtcacaggagtggcagcctctatccaggttctgacagacacacacagggtcctaggagagcaagggtggggcactggagcataggggcaaccacccagaagagtcagtgcgggtttgagagatgtgg

SEQ ID NO: 719345 - DNA, 836 bp, Homo sapiens
caagatgctggtatactgagcataacatttactgaagacatggggctgctgccctgcctcctgtatcagttctaaagttcaaggtagggcatttttcagggatctgaagccactggtacgtggactactcactcctttctcctccccaagaagattttcattaaaaactcgtttgcatctttgaagaataagcatagcagttgttttgaaagaacgtgcatatacgtgaaagtggcttttaagggaagattacagtgttagagatggtggcgttgatccagtgtgtgctgcccactgccatgagagctgtttgacaactacatgcaacaagatgcccatgaattcttaaattacctactcaatacaattgctgatattctacaagaagaaagaaaacaggagaagcaaaatggccgattacggaacggagacgtggacaacgaggataacaacagcacaccagacccaacctgggtccacgagatctttcagggaacattaactaatgaaaccaggtgtcttacttgtgaaactataagcagcaaagatgaagattttttagacctttctgttgacgtggaacaaaacacatcaattactcactgcttaagagggttcagtaaacacagaaactctgtgcagtgaatataagtactactgtgaagagtgcccggagcaagcagggaagcacacaaagcggattgaacgttagaaaatggcccgatcctgggtctggacctgaaagaggttagtctttgggccattcccgggaacgaaactttaacggggggatcctaaaacccgtgtcacgttgggagggacaaccggaatttgcc

SEQ ID NO: 719346 - DNA, 127 bp, Homo sapiens
cgctaagaggggaggtagctcccaccattttatgggtgcatggcaccctcgagcagacatcatgtgggacgggagatactgatgcaggcatcttaggaaacattctacttagctacttatatgctag

SEQ ID NO: 719347 - DNA, 912 bp, Homo sapiens
ctctcgcgtttcggcccgctgaatactgttggtcgagacaatacgggagaagctctaaaattactcatcgcgtgaagcaccgtacatggatacaacaaggaatagacaatattactgatgatcgtagttaaagtgcttacactatctttctgatgtgacatctgttcactgtcgaggctattgatctctccagcgcaataatatcaaacaagttcgtaatagctaggaagaactattaaataagattgtcttgtggtatatggattgccttcgaccttaaccggaatcatttcaaatgatctcgcgcatacagtaagaagacgcctatcaaagctaggggcataaacagggagcgttctcggcgagggaagttttttaagcgtttgcgagaactcctcatgccaccctgtgcttggagtccctgaggactactgagccggcaggtgggttgaattgacaccctctatgccttcaacagtggcaaacggtaagagcggaaaccaggacctctgaggactgttctggggccaaaacagcctgatttaagcaggctaatgaagcccgagctactgacgaacaattacaagttgtaggtgcctacagtggagatgacctttcacacgagcctgacccaattcacagacaactcacttttgacggacactggccaaaagttgctaacaaatcgcgggtgaatgaggtggagcttctgttgatggaggccctttacgatggggcttgggtgaacgggcatattaagacgaggtggacaacagaagtccacatgacctgtgttgcagccccgagtgtaggatttggaaaagatcacagggattgacaggaccgctggagttctggtgccggatttgaaagaacatagaatatgtgggaaccacggccatgacatctcca

SEQ ID NO: 719348 - DNA, 251 bp, Homo sapiens
  misc_feature (210)..(210): n is a, c, g, or t
atcatcgagctcggtaccactagtccacggttggctagtcacaacactctaaatgaagtttgaattctttttccattctgggtggttccctgccaagtgggaaagaaactggcctggaagtctctgttgtggcgcctactggcagaatccttggtagtcatgcattctgcctggggagaagaggctagggctcctcagcccctatccccngaaaaggtcattcttctctctcacgattgccttctctggaa

SEQ ID NO: 719349 - DNA, 122 bp, Homo sapiens
cgagtaggcgtatgcacatgtaagcagcatcatggaggccaaggaggttcgaagctcagtggccagctgggtggccagactgcagtggcgagtggccagactgcagtggccagagagtggcc

SEQ ID NO: 719350 - DNA, 144 bp, Homo sapiens
cgatcgtgacatggtactacaattgacagtattctcgcatcataggctgctgattgttcatctgatgcacgagccgagtgatccaccgctaagagtctgtacgtgcttgtgtttggaatggctggcacggcacactagcccccc

SEQ ID NO: 719351 - DNA, 514 bp, Homo sapiens
aatatgtcgagctcatcgtagcctcaacctcctggggccagcaatcctcctaactcagccttctgcgtaggtgggaccacaactccgtggctcaagcgatccacccaccttggcctcccaaaggcctgggattacaggcttgacgcaccatgcccagccaaattgacatctttatgatataaaatcttcttaatcaagaacatggtatagctctccatttatttagggttcgtttgtctttgtttactggagacagggtcttgttctgtctctcaggctagagtgcagtggtgcgattatagctcgctgcaacctgaaactcctgggctcaagcaatgctcccacctcagcctcccgagtagctgagactacaggtgcgcgtcaccatgtgcagctaatttttgaatttttttgtagagcgggggtctccttacgttgctcatgttggccttgaactcttgggctcaagtgatcctccttcctcagcttcccaaagtgctgggattacaagtgt

SEQ ID NO: 719352 - DNA, 383 bp, Homo sapiens
  misc_feature (339)..(339): n is a, c, g, or t
  misc_feature (355)..(355): n is a, c, g, or t
  misc_feature (376)..(376): n is a, c, g, or t
taacggtcacaagaagtttttggttttgtttttgatttttaatctttttttttatagctcagatttcattcccctcctggaccaccttctgactgttccatatcccatacctttccctaacctcccatctccattaggatgtccccagtcacaagcccctgacccatcagacctccccactccctggggcctcaagtctcttgagggtcagttaggtgcatcttctctgactgagtccagacccaccagtcctctactatatatgtagtggggggcctcataatcaagctgatgcaaggctgctgggttgggtggtccagtggtttggagatatctcangaggttcaggtaagtngaaatgctgggtcctcctaanagagttg

SEQ ID NO: 719353 - DNA, 493 bp, Homo sapiens
  misc_feature (478)..(478): n is a, c, g, or t
tctcactgacttcaagaatgaagccacagaccctggtggtttatttaacaatgtgaagtagtcctgggaagttgtactttgagcaaggtccgcaagcagtattcctgcacttctccagtcatgccccagcgccaggtcggaagctgtccacatgcggggatggagcctggcgtcctgggcccacaaggacagggccctgaatatggacttagcagaacaaagttgggaaggcaactgcactcaccccttgtgcctcctgtggtacctgcccttcacggttcctggtggggacactcaggcaccagcttcatggctggactcagatgacacaacgccaggaaaaaaagtaaaagccccattaccctttccaatgcctagataaaatagatgtctaataaaaacctgctaataatcatttattgtttgtttatatacaattaaaacaaacattaaaacaatatttaaaaacactcttttntaatgagtgtgggat

SEQ ID NO: 719354 - DNA, 510 bp, Homo sapiens
  misc_feature (495)..(495): n is a, c, g, or t
agggaaggtgtgagctgccgccgagggtcccaggcggaacgcgggaagggagcaggtttatttaacaatgtgaagtagtcctgggaagttgtactttgagcaaggtccgcaagcagtattcctgcacttctccagtcatgccccagcgccaggtcggaagctgtccacatgcggggatggagcctggcgtcctgggcccacaaggacagggccctgaatatggacttagcagaacaaagttgggaaggcaactgcactcaccccttgtgcctcctgtggtacctgcccttcacggttcctggtggggacactcaggcaccagcttcatggctggactcagatgacacaacgccaggaaaaaaagtaaaagccccattaccctttccaatgcctagataaaatagatgtctaataaaaacctgctaataatcatttattgtttgtttatatacaattaaaacaaacattaaaacaatatttaaaaacactcttttntaatgagtgtgggat

SEQ ID NO: 719355 - DNA, 356 bp, Homo sapiens
cgtgactgggggtgtccaatcattgatgacaccaaaaagttgtccttcataagggttttctaaaaaaagtctgtgggggattccctcatccttaaaaaggaggaggagaaacacaagacctgtaaccatcagtggcttggggaacacgggaattctcatcagatacgtcagtataaaccagtaaaaagcgtatgtgtggaaaatacggaacgctaaatttgggcaaattgggaagcctgccagacaaaaaccgctcaagtatttattagaaaatatttaaaacatactctgggtatcactaccagtttaaagtattttggagtattctctggcaggtggtatggctatataaaaaa

SEQ ID NO: 719356 - DNA, 1149 bp, Homo sapiens
cataagactcccacgtgtgggagcgcactctagtacggtgtgatcattggcttagacttgctatcgctctacgccaacgtacagagtgcagggacataggcgggaggagtgaagattactatgattatgtgatctgttgagcttggtgtagtcaatgggcagtattcgggttataggacggacagaatgtgctgatgttacattcgaagtaagagaaaaattaaaaatactggtaataagaaagttacttatacaatactcttgacaacggtgaagacatagagtagaaggtactcaataattgacgtttgaggtacatcattgctgtagtaacaatcttggatcggaaagtgtttggagagctcataggtgccgttagggagtatcagagtcaagattgaattcattatgtgggtccactaaagattaaggggaacgatatctgatttgacatgatgggaaaacgtagtaaatttacaaatagagaaggtttacggaggaagttgccaatctttaaattattcaggagaaaatgaagcggaagcgcaaggcatgtggaatcgtagaggtattcagtacctcaaacgtataccaagttgaataccttgctacgaaatcgtggcacctggcactttgcccctgtacgtgggcggcaaatttcagacccgccgtcggctcacaccaaacattagaaagcgacatatgaacgtccctagcaatgcctcccgatggcgcaccactcctggcgtaatccaactggcgagccaccaatcctacttggcggcaatcatgtggcgaacggttctgacgaagatcttctcaggatagaccagtctgcttcccataggagcaagggttcttttaacgtcggtaggtataccccgggaaaatatcactatcgcgcgcgcaggtcaccactccgtttttcgagcaggttctccactccatattcacgcgtaaagatcgggtaaaaaaccgccccttaggcagcgtcacccatctactggcggctactcgctcaacagcaaactcttttgccgcctgtggaaaataacgtgtcgcgctcaactcaagaccatagcgtaataacccttcacaccccctcatagtgggctcacaagttctcacttcgacgggtattgcaactcc

SEQ ID NO: 719357 - DNA, 1211 bp, Homo sapiens
  misc_feature (445)..(445): n is a, c, g, or t
gacgctatgtccatcatgggctccgtggttctggcctacagtggcggtctggacacctcgtgcatcctcgtgtggcatgaagcgaagcaacggactaatgactgtcacttgccctaatctggccaagcaatgggccatgatagggataggactttcgacggaatgccacggatagaatggcatctgataggttttgggggccaacacaagggttgttcaattgaaggagtagtcagtcatgtggcagtgttgtaggatgtgagttcactctagggccgtgactctatccatgatcacagtcggcgaacatgatactgagggatccgcgtactctcactggcgacatccttcttcgttggcctagagtcccttgatattccgtccctggccacaacgatacgtgggacaatacagtccccagaaggcgtagggtggtgccgatagnttatggttgatacacacaacggcccagccacattgagtatacatggggaagcagcacttctagtggtaccggagatctgttgaacgccttgcaaaagccttggctaaacttatcgatcatgggacactcgcactctagtaattacatagggttccactttggacttccacctggggaagcgacattggcctaaggaaatttcttaaacagatcgcggggtttctcaatggtgcgcgagaaaccttgaaccgtcgcactgagcatgttaacgcaaatatgcaaaacgaactgggggaccttctcccattccctcgaggatcgaccttcccctagaagtaaactctctagtgggatggtaatggtgcgttgcaagtaagaaccccttcaaatgggccacagatacaagttcattaacggaccggggatctgagaagacaacttcccgttggtggaaggaaaaagcgacccgcataaagaaaaaccctatattaccagccccagcacgaggaggttccattcctaaccaaacatgaatgacggaacccaccaagggaaccccccaaaggagcgaataaaaggccccaccacaaaagcaagcccctcacttggaacaatattcctacaaggaagaattctcggataggtttacgaccataaaataggcggggggtccccctgtgttgtcaaaaacggtagaacgcaacaggagagactacaccggggagatgtgtggcgacaaagaccaccaaaacaaagaacaacatag

SEQ ID NO: 719358 - DNA, 444 bp, Homo sapiens
cattttattgataagcccagagaggttaagtaactcatgcaaggtcacaccgtggtgaaatcagtatttaaatacagggtagcttcactccagtgtctgaactgttaacatttatgccatgtgtaacattattttcaggaatgaaacaatgttattggttgccacttttcagagaattggcaagtgctcaggtttaatgcaggtgggcagaggcagaggtgtcactgggtgctctagcctctgtatcctgaacttccagcttcctcttactgtccatttgtgatcctgggagagagaaacactgtctcctctgtgcctgatccactcttgttcaagtgtccagcaccctttccctgaattactgcaaagacctctcaaattatctgtggtaaaggaccatttcccaccccaccccctgagtccattgtagccttatatttttat

SEQ ID NO: 719359 - DNA, 887 bp, Homo sapiens
  misc_feature (879)..(879): n is a, c, g, or t
gtgtagttgcaagaggatcagcttcgatcattgctctcaattggtttttgtcagcttcctatggccggccgtataccactcatcttcaaggctctcgtctcctttgcaaaactttttgaaccaccattgcactgcatgttcgttagcagttcctgggccaaatgcgttgatgttgcaagttgtctccactgctttatgacccatttgtgaactcgaataagaaaattactcacattgtgtttttgtgtctaacatcatttccatagtctaaaataaacataaacagcaagtaataagttattagccagaaaacataaagcgagaaatgctcattaaaatgatgtataacataaccacacttatttaagaacatattccaatatcaaacggcaaatttcaacagtgcaaaaaccacaattacgtttgcaccaaccttaatatttatttatatctgtgacttaagaatgcataagtaaaaataatagcaacaaaacatttaaaatattagtgatcatgtatttcatgtaactagtcatcaatataggacagtacaacgtggtttgcactaagcttaagatctttggaatgcttgctaaatttccaagtttacatgaatacctctactgagagtgatggatagctgccttctaataccgcacacatacttcgaacgggcttggttatcagcctatatagggaataccaaagtattgggctctcgccccatttaaccctgtttccggtcggaaaggaacaagctcgcacaccacgccgcggtccacaaagtctccgcctaaaatctcgaacgggcgtttacacatcccatctctcttctctcctttcctttcctctctcttctcagtattttctgttcatcangaaaaaaa

SEQ ID NO: 719360 - DNA, 318 bp, Homo sapiens
tttatttaaagaaaatcttcccacaaagaaaactctaaactgggcgtgttggctcactcttgtagtcccagcactttggaaggctgaggcgggtgaatcacttgggctcacaagttcgagaccagtctgggcaaaatggcaaaactctgtctctactaaaaataaaaaaagtggccaggtgccatggtgcgcacctgtggtcccagctacttgggaggctgagttgggaggctcacttgagcccaggagcagaggttgcagtaagccgagatcaccgcactgcactccagcctgggcgacagagtgagacctcatctc

SEQ ID NO: 719361 - DNA, 628 bp, Homo sapiens
  misc_feature (15)..(15): n is a, c, g, or t
  misc_feature (29)..(29): n is a, c, g, or t
cttgactccctcccnggccccctgcactnccttccccaggacctccacccaagggatgatgagatggaaacagataagcaggaggagaaagaagtccctaagtgtggatttctccctgggaatgagaaagtcctgtccctgcttgccctggttaagccagaagtctggactctcaaagagaaatgccttctggtgattacatggatcccacccctgatccccaagattgaagatggaaatgattttggggtacccatcccggagaaggtgctggagagggtgaatcccgtccagcccaaagtggaagctttcccgacaaccctttccaagttcttctcagaacgtggggatgctgtggccaaggcctcccaggagactcctgtaatggaataccgggccttggtgcatgagcgagattaggcaccctatggggagcccagggccctggtgctggacctgagggccttttatgctgagctttatcatatcatccgccgccccctggagaaaattgtccaccccaagggtgaagaaaagccctctatgttctgcacccggggctagaaggacaaatcctcctttctcttctgtgccgtcaaccccgactcaaaaccgagtattcatcaaa

SEQ ID NO: 719362 - DNA, 181 bp, Homo sapiens
gctagatttacttcagtataaattattttatgaaaacccaattttaaaagccccaggggttgattgttataaaaaaacatgctgccctttttgattgctaaagtttttgttagtactttggatgcaattaaaactatgggctatcccatgtgaaaagcttaataaattccctcttcccgta

SEQ ID NO: 719363 - DNA, 133 bp, Homo sapiens
ctctcccactggccattctaaccattttgtgcagttcggtggcattaagaatattcacgttgttttacaaccgtcaccactgtccatttcccaaatgttcttgtcttcttaaactgaagctctgtccacatta

SEQ ID NO: 719364 - DNA, 1286 bp, Homo sapiens
  misc_feature (40)..(40): n is a, c, g, or t
  misc_feature (749)..(750): n is a, c, g, or t
tggcgctcgcgatctagaactagtccggacgcgtgggtcngctgctgccatgtaagaagtgccttttgcctcctgccgtgattctgaggcctccccagccatgtggaactggctcagtgtggtcaaaagaagactatagaatcaaggatgaagagaaggaacacagaataaaaggacgtctcagcaggaagctctgtgactactatgtaattcttacaatacagcaaatgatgccatacagtgaagcaccttgaaagattgctgggataagctgacagcatggcagccaaaatagtgaccccaggcttgcgaggaattctgtgctttctggaggaaatggtcatgggtttcccaaactgccttttaaactaaggaccgagctgaagaagcccccgtcttccagcgcatgttattcccatgacagatgctaaaagttcaaggggagagctacaagaagtgcgttttcctgtggctactttcatgtctggatgcaatgcctagacctgcatccatcttgcgaccaacctgaagatgaacagaaaggaaggaaggatggcccaatagcctgggaagaactggtgttcctgataccatcattaaccacagaatctacaatcccggaaccccccatccttaaccatggaatctacaatcctatctctagaccctttgtccagatgctacagtttctttgttcaatctagttgtgtcaggattctgtcatacatcaaaagtttctatactgtagnnaagcactggagaagttttcactttgtctttaaccaaagaagacttccaggaaacatctcctcagtgggtttctccctcaccactggatttttatctctgtactagtgctttgatttgttttaggagtctcacctctccacctgtcatatttccctggcaggctcatttctgctaatgcccacaatatgtgtatcaatgagctttcaacgttaggtacacagctcttcaggcatgttatagcacattaatctgtctgcttctaagtggtctgttgacatgttttggttgccagttatatctacaaggtgtgatcattgtccctgggttattcctggttggtcctctctgcaaggatgcatttaggacaacacaaggcccatggccaatcacttttaccattctaggaattcaaatcttattttccttgtgcaattccctggaaaacctcctgttcttggaaaccccttttttttcaacaattcccactggaatgttcacttcataagccaacggtcttgcgcgttgcacaaatataa

SEQ ID NO: 719365 - DNA, 915 bp, Homo sapiens
  misc_feature (40)..(40): n is a, c, g, or t
tggcgctcgcgatctagaactagtccggacgcgtgggtcngctgctgccatgtaagaagtgccttttgcctcctgccgtgattctgaggcctccccagccatgtggaactggctcagtgtggtcaaaagaagactatagaatcaaggatgaagagaaggaacacagaataaaaggacgtctcagcaggaagctctgtgactactatgtaattcttacaatacagcaaatgatgccatacagtgaagcaccttgaaagattgctgggataagctgacagcatggcagccaaaatagtgaccccaggcttgcgaggaattctgtgctttctggaggaaatggtcatgggtttcccaaactgccttttaaactaaggaccgagctgaagaagcccccgtcttccagcgcatgttattcccatgacagatgctaaaagttcaaggggataattcaatacaagaaagaagatttgcttgggaaggtctgaatggccctagctttgtttgttaaccataacctctaccagctggaaacacaatgccccactaatactaacagtgcctgcttgtccaaacagcattctggccacttacagcaattgacacaaattctaacaggtctgttaatgtttttcagatcctaaacttgtagtagatttttatgttctctggcaatcaggttttgttcaggcggcctgcagggtgtttaatgcgtgctgggatgctaaattctcaccattcacaatagtttattctttacacaccaaatctcgagaattattcctcatttggcaaaaaccccatccaatatttccctccttatcttccggtgaaggggccaaccttctgtgtaacgccccaatattccagggaaggctggggaaacctgtccctcgattcatggccggcccccggccg

SEQ ID NO: 719366 - DNA, 219 bp, Homo sapiens
ggtactgctccggtggagcaggcggaatattataggcaagtgttggcatagagacatgatagtcggattgtgcagcagtaaagaacagaggctacgggtagaagagcaacaagaggagagtgcgggaagctagaaggcggcaggaacgtgaactgcgaagggcagtaacaaggaagaccggaggcgtctagagtagttcgtagagacggcgcaaagaag

SEQ ID NO: 719367 - DNA, 890 bp, Homo sapiens
  misc_feature (40)..(40): n is a, c, g, or t
tggcgctcgcgatctagaactagtccggacgcgtgggtcngctgctgccatgtaagaagtgccttttgcctcctgccgtgattctgaggcctccccagccatgtggaactggctcagtgtggtcaaaagaagactatagaatcaaggatgaagagaaggaacacagaataaaaggacgtctcagcaggaagctctgtgactactatgtgtctcatcttcagcacttctaaactgtgggaaactatgtgaaaacaaatggagtggccaaacacaccattcatcactgtgcttctggacagctgcaagtccatacgtgttctgatgaagtctggctctgttgcccaggctggagtgcaatggcacagtctcggctcactgcaacctctgcctcctgggttcatgcaattctcctgcctcagcttcccaagtagctgggattacagacatgcaccaccatgcccagctaatatctcgtatttttagtacaaacagggtttcactatgttagtcgggctgatcttgaactcctgacctcaagtgatccactccccgaagcctcccaaagtgctgggattacccggcgtgagccactgcgcccggcctttcagcctgattttctaatccaagaagttatatcagtcttgtctgcaggtagcgtcaaagcactctctttttaaaggtgcaggactaatccacctcggactatcgcaccagggctccgcgacgggtatttccacgttatggaataccagttatttgataaatgttaagttcatcctggttctgtcctggtcctgcgctggggacgcccatgtccacgcgcgccatccgggccgccagacactcaccaggacgaaacgggcagacgactcgcgacgccgctcgccaac

SEQ ID NO: 719368 - DNA, 87 bp, Homo sapiens
gcggccgcctactactactactgctcgaattcaagcttctaacgatgtacggggacatgctttgaaagaaaaccaggttcttcgtgc

SEQ ID NO: 719369 - DNA, 467 bp, Homo sapiens
  misc_feature (239)..(239): n is a, c, g, or t
agctgctcccagggtggcaaccgtgggcggaggctctgctgcaggatccgggaggcccagagaaggcacctgcatttcacgctgagcgcatctgaggatgcgatcaggaagcagccccggcactctctctttatggatgcccacttccagtttaaccgtggcatcccgggggcaagggcgccctccaagctgtgcttcactaattccctcagggtttggaactatttgcccagttcccncgatgggcctttaagctctcgtccttcctaacctaaggcaacttcaaccatctgataaatctaataataagttacaatcgaggccgggcacagtggtctgtaatcccagcaccgtgggaggctgaggtggaaggattgcttgagcctgggaggtggaggctgcagtgagccatgacagtgccactccactccggcctgggcaagacagcaagaccctgttttcaaaaa

SEQ ID NO: 719370 - DNA, 424 bp, Homo sapiens
ggattccagtaacctagtagtaatcagctcaacaccaccatcctctctcacctcaatttaattcttataggactaatgacctgtcacatgccatggcataattatttatttccaagctatcatcaatgattagaactaaaaaaaattgggcataaaaaaatcacaattcagcataaataacgctatctacagcttcaccactagctagcatctctaagcattgtagacttaagtactataaccttgacaatatacgaccgggtgtctagggttaagtgaaagtaatgcatatctgaaaagtgaaaagcttctaacattattgcacagacagtattacccaccccacataatgaatcgtacgatatatttaatgtacttaatacccacatgtatgacgcatgacactgggttcctgtagtacaga

SEQ ID NO: 719371 - DNA, 607 bp, Homo sapiens
  misc_feature (42)..(42): n is a, c, g, or t
tgatcatcagtgccaatgagtaagtcagtcaggcttatgcantgaggcttctataaagcccaaatgggactgactttgaatagttacagcatagctaatacctatcttgtagggtgatgttcctgtacatggtatggaagctctaagccctttccctcagaccttgccatatgcatcgcttcatctataacctctgtaacagcctttgcagttagccagtaagtgtcctgtccagagttctatgagatgcgtagctaattagccagccgcatgcagtgagttgtgagccatagatccatacaagggtatagaacctgccaaaggaattcactctgtagactggtgaatgccacatgtgcaaaaattagaactgaggaaattatgacagtgaaagagatcagacataattgactccatcatgtatctaaccattgggctgttcttgttcaatgctgggtgtaggtcagaataaccttgggaaggaattcagtgcacggtttgactctaaagcaaaactggtaccagccctttctcggaaagacccccttcttgcttggggaccagtctgcctttgaaggactagcaaattagcttcaagattagcaat

SEQ ID NO: 719372 - DNA, 841 bp, Homo sapiens
ctcgagatcacttgagtcaggatgcagaggttgcagggagccatgtttgcaccactgcactccagcctgtgcaacagggcacaaacctttctcaaaaaatgaaaaaaaaaagagaaaatttcctctgttaaactgtctatagtttataacaatttggtaaagtgtacttttgtaaactaagatggaaagatttgctttttctttctgctcgattcctccagaatttggaaactatttgggaaatattcttacggcagtatggttatttacacaggtccagtaaaaacctgctcttggtgtctcattcaactccaacatggcaaaaatctccagccctacagagagtccgattgctgttttccagaaatagactggaaaggatggttacgatagcattcactccaagatggagttcccaagcttcatgaatacagaactggatgccttcacgaagaaccagaaggccccagtgtccttgaccacatgatgaagaaactggacctcactagtgatgggcagctagatttccaagaatttctgcatctgatggatggcatgactgtggcttaccatgactcttttctcaaggctgcccattccaagaagcagatctgaggatcccctgggcctggtttccaagccaccccctttccttccaacctcaccattcaccatctgctcacagcccacacataccctggggccagcacacctaccacctcatgcaggccctgcttgcaggtagtaataaaaccattcttcctgactgcagttttccactccctctcccccttctcctcctcccccgcccttcctctgcccttgtcttctcctcccctcc

SEQ ID NO: 719373 - DNA, 446 bp, Homo sapiens
taccggagctttatattgagtggccatgtgacccagctccattaccaggaatatacccaagagcacagaaaacacatgtctatacaaaaacatgtacaagaatgtccacaggtgcatttgaaagagccaaaaactaggaacaacccatcaactaacggataaacaaaaatggaaaactgtttgaccaggaaaggagggaggactgacgcatgctgcaggatatgccttgaccggcatcacgctggggtgaagcagccggggagcagagggacacgtgggccatgactccatttacatgacacgtgaacaggcaaatccacagaaacaaagtaatcagtggttaccagagggcagagggtggagggaatgggagggactgccagtgggtttcttttaggggtgatggaaaggttctagaattatccaactcacatggccactcaata

SEQ ID NO: 719374 - DNA, 199 bp, Homo sapiens
cgccgccgatgccgccccggctggcgcgctgcggacggtcgcggtcactctccgcggaacgccggcttgcgccgctcgaggaacgcgcgcgtgccctcgcgcatgtccgcggtcgagaacatcaggccgaattgcgcggtttcgtagccgaggccttcctcgatcgcgcattcgccgccgacgttgacgcagtcgagga

SEQ ID NO: 719375 - DNA, 108 bp, Homo sapiens
taattcctgccccgacttctagaggatcccgtctgagcagctgggaattttctgctcatagtagctgggcaaggcaatgcaccgttgacagacttcacaaagatcacc

SEQ ID NO: 719376 - DNA, 570 bp, Homo sapiens
gatgggtcagatggacgaatggatggatggatagatggatggatgaatggatggatggatagaaaatcaacaaacagaagatgatggatggatggatggatggatggatggatggctggatggatggatggatatcagttcacaccactctcaaaaggctctgcaaaccagtctataatataataattgaaggtcttctggtagaaaatgttaattttctgatttaaaatattatcttccccaacaatgcacgctctttcacctcattttcctcccaaacctccaaattatgaagcctaactgtatcaattaagaatcttctggcttgaattaacagaagagccaaccatatgcaacttaaccaaaaggggctcatcaagtaaatatcatccccgaaataatacagtctgagagaaggaggtatgagtgtctcaagaatgacagtgctctcagtcagtgtagctataaatctaggcacctgttcatagtcatacatagtggctgacatagctccgacaattatgtcctcacctgacagactccagagcaggatgaaaggatgcaaagaaa

SEQ ID NO: 719377 - DNA, 223 bp, Homo sapiens
  misc_feature (9)..(9): n is a, c, g, or t
  misc_feature (14)..(15): n is a, c, g, or t
  misc_feature (24)..(24): n is a, c, g, or t
  misc_feature (31)..(31): n is a, c, g, or t
  misc_feature (35)..(35): n is a, c, g, or t
  misc_feature (39)..(39): n is a, c, g, or t
  misc_feature (47)..(47): n is a, c, g, or t
  misc_feature (49)..(49): n is a, c, g, or t
  misc_feature (52)..(52): n is a, c, g, or t
  misc_feature (63)..(63): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(77): n is a, c, g, or t
  misc_feature (88)..(89): n is a, c, g, or t
  misc_feature (103)..(103): n is a, c, g, or t
  misc_feature (107)..(107): n is a, c, g, or t
  misc_feature (122)..(122): n is a, c, g, or t
  misc_feature (132)..(132): n is a, c, g, or t
  misc_feature (161)..(162): n is a, c, g, or t
  misc_feature (191)..(191): n is a, c, g, or t
  misc_feature (223)..(223): n is a, c, g, or t
aacacaagnccctnngttggcgcnagttacnccgngaanattgtggntnganggcttcccagnaggnagantcnaangaaaatccctnntccagtatggaccnggancctggctggtagctngaccctccgngccgctgcgagtccaaaaagtttggaggnncctggtgcccgcgctcggctaccagaaancctaccgataagcccatcgtgactcaaaactn

SEQ ID NO: 719378 - DNA, 263 bp, Homo sapiens
tgcattttcactatgtgtaacttgactacgtttagtggtacttgcgcgtactttgagctcatcaggtatgtgaagatgcggatataggctgagcaagaggtggtgaggtgatcgcggttatcgataacagacaggctctctagagggtttgaatcaccgccagtcctttgagtttaagctgtggctcgtagtgttctggcgagcagtatcgtagattaagctgttgaggtccagggctaagcatagtgtggtatctaatccca

SEQ ID NO: 719379 - DNA, 352 bp, Homo sapiens
atcaccacaatcagatgcagaacgtttccatcgctcccaaaaattcaaaaacaatctggtcaatctttagttacctaataacagataagaggggtcctgggttaattaaggtctaacgatatcctataaactacaatctagccaaaactatatgacagcttcagtctcatttcctggcaaatctttcccccccaaatggatagcatttcataaaatttataaatatttgattaataacttcttcaggaaggttttcattaatccatttaatttttgcatgggaaataataactttattttatagtgtaatttcatttgggttctaaaagtacatgatgttacatattacggg

SEQ ID NO: 719380 - DNA, 120 bp, Homo sapiens
agagacagatacgaatcgagcccggtaccgctagttgtagaagttcaatagcaatctcagaagcttacaaatagatttccatgaagatatttggtgcttcagaattaaaacagtgccctt

SEQ ID NO: 719381 - DNA, 520 bp, Homo sapiens
actgtgtctagaggatcccggcacgagcatcgtataaacacatctcgataagtgcaactactattaaaaggtgttaccacactattcacgtggatggatttcaggatggccccataaactccagtgaaatcataggcaaaaattggtatctatgatatgcatggcactaaagtaatataaaacatttggcattatacaatgacattttagatgtggttggcctttgaccaagcagcccagtccacatatccaatacatcagcaaatccggtgggctctaccttcaaaaggtcagaaatccaaccacttccctccgggctcaactacaaccccagtgattccacgtcaccatggtctttctccggggcgactctaatggtctcgctttatcgctctttcctcgttatcatatgtgctccataacacagccacagttatccctttcgaaacccaagtgtggctgacagatctctcagggtggcccctgtgaatgcctgcctgttggtgtccatgccatttgt

SEQ ID NO: 719382 - DNA, 406 bp, Homo sapiens
gcagcggggtcttcttctatcacgagttggcagctggcatgtgcggaaccgagcaagtgctgcgtccacgttgcttgttctctaagcgatgaccaagtgctccgcgccaggttgttttcttttttgtcatagttatttcctatttctcagcttgacttctgtcatgaatcagcgctctctgggaggatgcaatactctgtttgggcattaattggtagcaggttgtctcaaccaaaaagacaggaaacagcaaaagcctctctgaaattaagaggaaagttactctccccacacccatcagagtctttattggagccaccaggtgagctgtgcagcctggacaggcctgcagctataggccaccttcccagtttaggtcctcagcacaggggagcccaagtcactg

SEQ ID NO: 719383 - DNA, 149 bp, Homo sapiens
tacgggtacttgtgattactctgtaactcgagtgacaatgagctataatcttattgttgttggatcatatagtgtgaagtcccatccagacaaatacttcaaaacaatttttcatcaatacttcaaaacattttctctctagggtattg

SEQ ID NO: 719384 - DNA, 787 bp, Homo sapiens
gagcgacactgagtggttgtgtggtcgctgtctcggaaaccggtagtcgcttgcacatatggttgagcaactgactgaagagcagattgcagaattcaaagaaagcttgttatcactattgttgacaaagattggttgatggtactataacaacaaaggaatggtgcgaacttgtcaattgatgatctcttgcggcatgatattcctacaagagagcgtgagttacaggacatgattaatagaatgtagattgctgatgtgtaatgggcaacaaatttgacttcacctgaatttctgcacaatgatgggaatgagaaaaaattgaataggactacatgacatgtgaagaaagaaaagttaatgaagaagcattcctgtgttgtattgatacaggatgagcaagttggctatacttaagtgcttgcagagacttctggccatgttgaatgatcaaaaacctttgggagaacgaaagttgacctagagtgaacgaatgtgtgatcgacgtattgaatccagcgggagaggcaagaattatgtgatggtgaatggctcaaagatgagaacgtatgcacagaggtttgtgagcaaagtgattgatcaggcacatagtgtaagaacccttggttaacagagatgtgtaaagatttttcttggtagcgacaaaatttgttgtagtttgacctatttgcttagtggttatgtagacttattttggattaaaagagggctttgggtaccccgtacttgttcaaaacgcaaagttatggcgcatgcttatagtgta

SEQ ID NO: 719385 - DNA, 451 bp, Homo sapiens
gctgctgccgcttgacagatagaaattagacgcagctgacagtaagagctgtaatcgtcaggtctgaggccacaggtcacggcgttgccacagaatcaggagaggtcctgaacccaagatatgaagtgggtgaggtctctttgatgctgcagatgcacatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttgtgacagccaggaatgccaacgagatgtttaggattttctccaggtttaatgcactggttgtcaggcctcacatccgtggggccattcgcgaataccagacccagctgatccaagcgcgtgaaagatga

SEQ ID NO: 719386 - DNA, 905 bp, Homo sapiens
ggcgggcagcggtctggctggagccggcggtctcctccagctcctttctcgggtgaaacctgggtgggtgattgccgcccacccgggcccgagtctggcgcttcgttaactttgctggtaccgccatgggagaaccgtccacccagtgaaagaaattattcccaagggaaccccttattcaggaaagaaagaaatggccccaggggtttgggtcagttaccccaaggaggggaattgcttacaagcacctggggaaccttggggccaggccctgcgggcagcggctattcacgggtttccttaaaaaccttctttatcacccggcaagagggtttatgtcgcgaagcacagactttggaccggactctcatgagtgctgaggccaacctggctggactcttcctcccaacggggatgcagccgcttcaacccgaacaatctcgtggcagcctattcctgtgcaccactggttgcccattcactgaggaccaggcctgctggaaggttcccgttggggcccatgtcccccgttatgagcagctgcagaaacgagacccgggaagacaccaagaagtatcagaatgaaagttctcggaattgccccatttcctggcacctggtggcgcacggaggaccggcgttccgacccttgacacttgggagaccggtctggggaatgggtcctattgacccacctccttctggttagggcaaaccgcgccggcttggccctggcgcgcctggggctctcccccaaccttggaggttgttcacgaccgggttataggggcattccgagttgcgcgttctctttcggaatcttcccgaggggagaaaggccgcggtcccgggggggccttgctcgggtccctaggagagcttggctcattgggggcactccccgc

SEQ ID NO: 719387 - DNA, 289 bp, Homo sapiens
gaattccagcctgggaaacaagagtgaaactctgactcgaaaaataagggaaagaaagaaatagaaaatgcgaaatggtaagaaaaaacagcataataaacatttgtatggtgtcgatggacaatgcatatgaagataatatttgaaaaaatcatattacaattaatttctgttctcactcatgggagcttgatgccctgaaaacttcgtcattggaccacctctggtgctttaaaagaaaaaaaaaattcacatcctcacacaggtcaggatcagatctcagcatgga

SEQ ID NO: 719388 - DNA, 199 bp, Homo sapiens
acagtgtggggtgtgtgaggcttgggggctgcgaggctatggagctgacgtcgcgttgagacagaaatgctggccaagatgaggaccacttcattacagtggacgctgtgggttgcttcgcgggtgctgaagaagaggcagaggatgatgaggatgaagaagagatcgaggttgaggaggaactctgcaagcaggtaag

SEQ ID NO: 719389 - DNA, 488 bp, Homo sapiens
tctgacacggggaaagggacatttagcatacacggggctacaatgtaaatatttctgtggaaggagataatgaatttcgggtgacaaaatatggttccttgaccttgacatggtcttgcataacctccagggcattttttttttaagagatggaatctgacgcaatcacccgggcgggagtgcaggggcataatcatagctccatgcaacccagagcttcggggctcaagatgtttccggaatgggtaggttctgggtctcgctgacttcaagaatgaagccgcggaccctcgcagggagtgttacagttcttaaagatggtgtgtccagagttggttccttcaaatgtccagacgtgtcgggagtttcttcttgcgggggggtacggggtctcacgggcttcaggagtgaagctgcagaccttcgcagggagtgttacagctcataaacgcaggggggacccaaagagtgagcagaagcaagattta

SEQ ID NO: 719390 - DNA, 553 bp, Homo sapiens
tttcggctccattaagggttggggctcattcagggcatcatcatctaccggggcggcctacttcgggcgtgtacgatacgggccaagggcatgctccccgacccaaagaacacgcacatcggggtgagcgggatgatcgcgcagaccgtgacggccggggcgggcgtggtgtcctaccccttcgacacggtgcggcggcgcatgatgatgcagtccgggcgcaaaggagctgacatcatgtacacgggcaccgtcgacggtgggaggaagatcttcagagatgaggggggcaaggccttcttcaggggggcgtggtccaacgtccggcggggcagggggggcgccttcgggcgggtccggtacgacgagctcaagaaggtgatctaggggccgcggcctcctccacacacacacacacaccaggggaaccaagagacccacgtagaatcctcaagcgggcggaccatcaaccttcgagaaatccagtggtcttccccccagccgcatccggccggtacatggccggggacggctctacgaccgggggcgcatc

SEQ ID NO: 719391 - DNA, 677 bp, Homo sapiens
  misc_feature (190)..(190): n is a, c, g, or t
ctttttaaaatacggctgaggcgggctggccctattctttgtctgctgccggcgtttgggctacggttgttcctggcgactgtgcttcacgccttctcttcttttgtcccccccttctcctcgcctccccgccgcctgtttcccctttcccagcaatccccatttttatttggtgttgggcccccccccnccgcgccccccctcaataaacttcctccctattctctcccccctgctcacccctctatacccctttcttccctttctttctcttttccgcctcttcctttccctcctccccgtctcctctctcacctcccatcggtctctcccggtttttttttttttttcccctttttctctcccccccttttcttctcccccttccttcttcctcctcttgtttttctccccctcctctccctctcctcctctcctgtcgctttcttgtttccttttctcttctcctcctcttctcccttctcccctcccccctttcctccctcctctctccttcctcccttttcttttcttcttactctctctttttttcttaaacccttcttttctttccccctctttccattcttcctcctctcctctctcccctcccccccccctccctccctctctccctctcccctccctctcttcttccctccttcctactatcataa

SEQ ID NO: 719392 - DNA, 390 bp, Homo sapiens
  misc_feature (11)..(11): n is a, c, g, or t
  misc_feature (21)..(21): n is a, c, g, or t
  misc_feature (53)..(53): n is a, c, g, or t
  misc_feature (60)..(60): n is a, c, g, or t
  misc_feature (110)..(110): n is a, c, g, or t
  misc_feature (251)..(251): n is a, c, g, or t
ctcaacaaganactacccagnacccacggttaacagaggatggaaaacacctncacaagnctccccagagccgatcgtcctctccaccgccccaccccgtgcttcagccntgcagggagagtgatgctccaggcaacacggttctgagtcaccttctgacacgagctccctctgcttgctttccaggtcttgaaaatctgaattcacttcagtttagtttatgaattttaggtttcatgataagcctcaantgtagttggacttttattgaatccttcctaagttattgaaaaaatgtcttttcatggtgaatgacaatatttatgttgcctttagcttcttgaagatttagaagttatataaaaaattaatttaaaagcaaactaaaaa

SEQ ID NO: 719393 - DNA, 355 bp, Homo sapiens
gccaaaattcagtcactaaattttagaaagtttgcaaatgtcagactgcataagcttcaattgaaagaaaagaaacaaacagctttgccctgttccgctttgtgaataaacaagtcacattttttcttagctttttataatacagtctactgtgaagctctttaacatttgtacaaattgtatacctatgttccttaagtcatattgtaatattaacaaaataaccaatgaaagcattaaggaatgttatttaccagtagcatgagcctcacctctttttgtattcttcaagctgttaatagtatggatacaaaatcatgtttatatttcattcaaataaagctagcccccatca

SEQ ID NO: 719394 - DNA, 471 bp, Homo sapiens
  misc_feature (191)..(191): n is a, c, g, or t
  misc_feature (332)..(332): n is a, c, g, or t
tcgaataaggccgttgcctcccggtgtcatgtgcacgacacttgtgaatatagattattcagaactttcgaattagagagaattcgcgttcacagaatcgcttccagcaccatgttgacatcgtatgaaaacgaggctcagtctggcagacatgatcgtcctctccaccgccccaccccgtgcttcagccntgcagggagagtgatgctccaggcaacacggttctgagtcaccttctgacacgagctccctctgcttgctttccaggtcttgaaaatctgaattcacttcagtttagtttatgaattttaggtttcatgataagcctcaantgtagttggacttttattgaatccttcctaagttattgaaaaaatgtcttttcatggtgaatgacaatatttatgttgcctttagcttcttgaagatttagaagttatataaaaaattaatttaaaagcaaactaaaaa

SEQ ID NO: 719395 - DNA, 107 bp, Homo sapiens
gtcatctgagcatcccatttatcgtgatgcggcaatggtgccggtctattatgacctccctttaaaattctttgcgtcttgttataggtcagtttatcgtttggtcc

SEQ ID NO: 719396 - DNA, 330 bp, Homo sapiens
gtacagagctagcccaagcaatataggcacatagtgctcaaatatctgcatgaacaaaccaacctttgaagaatgctctgagcataacttctggatgaagcgaagcatacaggcccctatagaaagtcttgtacaggaagatgccaggtagtactgattaacatgttacagctcagcagaggcactgaatcaggggcatgtttcagtgtataacacaaggtgtcacttaatttacctcattttatacattaatttataaatagtagtaattcatgaatataacactttcctttgaaaagaatcattaatgttttcaaactgtcggtaaca

SEQ ID NO: 719397 - DNA, 649 bp, Homo sapiens
  misc_feature (3)..(3): n is a, c, g, or t
  misc_feature (158)..(158): n is a, c, g, or t
  misc_feature (210)..(210): n is a, c, g, or t
  misc_feature (230)..(231): n is a, c, g, or t
  misc_feature (241)..(241): n is a, c, g, or t
  misc_feature (337)..(337): n is a, c, g, or t
  misc_feature (353)..(353): n is a, c, g, or t
  misc_feature (357)..(357): n is a, c, g, or t
  misc_feature (465)..(465): n is a, c, g, or t
  misc_feature (502)..(502): n is a, c, g, or t
  misc_feature (534)..(534): n is a, c, g, or t
  misc_feature (554)..(554): n is a, c, g, or t
  misc_feature (572)..(572): n is a, c, g, or t
  misc_feature (582)..(582): n is a, c, g, or t
  misc_feature (629)..(629): n is a, c, g, or t
atnaaaacaacacatatttcatgttagttttaataagagattccctatcctctgccccagtaaaacctaaccaagccagcctgacaggttatatcaatacagggagctggagtgggagccaagggtggtgttagataggggtggggtacagatcaagnggggcctgggagactcagtgactggaagtctctgcccctcactcttggtgantagctaatttcagcagctgnncttcataagngaggagtcaggggttggttggaggctcctcccaattccagatccacttcctcttctccttctgtctcctggacacttaggtcttactgagatggtnttcccacagtaaaganaggngggggcagagtactaagggtcaggagtgtgactctttcccatgactcaggcctctgtgctagaggtgacccttataggaaggggagacccgcaaatccttgtagccantgagtggtggggtgcatcactcaccagcagatgccancttggactctggggcaggacaccatacacagngcacagcaccccattgcggntcaagccagaaggaaganaccccaccanggatgggcggatattggttgagggtgggccccatctgtcgtgggcantcttggtgagggcagggcct

SEQ ID NO: 719398 - DNA, 94 bp, Homo sapiens
  misc_feature (76)..(76): n is a, c, g, or t
gcggacccatgagagccctgagcagccccaccgccgccgccggctagttaccatcacaccccgggaggagccgcanctgccgcagccggcccca

SEQ ID NO: 719399 - DNA, 715 bp, Homo sapiens
  misc_feature (11)..(11): n is a, c, g, or t
  misc_feature (368)..(368): n is a, c, g, or t
  misc_feature (529)..(529): n is a, c, g, or t
tagcctcccgnaactgggataagccttcgataagaaattgtcccttgaagcttgtatctgatatccgcactggattgtagaacttgttgctgattttgaccctgtattgaagttaactgttccccctggtatcttgtttaataccccggacaaatctttgagtgtccacccgttagtacgctgtggctctggtcaccttcgtggcctataggttaagacgcgtgccttgttggagagacccaagtctcgtggctctggtggagctctcgtgtgtgcccacgccacgcccttctgaattctgttgccacgcggtattttacgctgctccggggctgacagtgtttctgggaattttcttctatgaaggnctcgtgccacgagaccacgcttgtgtgttgtgcttgcgcggtctcgtcacgggttggaaagtcccagcccgctatggagccccgtttcctcttcttagcctgatgtcctttggccccgaacccccgctgggctgcttaccttgctttgaggttggagagcnggtttgcactttacgcctcgtataatagtattcacttcttaaattatgtaaggttttttttgtacgccattttcgattctttgaagagatgaccaccaattttggttttctactgttatgtgagaaccttaggcccccgccacccgtccttgtgtaaggaaaaataaaagtgctgccgtaacccca

SEQ ID NO: 719400 - DNA, 88 bp, Homo sapiens
gtgtggtggtatcggaagggccgcgttggaggccgctggaagtgaggatgccgtgccggacagtggcacctgggaagcctgggagtgt

SEQ ID NO: 719401 - DNA, 145 bp, Homo sapiens
gcggggacgagcctggagcatggggccagtgcatccccaagcaagcaagcaagcaagcaagcaacagccaacaagcaggtcagcaattggtttcctgcagtcagtgcacagcacccacttgacaagctcggcaggcagcaaactc

SEQ ID NO: 719402 - DNA, 1512 bp, Homo sapiens
  misc_feature (1305)..(1305): n is a, c, g, or t
  misc_feature (1308)..(1308): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaacccccttaaacttcaccngcncagtcattctcataatcgcccacggacttacatcctcattactattctgcctagcaaactcaaactacgaacgcactcacaatcacatcataatccttttttaaagactttctttaactcccactgattacctttgttgaacactttctacccctttctttaactttacccttaacctccaactatgaaccctaactggcatct

SEQ ID NO: 719403 - DNA, 163 bp, Homo sapiens
cctcacgtctgtatcctacactttggagacacagcatgacacgcgccctgcaataattaacaacattttcgtttccaaaaccttatttaagtggcagaagcaggaagcagccatcaagagaagggcagaagcaggaagcaggctttggtgagcggcagaagca

SEQ ID NO: 719404 - DNA, 228 bp, Homo sapiens
tattaaaaaaaaaagtttttatttttttggtttttaaaaaaagggaaaaaaaaaaaagggaaaaatggggggggaattgggtgttttttcggggtgtaaaatatgaaggaggtttttgtcgagacgatcgcactggcggggtgttgttatacatatgggaagtacataataataccaagaagaaacatataaacaaacaaaaataaaaaaaacaaaaagaggaggcgg

SEQ ID NO: 719405 - DNA, 1781 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaacccccctggaaaggcttttcacccggggcggccaaggtcatttctcaattaaattcggcccaagcggggctttaacaattccttcaatttaacctatactctggcctaagcaaaactccaaacccttaacgaaaacgccaccctcaccaggtccggcaatcattaaatcccttcttcttcaaatgggagctttccaaaaagttctaacgtaccccaactaattaaggctttctttggaagggaacttcctaaggacaaaggccttcggcttaaaaccttcggcccttataacccccccccaacttatttaaaaccctagctgtggcggacggaacactctacttgtagcctaagtaaaacccaccgtctctccttgaatccaagattaatacaaatacctcctaactttaaccagggacgctccaaaccatacctaagtcaacaaggcccctaatacttcccctcctaccattatttaaccaacaacaacaatg

SEQ ID NO: 719406 - DNA, 626 bp, Homo sapiens
tggaccgggtgtggtcgctgatgaggttcctcatcaagggaagtgtggttggtgggcagcgtctatctggtgtacgaccaggagcatgctgttgggcccagcgagaagagaccaggcagccctacagaaggctggggaggtggtccccgcccgcacatgtaccagttcagccagatacgtgtgtcagcagactaggcctgcgagataccccaggtacgtacgggccgggaacgaggccacggagtttggcgtggatggtcagcgtctggagaggtccctcgcagtccctgtccacgattgttgtccgtccattattgagtgctgaccgtgagttctccggacctgtccatcctccctccgtcatctgagggatggtgctgtcctgagtcgctttgcaccagttctttctagcctcactcttctttttcaccaggtccctagacctcctccaaagattgactttccacatccgtgactcctggtaatgcaggtaaggcactccaggtatctttgcttggagggagacaaccccaggtcgtagcccctcgtccccagcttccatgggcacttaccgtttctgtccactcgcatccgttcctgcctcgactaggtgtctcttagaggat

SEQ ID NO: 719407 - DNA, 1881 bp, Homo sapiens
  misc_feature (1783)..(1783): n is a, c, g, or t
  misc_feature (1789)..(1789): n is a, c, g, or t
  misc_feature (1791)..(1791): n is a, c, g, or t
  misc_feature (1793)..(1795): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcgtcattctcataactcggcccagggacttacgatccgtcattactatgtcgtgccatagacaaagcgtcaaactacggaaccgccagcgtcacagctgcgcaatcataaatccctctctcaagggacttcaaagctcgtagtcccacataataggctttttgatgacttctaggcaaggcctcgctaaacgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719408 - DNA, 1802 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacgaggccgattcttcatccagaatcccccgtgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcattctccaccccttgacaaaacacatagcctaccccttgcttgatctatccctatgacgcataattgttacaagatacatctgtctacgacaatacagacctaatatcgctcattgcatactcttcaatcagccacatagaccttgatgtaacagccattctcattcaaacccgctgaagctttaccggtgcagtcattattatacatcgtccacagacttacatcctgattactattatgactagcagactcaaactacgaacgcactcacagtctcatgataatacactctcaatgactctaaactctactgccacttataactttt

SEQ ID NO: 719409 - DNA, 1854 bp, Homo sapiens
  misc_feature (1756)..(1756): n is a, c, g, or t
  misc_feature (1762)..(1762): n is a, c, g, or t
  misc_feature (1764)..(1764): n is a, c, g, or t
  misc_feature (1766)..(1768): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccaggatagccctcgtagtaacagccattctcatccaaagccccctgaagctggagcggcgcagtcatgcgattctcataatcgcccacggacttacatcctcattactattctgcctagcaaactcaaactacgaacgcactcacagtcgcatcataatcctctctcaaggacttcaaactctactcccactaatagcttttgatgacttctagcaaggcttgctagctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719410 - DNA, 1223 bp, Homo sapiens
  misc_feature (346)..(346): n is a, c, g, or t
ggcggacggaccggttacgcggctggtcgtgcgctattgctggtacctgcatgaaatagcgacgagcagcttcgacgctcagtgggactggcgtgcacgtgccctgcctcatagattgctcctccaggctagaaggtctaggggctgagccaattgtagtgcttggccgtcgaatatcctcatgtaatagagggctttgctcgcccacggtgtttgtacaacagtccctagtggcatgccgacaagaggtgcaagcacatgggttgggacgctctcacagttgccgttggctagattgcgtagaggaggtctagctagagcaatttagtactaggggagccatggntcttagcagacgttcatcgtcaggcgcaacgttactccaatcccagactctagtggtgggtggaaggcgctttgatgtcctgtggatgcctccgagcatcgtagtcgaccagatcgtgccttccgtgtgatctatggaacctcaagaaaacgggacgagttacttggtggccataggggcttgcttctgcttctttgcgcgttcggtcgtgtgggcttgacgggccctggaggtgcgccttgccattgcgctagccttttcgttcgttccacctcgttcgtcgtagcgtcgcgcttgttgtaaccttttgtacgcgtaccactcgcctgtctgcgcaggtggcccgtccgcgacacttggtcgtcgcgatcgcccatggggtcgaggttcgcgctcgttggagtacgcgtcactctccgattcgcgaatggtggcaatgggcaaagtcgcgaaaatcggtcatctctagctatagctgtggggccatagctagcgaaggggcccccaggggcattgctttctgaaagcccactcctaacaaaggtacgttctacggcctgggccttggttacactagggcagggtgccatgctccccctttggggtcgcgtcgggacacttcctttactggacgtatttgctcaagcgtttctgacgggaacccatggcgccgggacggaagttctccccggcctgtaacttgggggcattgggggggatggcccttttaagtgttgggattccttcccctttccttccgtcatggtctggaagtccgggccgcgttcgagttcggccccgggtggcgcagtgtctgtggccgtcgcttttccttacccttgggacacgatgtgcggataactacccgtgcgccccg

SEQ ID NO: 719411 - DNA, 1068 bp, Homo sapiens
tgttttcttgtgtttcttttgtctttttatttgggcttttttgttgtctgtttcttattttgtttttgttttatgtctttcttttggtgtttttgacctacctttgttctcttgcccctcttgtatttgtgtgttctccatcttttccctcctgtgtcccctgtccatgctctatgctgacctccgcttgttggctgtctactgggtccccttcccacgtctccatttctttatgccttggctttgcccctctcaccagtccgtggtagtccagcagtatcgagctctcactgtgccggtactcacccagcaggtcttcgatgcctagtacttgatggctgcctgtgacccccgccacggccgatacctctccgtggctgctgtcttccgtggtcggatgtccatgaaggtaggtcgtatgtagcagatgcttttacgtgcagttacttagttactagcatgcttacttttgtggtaatggtatcctcctatactatattgttctatagtactagtccgttcttgtgttactatccctctaccttcgttggtcctctatagtatggactagtctacctttcatatggacatatgagtctacttgccattctcaggtatgctctttcaatgctgcatttctcgtgatgcagttgtcatctgcctattgtttcctgctctggataaggcctcttgccttcgcaacgtgtgtaactacacacaggacagacagggctattgagatcgagtaatggacgcttcaaccagaagagacctgaagagccaaacaatgaacagaacctcagctcatcatagaagataatcaagacaagtacacaaggaatgccaacctgcaagaaagaaggaagagaagagaatatatcaggatgagggaaggacacgaaagaagagaaggcactaaaggcagagtccacccaatcaaccatcaaggcattaatcagttaccttagaccgtcatacatcaactgcccctttcctcatcccatcaagaaattatgtgtttgctagccatcatagtcattgttttttgtctttttacctacggggggg

SEQ ID NO: 719412 - DNA, 1412 bp, Homo sapiens
  misc_feature (1273)..(1273): n is a, c, g, or t
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccttgacggtgccatggaatttgncatgggtggaatcatattggaacatgtaaaccatgtagttgaggtcaatgaaggggtcacttgatggcaacaatatccactttaccagagttaaaagtagccctggtgaccagcgcccaatacagacccatccgtaccg

SEQ ID NO: 719413 - DNA, 255 bp, Homo sapiens
  misc_feature (56)..(56): n is a, c, g, or t
ctagctgctctaacccttacggtgacgactgcgtaggacgggggcgggacgtggcngcgggaactctagacacggaaatgtgtagtccggggataccgggacacttactcttacgcggggggacagactggatgagtggggtaccttatcgtcgtggtacgggcggaatatggaagtggtattacgtcaggtgcgggagggatctgaggaaacaggacctgatacgcggtctggtgtttcggtgggagttgagta

SEQ ID NO: 719414 - DNA, 573 bp, Homo sapiens
tatgacacatctgtgagatgtcaatgccattcactctactctagattttctattacataaagaaaaaaacaagtgagaatctctggagtctcataaatttcctgtattctgtgtttctaaaagtgaaacaaatatctaaatttctgtaaacttattaaacactgaaaaaatagctgactttgtttaaagaaaaaagccatgcctcatgttaaatcatatgctattttttaaacttagagaaaaacaacgttattacttttactcaagttaagtacagttaaaaatactaacctttcaataactgaggtgatttaaagagagaaagaatgaactctagcaaatcagaaagatggccagcttgacttatttcacaagaactgcatctaataattttttaacagaaagcactcgctaaaactgacgccagttaaggctcagcaaaaaatgtattattaagttggcctgcttatatcctattacagactgcttatgaatacttgattctattttatacaactgacaagagtcaacaggcttaatgacaattaagatcaactcgtgtatgtgtcacat

SEQ ID NO: 719415 - DNA, 1206 bp, Homo sapiens
ctttccagagtaggtagagggatgatgctaataagtaggctgtgggtggttgtgatgaccccaattatgtgttttttggaaagcatgcccctcatttacataaatattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccgcaacacatactaccctctgtctatcctatagcatataacacctcataccaactctcatatcctctagacaccaca

SEQ ID NO: 719416 - DNA, 359 bp, Homo sapiens
  misc_feature (98)..(98): n is a, c, g, or t
  misc_feature (111)..(111): n is a, c, g, or t
  misc_feature (133)..(133): n is a, c, g, or t
  misc_feature (145)..(145): n is a, c, g, or t
  misc_feature (147)..(147): n is a, c, g, or t
  misc_feature (168)..(168): n is a, c, g, or t
  misc_feature (297)..(297): n is a, c, g, or t
tgaaccctgacctttggctgccttggccagagtaccaaaaatgagtgacccagacctctgaccttgacccctgatttctttcatccccagtccagggnctgggctccccanatggaggcagtcagcctcccanccaggccctaananccaaaccatgggctggtcccncttggacctgtggccaggaccacctcagcccctgggcctgcactgcctgcaggtgtggcccccttggcctggacctggggcctgaattgtgggaagggtggtttctttctttccttttttttcttttcntttttttttttttttttgtgcttcggagacatcagaattaataacactatttttgattttga

SEQ ID NO: 719417 - DNA, 1790 bp, Homo sapiens
  misc_feature (1692)..(1692): n is a, c, g, or t
  misc_feature (1698)..(1698): n is a, c, g, or t
  misc_feature (1700)..(1700): n is a, c, g, or t
  misc_feature (1702)..(1704): n is a, c, g, or t
accgccgacaccccccaaacttacggctaggtagcgaggcctcggtggttgattatactagcatttaccatctcacttctaggaatactagtatatcgctcacacctcatatcctccctactatgcctagaaggaataatactatcgctgttcattatagctactctcataaccctcaacacccactccctcttagccaatattgtgcctattgccatactagtctttgccgcctgcgaagcagcggtgggcctagccctactagtctcaatctccaacacatatggcctagactacgtacataacctaaacctactccaatgctaaaactaatcgtcccaacaattatattactaccactgacatgactttccaaaaaacacataatttgaatcaacacaaccacccacagcctaattattagcatcatccctctactattttttaaccaaatcaacaacaacctatttagctgttccccaaccttttcctccgaccccctaacaacccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719418 - DNA, 255 bp, Homo sapiens
gcgtatgttacaggcacactggcatgaactggtaggtccagatgacagtgacccagctgctataactgttagcagtaccttgaagccttagtcttaggaaaaccccctaacctctacttctatttactgttggtggggctacacatacagggagagtagaccacaggccagagtccatccattccactcacattccacagaagggtcattgtttcttttccttggaccattttcttcagcccaggttagaccttg

SEQ ID NO: 719419 - DNA, 1423 bp, Homo sapiens
  misc_feature (1325)..(1325): n is a, c, g, or t
  misc_feature (1331)..(1331): n is a, c, g, or t
  misc_feature (1333)..(1333): n is a, c, g, or t
  misc_feature (1335)..(1337): n is a, c, g, or t
gtcggaccccacacacctgagtccccctaagtgtggcagcactctagtatttgttgaacacatgaatggattaccagcctcaggggtaccacaataaattcttcagactgtgttattcctttgacctttaactttcctaaaccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719420 - DNA, 815 bp, Homo sapiens
cgagacgttgtctctacaaaaaattttttaaattggccaggcgtggtggcctgcacctgctagtcctaactacttatgaggctgaggcggaggatcacttgagcccaagaagttcagggctgcagtgaactatgattatgccactgcactccaccctcggtgatagggcgagaccctgtctctaaaaataatagtaataataataaaccttatatttgacatttgctaagagagtagatcttaaggattctcattacaaaggaaaggaaagggtaccaggtaaggtgataactctgttaattagcttgatcataccaatcatttcacaatggtatacatatatcaaatcatcatgttatataccctgagtatatacaatttttatttgtcaagttataccgcaataaagctgaaaaaatattaaaggacatccttcaggtcgaaagaaaatgaggtattaagagttattaaaatggcacagcaacagcaaatgaagcaacgctggaaatggtaaatatgtgattaaaatatcacagaatatatatatattcatgctttgacaaatgttaaatcgcttcaaggaaataatggcaacaccattagtttataaacttagagttgataatatcgctgagatcttaaaaaatttataacaagcgcaaaacataaattatgatatgtaacatataattggtgtaaaaaaagacgcacaagtctctggcagggtgataagagtggctaattagtgcaatgcatatttataagggtaatagggagagggaagagggggagagaaagaaagagagaaaggaaca

SEQ ID NO: 719421 - DNA, 1351 bp, Homo sapiens
  misc_feature (1253)..(1253): n is a, c, g, or t
  misc_feature (1259)..(1259): n is a, c, g, or t
  misc_feature (1261)..(1261): n is a, c, g, or t
  misc_feature (1263)..(1265): n is a, c, g, or t
gagtccgagcccgattacgtactccttattatgctgttccccggtgttatattgtgatccgcaaaaaaaccccctcctaatactaactacctgactcctacccctcacaatcatggcaagccaacgccacttatccagtgaaccactatcacgaaaaaaactctacctctctatactaatctccctacaaatctccttaattataacattcacagccacagaactaatcatattttatatcttcttcgaaaccacacttatccccaccttggctatcatcacccgatgaggcaaccagccagaacgcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719422 - DNA, 288 bp, Homo sapiens
caggcaccaggctggcagctgcggttcatcgaagagtcgcgcctgcgtgagcagcatgaaggcgttgtcggctcgcaggttcttcttcaggggccattcaacgcctcccgggccattcaacgcctccgggccattcaacgccctccgggcattcaacgcctccggggccattcaacgcctccgggaccattcaacggctccggaaggcgttaaatggccatccccttattagcgggcgcagtgattataggcttacggtctaagattaaaaatggcctataccaattt

SEQ ID NO: 719423 - DNA, 933 bp, Homo sapiens
  misc_feature (512)..(512): n is a, c, g, or t
  misc_feature (522)..(522): n is a, c, g, or t
  misc_feature (529)..(529): n is a, c, g, or t
  misc_feature (545)..(545): n is a, c, g, or t
  misc_feature (562)..(562): n is a, c, g, or t
  misc_feature (644)..(644): n is a, c, g, or t
  misc_feature (693)..(693): n is a, c, g, or t
  misc_feature (702)..(702): n is a, c, g, or t
agaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaacaccatcctcacagtccccggcccaggggctaatccctgcggaaggagcgtgaagagagtgcgcgggtgtcgccatcttgtggcccgtggtagtgtgttataagtggggtgagtggcctgcacaaatttcagcgatggcctagcaatntggtgctgcnttttacntgaaggcttatcaagntggtttaacgtacttcntgttgcttgtgttccttgtcatgagttgcctccatgaattagcgtgactttgcttgttcttaactaaaggctggcattgacncagttaacgcaggctgtcctttataaatgcatttgtcagccatgctggncgtatcttnggaatggcaacagcgaattttcattcggtcattatgcgtgaaaattgttctatgctggatatttgcacttacttgctggcttattcatgtatgtcgctctggttgatatggtacctgaaatgctgcacaatgatgctagtgaccatggattgtagccgctgggggtattccttttacagatgctgggatgcttagggtttggaattatgttacttatttccatattcgaac

SEQ ID NO: 719424 - DNA, 386 bp, Homo sapiens
tgagcccttcacagtgttaagggttttagaaacccttagtgcttacaaaatacacacttctctccccatttgtgcgtgacatcggtctctatagaagagggaagaatgtcatagacacaggtctggtattcaacacagcgcaagtcctttaatctgtcgcctcagttcttcatctctaaatatgggacctgttacctgcctccagatttcctcatagggccgtgtcagaattaatctcaacgcaaaacacataagtgcctatataaattctaaacgcacccgtctgtgagtataaagaattaattttaacatatatatatatatatatatatatttttgtgacacggaatctcactcgtggtgcataggctcgggcgcaatggtgc

SEQ ID NO: 719425 - DNA, 154 bp, Homo sapiens
ctgagtacactttgctgtagtttaatgtttcactgtaacatatgcttctgtcacccacatatgtcacagtgaaacattaaaactacagcaaagtgaaacgcggtctgatgcacctgccacctcccagcctccatacccgtcccccccccgcact

SEQ ID NO: 719426 - DNA, 1287 bp, Homo sapiens
gcagccgtggctgagtccagaactactgagacaggatttacatagggtactaaatgtagaagtacagatatttacagtagtaagggattacagcatgtagaatatagccagtgggcaggtagcctttccaggacatgccatacgaactacagcatgctgaatacagcaaactgacaaggtacctcctatataagcccattagcgatatacacgctaatttatccactcaactcagaactaccagaatgaacaacatatcccaagtcaggtgtacacctctagggaattgcgaagacaacgactgctagcatatgcctcatccaccatgcgcaaactcaccaccagtaccactagcttgacccgcacttacacaacacacatccctcaaacaacccactccctctccctgaccttactatcaccctcgcgtaccagccatcccgatcatgccaaacccacgcaactccctgcacgacaaacggccccatccacccacacacacgcaataatcaggccccaccaggccacacccctcaacaccacaataaaaacgcaacgacaagcccaccgcagaacaaaacacacacccctaccatgactacgacacaacccatacccttacatcaacccacagaccacatacaccaacatccctctacccccaaacaaaaataatatcacacctacagccaccacttcaaccccaaaaaaaacttatacaaatcaccccaaaacacccaccaaaaaaaacactcactatcccactacgacacccttctctcacacaccactcaaccaacaccacagcacacaaagctgcactactcatacacttagcaaaacctgtaaatagcccagaccgacaacaaaccagtacaagtcaataacacaacaacacaacactcaccacacaccccataccacgacacacaaaccgacacacgcagacccagcacaacatccacaacaaaaccacaaccgaccccagcaacaccaaacgcacaccccctcctaaccactaccacctaaccacatcaccacactactccctcacacacaacacacccacactctcccacccccctcacgaccaccaccgcaacccctcaaacacgaccaccaccaccactcacacccacacaaccatccccacctacactcacccacaatcacacacaaacccacacacacacactacctccccccccacacctcacctcacaacccccgcccccacacaaaatctccaaccaccgcaccactcagctcacgctaccaaacacaccc

SEQ ID NO: 719427 - DNA, 1270 bp, Homo sapiens
agcgggagaggcggggcggtgcccccaccgaggcccgggcgccctctgcaggccacaggcagcgactcaccagttgcctacatctttcctctcctccctcttggggcttacctcaggccacatttactgtgtgtctgggcagtctctcaggctccgactcccgtccctttcttcccacttccagtgcgggacgtgtgagtgtcttcgcgggaaaactgccaataaagtagtacttcttctcgctcccaagatccccgactccccttaaggcaccgcgagatctgacggcgcggctaccatggcggcggcatttgaagcctcgggagccttacgcagcagtggcgatgctatgccggatgagcatgtgtgcgtgcaggtcccgtgcccagaagcaacaacccgggcctgtgaggatcctgcggaaccgctcaggatctcagcaggaccccgaggacccgcaccggggcgatgtgctgtctggcggagccgggacgacttcgagatcactgcctgcttacgcggcaggtgctggaggggactgcagggcggcacggctctcgaagaggaccatcgaccggtgcaagctccacggacaatgccgctggggggcgcagagcaggctcgacatagtagctccaagctagatctggcaccgggacaacacttgtagagtacatacaacacaaagctttggactctagtagaacaagacaacttaaaggtacgccagacacctaggaatccttgcggagccctaacaacgacagcaacacttgtgaggcgacccagacatacattacctggtacataaccaagcccaagttgggagtcaacaacgatgggccagcggtacacaaacggcaacgagcagcaacaatgcgaaaggcgacaacccaaaaaacaaacagagacacaacaccacagaaccaagacaggggacacaacggagcacagaaccgaccccgcggccaccaaaataccacaccaaccaccaacacaaaccggacgacatacggcagaacccacaagggcgcaagagaaaagcagccacccgcagaccgacgcacagcaacaccccaacgcgtggacgcaaaccacgagagcccccgaagacccaccacaacagagtcagcaacacacgacacatgccatcaccgccaaccacaagcaggatagaaacaccacccacgcgcagacgaaaggcggtacgcgcagacgagagagacacacaccagacatgacaacaatcacccctcccacagaacgacag

SEQ ID NO: 719428 - DNA, 883 bp, Homo sapiens
gtccacctctgggggcctcacttagggcggcttctctggttggctccccggggtgctcgtccacgacacaccttccgctggatgctcgcatgttgaagggctttcataggtgagcatagcctttgcagtgggcgctgtgaatgcccgtggtctcttccgggtctccgccgcggcgtccctgttgcctgatcagcagggtgaaggctctttgccggtctgtgccctcccacgttccagggcacgcctgtcctccccgcaaccggggggttttcctttctccccctcaggcgcccatcttgtcgtcggcgatcccctagcgccgcctactcccccccggtttcggtgaacaggcgcttgttcctctgcccccagcgggtgcccccctttcgctcccactgaatggggaggatttcttacccggattctagggcccccagagggccctctcacagacatctgtgcccacagggggcagtgtcttctcttaaagaagaactgtccgataccacaagttcgttggacaaaaagtctccgcgccttatgttcccacctccatgcgcacaccccagagcagtctctcgcggcggccgcccctttctatacacgaggagctggatcgcttccccctcccgccggtgagagcacaatttgtgccgcacgatgctttgtccccgcgaatatgtttcgcgccacagaacccgcacttgtttcttggtgacatacaggggagcgctccacccctctatcgttcgcgtctggatcttatcatacgggatagctgcactgcagagcaagatatggagagcgggcggacgcagagggaaagttcggggggcccaaaaacaacccggcaaacaccccatcttgataacagcccacatgc

SEQ ID NO: 719429 - DNA, 113 bp, Homo sapiens
  misc_feature (56)..(56): n is a, c, g, or t
attgaaagattgatgagtgtgactttgactgttaagtggttgcagctgaccatgtntgcataggcaggactcggtccccttgcgtgtcccctccctctcgtcggcattcaagc

SEQ ID NO: 719430 - DNA, 744 bp, Homo sapiens
agtgcttggacggaacccggcgctcgttccccaccccgggcggacgccatagccagacctccgatcacctcttcaccgcaccctcggaatgacccaaggaccaccgacgaagctccagcgccaagcagacaccagcagcgcgccgccatcatccattagagcgccgcaacattgacagagcgccgatccaccatcagcaggtgcgaccagaagctacacaccaaggacatcagagagcacgaacatcacaccgacagactcaaaactaggagcatctcacgccatcctacggtagtaccagataccatgtcgttacatacatttgaacagcagatgatgtggcttagaagaactttgcacaaattactaatactatcaccaactctcacatgaagagagggaacatgctgacgacaactgactgaccctgcagaaccaaagaggtggacgaatctctccttcaggatatcaagaaaccagactgtgatgactggcgagagcgggctgacatgcaatggacttgtgccataacaatttggacaaacaaacatgtgaaatacagacaactacatggaaactgacacaacacagcgcactgacaacaaatgaacaccataagagtgactaacatatgagaaaacataacctgaatgagaaaggatgaaaaccatcaaagaatagcagagaccacgatgaacacacgttgcgccagaaggaacacgacaaacatacatggggaaaaca

SEQ ID NO: 719431 - DNA, 102 bp, Homo sapiens
tctgggacagcttagagcattagggagctgctaaagagaagagggctgaatagcaagcaagagttacgtgtgctcagagggaggaggaagcctcccaggtgg

SEQ ID NO: 719432 - DNA, 278 bp, Homo sapiens
  misc_feature (18)..(18): n is a, c, g, or t
  misc_feature (63)..(63): n is a, c, g, or t
  misc_feature (69)..(69): n is a, c, g, or t
  misc_feature (71)..(72): n is a, c, g, or t
  misc_feature (79)..(79): n is a, c, g, or t
  misc_feature (83)..(83): n is a, c, g, or t
  misc_feature (91)..(91): n is a, c, g, or t
  misc_feature (118)..(118): n is a, c, g, or t
  misc_feature (146)..(146): n is a, c, g, or t
  misc_feature (183)..(183): n is a, c, g, or t
  misc_feature (210)..(210): n is a, c, g, or t
  misc_feature (218)..(218): n is a, c, g, or t
  misc_feature (224)..(224): n is a, c, g, or t
  misc_feature (257)..(258): n is a, c, g, or t
  misc_feature (264)..(264): n is a, c, g, or t
gcggctcggagggcgggngcccgcgcgggtccccggtgcgctgcgggcaggcggtgaggctcncgcatntnnttacggngcanagaacctncacacgaaccacttcccgtcgccgatntccaacaaccaggaggtgagttcctttngggaagacggcgagggcgacgacctggacctatgganagtagcagctgctctggacagcactgnggagcgtnaggctnctgtgcgcttccagcatgatgggcacgtctgannttcctntcagtcacgggtga

SEQ ID NO: 719433 - DNA, 318 bp, Homo sapiens
tcccttcgctgatttgaagcagagtatacaactgcggcacgggagaccaggtgctgggaatggggctctcctgggaaccaaacaatgctggttctgcaatccgcttgcgtctagactactctccagaagaggataaaacatggccttgagcaactgcctagaagaggcaatctccatacggctgcgttgctgcactctggcatcgcagtgactcgcagcaagtccttatctcttgcacacgctcttcccgggaggaggaggtcgtgcacaccaatttgacgctcgagctgctacccccgcctgcgaccctgtcagggc

SEQ ID NO: 719434 - DNA, 598 bp, Homo sapiens
  misc_feature (162)..(162): n is a, c, g, or t
tagattcctgtaaaaagttaggtccttggattatggacctaagaagaacctgtgaatacctttcctataggtaaaggcttgattagcaggtccgcgatacagttatctaggccttaaccggcaggaccaaatgttcatggacacggttatcttaaaaaactnggttcatcaactctcagccgtcatccggtcaagggtatattgaggatctcatcagacttgattcgaaaaaaaatctggtttgaaccaataggtcctctctcagacaaggcatctatgtttgaaacgttaaaggtctcgtacccctgtggaaccttcccaagggtttatcgcgtggccactttattcttacaagggtctaaacgtgttcgcattgtcctcaatagagaatgctgttaacccccagactttcctttgacccaaattttctggacctttcatgccaaagtgaacttttgtaaaaagaatttaaaatgcttcatttttaaaaaagggtgtttaaaaacagggctggaattcttatgcccatttattaacccttcaagtttttttgacggcgtggacccaataaaatttggcattttgatagaaaacaaca

SEQ ID NO: 719435 - DNA, 683 bp, Homo sapiens
tgtacatggcatagctgttcctatgatgtacctagtatccgcaatccagtcagcgacgttagtaccatgctcgtgggttgggatgggtgtgtgtgtcctcacacaaccagctgaggtctagcactgagctgggttggcttgcctttggtccctttactcctctgactggaaatgcaggagactctggacagattcctctctgccaagtctgctaagcccagaacatgagtaaccacactgggacactgccacctggggcctcaagtccttctccacaaacttgcttcccatggtcagcattgccactgcctgaacacctccaacagggtccctggtgtcactccaaacacatcgctctctcacaaccccatgcaatgattcattcctggggtcctttcggtcttccatctaaacaccaccataggatgcttcctccacaccatactgaactgtcactcggttatcagtcactactgcagacattgggagagaagatgaagaactgagaatgtccagcgtgaccatcgcgcgtctctgtacccatggcttttgcctcccaagccctgtagcaggtgcacttagtcccaactgctcctccccagcgctgtgtaaaatcgatgactgacaatgagtactaatcccctagagtgtcctttctcgcactgtacttgacaattattctg

SEQ ID NO: 719436 - DNA, 84 bp, Homo sapiens
gcctgcgccgaccaccccttccttttcttcatccagcacagcaagaccaacgggattctcttctgcggccgccaccgcgtcgga

SEQ ID NO: 719437 - DNA, 317 bp, Homo sapiens
  misc_feature (7)..(7): n is a, c, g, or t
gtttttngttgtttgctttaggtttttgaaacagccccggaaacgcctttattggttttgggccttggcaacggccgttgtcatggttactggcccctaggcgccaatggcaaaggccgcgcctcccccccgggcggggtcgttggttggccgggcccaggggcggggggacgcggaggccgggcatcctttcccagctccccaccctccttgcctttgggggggcgacaaacaatcgctccggggtcagggggggggggtttttcccttcattccatgggcctttttttgggcacaataaagcgtttaaaccttta

SEQ ID NO: 719438 - DNA, 156 bp, Homo sapiens
ctgacggtggtacagggggacatgaacaaacctcctgtaattaatcagctttcagtttctccccctagtcactccttcaaaaacataggaggatcctccccttctttctgctcacgggcttatctaggctatcccagggcccaggggccgagagta

SEQ ID NO: 719439 - DNA, 279 bp, Homo sapiens
aatgcgttgaagggagaaaaggagagagtatatatatagcacacagacacacacacacacacacacacacgaggcacacacacacacacgcgcacacacacacacacacacacacactctgtatggtgtggtgtttctctttattgtggggagaattctatctaacatatctactgtggtgtatagagatgtgtggacagtgctctctatatgaggtgtgaggatagatatatacatgtgtgcgtggagagcggacagcgagctagaatgcgtaaatat

SEQ ID NO: 719440 - DNA, 214 bp, Homo sapiens
tgcgactgtagtgcgttcgtagctatgagtttgctaggcggacctagtaatgatggactgtaagtccgtgggcattatagaatgactgcgccggtaagcttcagggggtttggatgagaatggctgttactacaagggctatgtggctgattgaagagtatgccatgagcgattttaggtccgtttgtcgtaggcagcttggggtaccgaggct

SEQ ID NO: 719441 - DNA, 1282 bp, Homo sapiens
  misc_feature (1184)..(1184): n is a, c, g, or t
  misc_feature (1190)..(1190): n is a, c, g, or t
  misc_feature (1192)..(1192): n is a, c, g, or t
  misc_feature (1194)..(1196): n is a, c, g, or t
aggaagtactacaggacatattttggtgtgaaattttgaacaaataaaatttcaccaagaaaccactttgaccatatttacgcaagctcaaatttaacccgctctaaagggcacaaaaactgaaaccccacctaggtggagcacgctctaaaactagtgattcccccggatacaagaaattccgaaacgcgtcgactaaggctacaagaagacgacaaaagggaaccagactaacagcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719442 - DNA, 335 bp, Homo sapiens
gcggccgcctactactactaaattcgcggccgcgtcgaccaggaataacctcaactctcctaatggaagttcttcttttccattctagccattctcatctcagtatgatgatgaacagcagaacactttcaaggatgacgtacgaatatttcccgaaagtggtcaggctatctgtcgctgcgaggtagtgaggggattgctatccatcagtttcatagccatcatctccaacgcatcttcaatgcctcatccaatgatatgaagttaaaaccagagctatttctgacacagcaatctttgagcgggcatttgccaaaatacgaacaagttcgtcg

SEQ ID NO: 719443 - DNA, 1113 bp, Homo sapiens
  misc_feature (13)..(13): n is a, c, g, or t
  misc_feature (1015)..(1015): n is a, c, g, or t
  misc_feature (1021)..(1021): n is a, c, g, or t
  misc_feature (1023)..(1023): n is a, c, g, or t
  misc_feature (1025)..(1027): n is a, c, g, or t
ttaactctagganggcttgcccagctggggtaatcataggctcgattgacggtaaccatgtgtgaaagcctgaacgcaggcacatacttcctattctacaccctagtaggctcccttcccctactcatcgcactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719444 - DNA, 1094 bp, Homo sapiens
  misc_feature (996)..(996): n is a, c, g, or t
  misc_feature (1002)..(1002): n is a, c, g, or t
  misc_feature (1004)..(1004): n is a, c, g, or t
  misc_feature (1006)..(1008): n is a, c, g, or t
tccatgctgtgccttctcttcaccctatcagctatacgcatacaatgcctgtacgtaggacactactatgctataccaaccatagtcagctcctcttcccctactcgtcggtactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719445 - DNA, 1070 bp, Homo sapiens
  misc_feature (972)..(972): n is a, c, g, or t
  misc_feature (978)..(978): n is a, c, g, or t
  misc_feature (980)..(980): n is a, c, g, or t
  misc_feature (982)..(984): n is a, c, g, or t
catggacagcgtagtatgcttgtagactgggaaataccttggtattctttaacctcaggtaagctcctttcgcctagttcatcggaaaactaatttacactcacaacaccctaggctcactaaacattctactactcactctcactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719446 - DNA, 1333 bp, Homo sapiens
gcaatggttccgcgccgggcgtgcacggtgtggggcgtgtcccgtgtcccgcagatactcgttcctagctgactgccagcgtcctcgtgccggccctgaggatggacccaggagatccctgctggtagaccctgccgctaggcgagcgccagcgcatgggcacccacaggcttctacagcctacttctccacctaagcagagtggtgatgttttcaaagtgcaacagcccagctagcagggcccctgtgaacagactcggagccccactggaacactaatggccctccctggaacagacacggcaccaccaacctgagaacagcctcgagtgcccccatggaacatgcctcagcagccccctggaacactaatggccctaccctggacacagagaatggcatcctcaaaccgaagaacgagtctctggatgccgcccgtgggaagcagcatcacgcgagagccgcctgtaccaccagactacgtagtgcccataccctagggtcgaccacgattcacgcgcaccccctgcccatcagacagtccctagggaggccagcatgggagacaccaacgttgactccctacaccagcacaccatatccataccgacatcacccacacttataaaactattcaaactacatccaacccatcttcacaccaccacaacccaatcacacaccaccatacactccaccacttcacaacatacaccacacatcaccatacaatacaaactatagtccacacctccgacaccacctccatatgttacggacaacacctgacaacagatcttcaacggaccacatccagacgcactcatccgatcaagctagacaggacccgaccaacacaagtcaaccaattaaacctctcagaccgccacaccgcaactgccaaacataccaacagagcaggaacgccaatcaacaaacaaaagatatgtgctaccctccgacccttcccacacatagctacaccagcagtcgcacaacccactcaaccacccacccactaccccaaaccaccccccccacaactccccttccccaactgcccccattcaccctccaacgatatgactcttcccacccgccaccacccaaacacatactcaccccacactacccatacaaaaccactgacacactacaccaccaccaacccatcccagcaacatatacctcacaactaacacctttcgtccacttttacccaccgtatcacctcatactccacagtaaccctcactcatcatactcaactctacaaaatcacaaacacacacacccataccgcaccccgcacgataacagccaacaaaacaaa

SEQ ID NO: 719447 - DNA, 1032 bp, Homo sapiens
  misc_feature (934)..(934): n is a, c, g, or t
  misc_feature (940)..(940): n is a, c, g, or t
  misc_feature (942)..(942): n is a, c, g, or t
  misc_feature (944)..(946): n is a, c, g, or t
cttcaggacccagagaggatatgatgcgactgtgagtgcgtcgtagtttgagtttgctaggcagaatagtaatgaggatgtagtccgtgggcgattatgagaatgactgcccaagaactatcaaactcctgagccaacaacttaatatgactagcttacacaatagcttttatagtaaagatacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719448 - DNA, 983 bp, Homo sapiens
  misc_feature (885)..(885): n is a, c, g, or t
  misc_feature (891)..(891): n is a, c, g, or t
  misc_feature (893)..(893): n is a, c, g, or t
  misc_feature (895)..(897): n is a, c, g, or t
tcagggagacgggtatgactgggggtcgtgatacatggggaacgagctaactaactgggcgagagttatcaacggggtgagcgtactactggggatgactcgctgaccgggccagcgtgtatagccagaggagacctctttacggactccacttatgactccctaaagcccatgtcgaagcccccatcgctgggtcaatagtacttgccgcagtactcttaaaactaggcggctatggtataatacgcctcacactcattctcaaccccctgacaaaacacatagcctaccccttccttgtactatccctatgaggcataattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719449 - DNA, 836 bp, Homo sapiens
  misc_feature (782)..(782): n is a, c, g, or t
gctcttcctaagccggagctcggtgaagttctcccaggatgatagccatgttcagtgcgaccgccaagatcgtgaagtccaatggtgagaagccggacgatgttcgagtccggtcatcatactcaggctctgtctggatgctaggaggatgagactcggactctcgaaagggtcaatgcctgcaagggagctgaatacttacgtgcagcgtaatggaaagtcgagagttaggtggtgggtggggaaagctatctgatattcatttgtgccctgttgcgtcaattgaaatctttctcgatgaaaatcctaagatccggggtagtacgcggaattggagaaaaatgttcagtgggaacgcgatgtacgtctcttgatcagctcacgaggagatagttcctgctcgtaataggccagattgcagagataaaagctctgtacataggagacatcatagcaatatagcgcttccacgtagctcgtactcctgacagtctgttgcgcagattgccatccgttgacggactctggtcgttccacaagcaagaaagttgtgggctaaagggaattcgcgttggtataactgagtatgggtcacggcgcggcattcagtaacaggttgcattcttggacgagaaggcatgcagtcagagacaactggtgggcaacgagaaaggtttgcaagaccgtttgcttcttgagtggtcctaatttatagaaagacttacaactggcgcgacaggactgtttgaggtctttatgcaaatttccccagggaggttttncatacttggtaacaaccataagatatggacttaaattgaaacacacgttattat

SEQ ID NO: 719450 - DNA, 748 bp, Homo sapiens
  misc_feature (650)..(650): n is a, c, g, or t
  misc_feature (656)..(656): n is a, c, g, or t
  misc_feature (658)..(658): n is a, c, g, or t
  misc_feature (660)..(662): n is a, c, g, or t
cgacgctagaggacccctcatagggatagtacaaggaaggggtaggctatgtgtttgtcaggggttgagaatgagtgtgaggcgtattataacaagctccatctgcctacgacaaacagacctaaaatcgctcattgcatactcttcaatcagccacatagccctcgtagtaacagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719451 - DNA, 901 bp, Homo sapiens
taaaaacccccctcaaaaaagggaaaaataaaaaaaattaaccccattttaaaaaaggccaattagggggggggttttaaacccaaagtttatgtgttgggagttggatagaagagaactaattataggtgggggagagtagaaagaaatatatggtgaggagaaatcgtgacgcacaataaattgcagtagaactactcggttagaaccctgtggtgtctacacaaaatagtgattagcgcccgatataatcggtggaaaaatgttgtaagggagaagatcacaaatatatcctggaggttgtgtgggggggatactaaataaaatagaccccagaacaaaaaatttgggtaacacaagcacgcgggcgcttcgcaaaatataatgtggagggtgacccgcgagagtggttactcactataatacaacaaacatgggggagacgaccgccggggtagtgagaatactcacccccggtgagtgagagaaacaataaaacagcgggagagtgcgtgtagtaaacaaagggagggagagaccactactcagagggaggaaaacgtaacggagcggggttaacgtcaccagtggtggggagggggcacgaacgagcagcctcctctatatgggggggagagaggggacaacgagggtgaggtggtggataacacaggggtacaaaaaaatctcttgtggtgaaaaaaaaaaaattgtcgggagggtaaacaacaatagggagattatccccagaataatgaaagggacgttttatgggaacaaggtgatggtgatttagtaggagccataggagatatggtgattatcgtggtgattataatattgggggcacatttaggtgttatgaggtatcagatttagtgatatagaggcctaatataga

SEQ ID NO: 719452 - DNA, 631 bp, Homo sapiens
  misc_feature (533)..(533): n is a, c, g, or t
  misc_feature (539)..(539): n is a, c, g, or t
  misc_feature (541)..(541): n is a, c, g, or t
  misc_feature (543)..(545): n is a, c, g, or t
ctgggcacgttctgtcccggaggtcagcgcaggtggcctatcagatgtgggaacttagtgcatgtggcccgagtagagctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcgctaacctcgccttaccccccactattaacctactgggagaactctctgtgctagtaaccacgttctcctgatcaaatatcactctcctacttacaggactcaacatactagtcacagccctatactccctctacatatttaccacaacacaatggggctcactcacccaccacattaacaacataaaacctcattcacacgagaaaacaccctcatgttcatacacctatccccattttcctcctatcctcaaccgaaatcattacggggttccccctnaaacancncnnnggggccgctcaaagtcccgccggggccacattcgcaccgcatgtggtagggccaagggtgtagccgccggctgaccgacggaagta

SEQ ID NO: 719453 - DNA, 966 bp, Homo sapiens
gttctatgatcgcgagcggcgcccttttttatgtttctattttttatttattgtttttatttattttaatataaataatggggagaatcttttttttctcattttttctttatattgttatatttttttgggagaaaaacgaagtattcctgtcgtctgtgtgaaccgcacgggggtgcggcgtgcgcgcaggctactcgagtgctccactcagcccatgcgtcgcgacaacacccctgcctccactgagggtgaagaggagatgctgtcgcgtgcgtgcaatggtccgcccccctgtgttgcgagtggaggagatcacttgagcggtcagtgcgtggcacacacaactcgcgtgggtgaaacaaatgtgtcacactagtatgtgttcgggaaacaaaagaagagagaggtaaatcaaacacgctgtgtcgtgtgtgagccacagtgagtgtgcgtttcagagaaaactctcacaggcgacagtccaccacgagagaggagacatgtgtcgctggcccgcagcgtgcgcggtgaggttctcacacacgacagagggtgcgcaggggggagatataaacgagagggtgtgtgggagaacgcccaagtgtgcccccacgcgtgaccgccgagagagagatgtcaatgccactcttctacatacctatatatattctaacctgtgtgatggcgtgtattatacacactagcgcccttcttgggatatatatactagacctccacagataagagcgcggtgtaaaacctacgttgtgctgcgcgctgcgtcccatacactataatagaccaaacgtggtgacagtaacccatggtttctgtgctgcggtggcgaccacaaaaaaagcacagggcacacaaaataagataccccacaagacgagaagaaggcggggggggcggggcacggccgattcttataatccgaaaaaattttgcacccccggcgaa

SEQ ID NO: 719454 - DNA, 539 bp, Homo sapiens
gagctcggtaccccttgcatgtaccgggcccatacccttgcatgcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcattctccaccccttgacaaaacacatagcctaccccttgcttgatctatccctatgacgcataattgttacaagatacatctgtctacgacaatacagacctaatatcgctcattgcatactcttcaatcagccacatagaccttgatgtaacagccattctcattcaaacccgctgaagctttaccggtgcagtcattattatacatcgtccacagacttacatcctgattactattatgactagcagactcaaactacgaacgcactcacagtctcatgataatacactctcaatgactctaaactctactgccacttataactttt

SEQ ID NO: 719455 - DNA, 549 bp, Homo sapiens
gccgctcggacccactttcagagtagccattctcatccaaaccccctgaagcttcaccggcgcagtcattctcataatcgcccacggacttacatcctcattactattctgcctagcaaactcaaactacgaacgcactcacagtcgcatcataatcctctctcaaggacttcaaactctactcccactaatagctttttgatgacttctagcaagcctcattctccaccccttgacaaaacacatagcctaccccttgcttgatctatccctatgacgcataattgttacaagatacatctgtctacgacaatacagacctaatatcgctcattgcatactcttcaatcagccacatagaccttgatgtaacagccattctcattcaaacccgctgaagctttaccggtgcagtcattattatacatcgtccacagacttacatcctgattactattatgactagcagactcaaactacgaacgcactcacagtctcatgataatacactctcaatgactctaaactctactgccacttataactttt

SEQ ID NO: 719456 - DNA, 504 bp, Homo sapiens
  misc_feature (318)..(318): n is a, c, g, or t
gactagaagggaaaggggtgcaatttcttgggtcctctgtgtcctcaacagctttgtggtataacagcagaaacttgctaaaggttcatcaagtgcttgttctgactgggtcccctgactctggcctaaatggcattgggaggggactgggactagaaaatttaataatgcagtggttttgcaaaaccaaatagacttatatctgggtcttaaaaggcatagcccaggccaggtgcagtggctcatgcctgtaatcccagcacatcgggaggcggaggtgggtggatcatgaagtcaggagattgagaccatcctggncaacatggtgaaaccccatctcttctaaaaatacaaaaattagctgggtgtgatggcatacacctgtagtaccagctactcaggaggctgaggcaggagaatcgcttgaatccgggaggtggaggctgcagtgagccgagattgcgcgactgcactacagcctggtgacagaggaagatactgtct

SEQ ID NO: 719457 - DNA, 830 bp, Homo sapiens
  misc_feature (231)..(231): n is a, c, g, or t
  misc_feature (235)..(236): n is a, c, g, or t
  misc_feature (283)..(283): n is a, c, g, or t
  misc_feature (285)..(285): n is a, c, g, or t
  misc_feature (289)..(289): n is a, c, g, or t
ccaatctgcgggctgccgtgccgctgcagacggtgccggttgatctccagcgctacattggccgctggtatgtcatcgcgaatatcccgtactttggcgagcgcggcaacgtcggcagctacgccgagtgggcgctgcggcccgacggccgtatcgacgatgcctatgtctaccgccccggcggtttcgatgcgcccttcaagcgcatgcagtttgtggattcggtggtancggnnagcggcggtggcgagtggcgcgtgcgcttgttctggccgatctacgntncgcnacagacgctgtatgtcgacccggaataccgggtgacgctcttgggctatcccgacaagagcctcggctgggtgttctcgcgtgaccccgacatgagcgatgccgactatcgcgcggcactcaaccgcttcgaggcgatgggctacgacacgtcgcgcttccggcgcgtgccgcaattcccgagccagattgggcaaccaggcttccagtcgccgggggacgacaactagccgtatgcgcatcactgtgactcgcccagcagatggtggcgcagggcaggtgcccgggtgccgggggcgagccagatatcgaagaaggcgcgggcaaaggccgggtcgtcaacctcggtcgtcagttgcccgttggcatagaagcgcgcaccgcggtccggctggtagacgccgcacagtgtgtcgccgggcttcacgtccacgaacgcgggcatcatcgcctcctgccatcgcgccaaagtggcatcggatggcggaggcatctgaatccgccgaatctcatcaatgccgtttgtgattcaggctactccg

SEQ ID NO: 719458 - DNA, 243 bp, Homo sapiens
ctgatattccaatgtgaaacaagttgtgtatgatgcataaaaaactacacttaaggtagaaaagggaaaactaaaactttctaaatgcaactgagatgcagtaagaagaaacgttttctaacctgaaagtaaacccatttgtttcacaaaatgggaatgtgttcttgttactttaaatagtacaatttaactgttaaattatagaccaaaaggcaaaacaaatattttgttatttaatgggtc

SEQ ID NO: 719459 - DNA, 338 bp, Homo sapiens
cgtggagtcccatgggagttgggtttgtctgtcgttgcctgcctctgttgtcgtaaaatgggggtcccttgactgcgattatcaagggagaaggcaagactggtgacgttctagtccatctaggaagactctgcaccactgtcgccttcatcacagggtgaagctcggatagacaaaggcgctttggctaagctggtggaagctatcaggacctaattatcaatgacagatacgatgagatcctctcgtcactggggtggcaatgtcctgggtctctaacgtctggtggctcgtatctgccaagctctgtaatatggcaaatggtctaaagaacgtgg

SEQ ID NO: 719460 - DNA, 405 bp, Homo sapiens
  misc_feature (36)..(36): n is a, c, g, or t
cccactgttggcctgagtcctgccccttggaaaccngaataaatatagctctccttccatgcgtctgcttctaccaaaaatttggagcccagtgcttaggtttttcctttcttcctaaaattctggtttgaataattccctgtcttccagttgttcttcacaccccatgagctttctcattttgttcattcattctccacatgtattgagaagttactgtgtgcaagcaactctgttttaagtattgggatctatagtggacatttcagataaggttccctgttggggaaaagggaaataaacaagtgagcaaataaggcaatttaaggtagtcaaaaagtacttttcgtgatgaatgattagaagagagctgttttggataaaatattgagagaaagtgttttg

SEQ ID NO: 719461 - DNA, 229 bp, Homo sapiens
  misc_feature (1)..(1): n is a, c, g, or t
naattagatattttatttcattcaacgtgtaagagcttttagaaaatacacatctactttcataatgtaaaagaaaaatattttcaaatcaaaagtaatcacaatcataattttcttacggtgttttttttttgttttgctttgttttgttttaaaaataaagtctccctctgtcgcccaggctggaacgcagtggcgtgatctcagctcattgcaacctccacacttc

SEQ ID NO: 719462 - DNA, 118 bp, Homo sapiens
cctcacagaccctggcaaagcaggaagcagataccttcatcttttgtttctatttgatttcttttttcttttttatatttattattatgaggcttctcaaatttgccttaagtatttt

SEQ ID NO: 719463 - DNA, 601 bp, Homo sapiens
ggcggtacctgcttacaaaagcacatagtaaaataacccaaacatccacagtaagaggatgaggctgggtgcggtggctcacgcctgtaatcctaacactttgggcgtctaaggtgggagaattcctcgagcccaagagtttgagaccagcctgggcaacatcgggagaccccgtctataaaaataaaaaaaattagccaggtgaggtggtgcatgcctgtggtctcagctccttgggaagctgaagtgggaggatcacttggacccagggagtcgaggctgcagtgagtgtgatcttcccactgcacattccagcctgggaatcagagcaagaccctgtctcaaaaaaaaaaaaaaaaaaaaaaagttttaaaagagtgtgaggaaaatcataaagagcagggctccactccaagtgttttaataagtgggatccccataacccctgctccacccgtgatttctggggaaaaataggccacaaaaggtgcccagatttgattgccctcggggttggtgatgggtccactctggaccccagttcttcccctgttgtaccctttattggccttttgggaaacgtgggaaaatagctctaagg

SEQ ID NO: 719464 - DNA, 1275 bp, Homo sapiens
  misc_feature (30)..(30): n is a, c, g, or t
  misc_feature (65)..(65): n is a, c, g, or t
  misc_feature (128)..(128): n is a, c, g, or t
  misc_feature (223)..(223): n is a, c, g, or t
  misc_feature (322)..(322): n is a, c, g, or t
  misc_feature (379)..(379): n is a, c, g, or t
  misc_feature (475)..(475): n is a, c, g, or t
  misc_feature (489)..(489): n is a, c, g, or t
  misc_feature (567)..(567): n is a, c, g, or t
  misc_feature (661)..(661): n is a, c, g, or t
  misc_feature (698)..(698): n is a, c, g, or t
  misc_feature (727)..(727): n is a, c, g, or t
  misc_feature (767)..(768): n is a, c, g, or t
  misc_feature (770)..(770): n is a, c, g, or t
  misc_feature (784)..(784): n is a, c, g, or t
  misc_feature (818)..(818): n is a, c, g, or t
  misc_feature (826)..(826): n is a, c, g, or t
  misc_feature (834)..(834): n is a, c, g, or t
  misc_feature (842)..(842): n is a, c, g, or t
  misc_feature (859)..(859): n is a, c, g, or t
  misc_feature (916)..(916): n is a, c, g, or t
  misc_feature (949)..(949): n is a, c, g, or t
  misc_feature (959)..(959): n is a, c, g, or t
  misc_feature (989)..(989): n is a, c, g, or t
cggattgcgtcggggcgccccgaggaactntgggaggccgtggtgggggccgctgaacgcttccnggcccggactggcacggagctggtgctgctgaccgcagccccgccgccaccaccccgcccggncccctgtacctatactgcccatggtcgaagagcccttgcggaagcaacgcgccgttacctccacaacatcgcactggcccacaaggctgccactnctgctcggcctcctgcacccccaccaacaccacaaccacccaatcccacacccaacccaccccggcctaccctggccaaaaaagacaacgaggaggacnaggataagcccacaaaaacaaaaacctccggggagcagctgggcattaatgataatngagggctctttttgatggatgaagacgccaccctccagaaccttccccccttctataagtcaaaccccgaaaatacaaataatggcagcctgaacnaagaaacccccgcnggcccccccacctgctcaatgcccccaacctcaaccctacccacacagcagtacgccaagtccctgcctgtatctgtncccgtctggggcttcaaggagaagaggacagaggcgcggtcatcagatgaggagaatgggccgccctcttcgcccgacctggaccgcatcgcgncgagcatgcgcgcgctggtgctgcgagaggccgaggncacccaggtcttcggggacctgccacggncgcggcttaacaccagcgacttccagaagctgaagcgganntnttgaagtccagggngggagcgcccgggccgcgtccgccccgtcccacnctacgccnccgccccnctcccggngcctgctaatctgaggncgatccgggaccggcctccttgcgtctcccattcccaagattgtccgcctctgccantccccgccgtccttccagccacgacctgccggncgaggagggnatctgtcccgtttccgattgggtctgtcantctctcatccgcctagctgacggagtcccgttctagttgatgggattcggcctcagctgagattcgtacagccctatgatgggtccaactcctttgtttgtcctgcgctagcgacgcagggattttgctcgcgacggcattggctccatcccctagtcggctggaccagctccttcggttgagtcggctccactcctgtaaagggctttgaccaggcttctacactggtcccgtgcgggttccccgagtttcccccccatgggcccgcgtccggggggtgccgcca

SEQ ID NO: 719465 - DNA, 149 bp, Homo sapiens
atgcatgacagacgccaccacggtagagggtgggtctggggcaggcactacttttacctttctagacctttgaggttagcaaaaacctgaaaggtaaagcgcttactggaaagcgcagagctaactgagagcagaactagtgacctgta

SEQ ID NO: 719466 - DNA, 128 bp, Homo sapiens
  misc_feature (62)..(62): n is a, c, g, or t
acggccgtgtattactgtgcaagagatctcttggagcaaacgaccatgcggcatattgtagnagtaccagctgctatctactactactacatggacgtctggggcaaaggaccacggtcaccgtctcc

SEQ ID NO: 719467 - DNA, 257 bp, Homo sapiens
attctgaatttaggggattatcaaaagataatattttacatccactgtctgttatcgcacttcatggctcagctctggggcagcaccctctaaatcaccaccttaatctgctgcaacaaactgtagaatattcagacacactggatccataaagactaagtagcccataaggggtcaaattttgctgccaaatgcgtatgccaacaaattacaaaaacacttcgttcgcagagctttacagattgtggaatgtcgga

SEQ ID NO: 719468 - DNA, 282 bp, Homo sapiens
ctcccccgctatttacaactatctcaaggtgggtggatcactgaggtcaggcgctcgagatcagcctgagcaatacaacaagaccccatctctatttcaaaaagtgtttttaattagttggacctggtggtgcacactagcagtcccagccactgagggggtagaggctggaggattgctggagccaaggacatcaaggttgcagtgagccatgagttgcaccactgcactccagtcttgggcaacagagcaagaccctgtctcagatagttgtaaatggcg

SEQ ID NO: 719469 - DNA, 536 bp, Homo sapiens
ccctaccgcgttgtggtagccctgagtctgggtgcccgtgccagccggcagacccccaagcctagccaccgcatacccaagcagccccgaccctacttcccctacaaccaccggaccaggcccgccactggaccagaccgcctgtcaactagcacgtcagccaccatgcacctgtgccgtagcatcagccgcttaccacccctgcacatccacacacgacccagccccgcttagaccctactacgcgctataccaccctatgcggccacgaccgcgcacgccatcttcgagttgcgccgcctagactctcgtactcccctttctcgccgttccttggcgaccgcggcgttgccacggccaatagccgaggtgctactctcggttacaccacgacaccccccacccccaaactcaccctctacctcccataccttccccaccacccaacgacacgcgcaccctacaacacgcctccccacgaccctctacccaatcttcccctcacaccccaccagcccaccacctgacacacaccc

SEQ ID NO: 719470 - DNA, 503 bp, Homo sapiens
gctttgtcggtgatgtgaagtccctacgcaggtgtagacagctcggtcggtgaggaagtccctacagcaggtgtagacagctcggtcggtgaggaagtccctacagcaggtgtagacagctcgttcagtgagtgaagtgcctacagcaggtgtagacagctcgtccagtgagtgaatgtgcctacagcaggtgtatgacatgctcgtccagtgaggaagtgcctacagcaggtgtagagagctcggtcggtgaggaagtccctacagcaggtgtagacatgctcgttcagtgaggaagtgcctacagcaggtgtagacagctcgtgcagtgaggaagtccctaaagcaggtgtagacagctcggtcggtgaggaagtccctacagaaggtgtagacagctcggtcggggaggacgtccctccagcaggtgtacacagctcggtcggtgaggacgtccctacagcaggtgtaaccagctcggccggtgaggaagtccctacagc

SEQ ID NO: 719471 - DNA, 172 bp, Homo sapiens
aagctaatcagtaatcgttagtgttagtgtattttatgtgtggcccaagataattcttaattcttccaatgtggcccagggaagccaaaagattggccacccctgtacatgctcatatacttaatctttattctttccaggccctaatctggtaagtggttctgcattttgc

SEQ ID NO: 719472 - DNA, 234 bp, Homo sapiens
gaaagcgctggtgtgaaaatagctgttaatgaaagcggctgctgaataaaaccatattcacctgcctagagctccccaagcgttctttccgctcatccacccactcccctcggaccgcagcatgggctggacctggacccccaggatctgaaaaatgtatttgttgaagaaatacaattcttgtccatttaaccctgcattgctaatgcataggcggtcctttttttttttttg

SEQ ID NO: 719473 - DNA, 869 bp, Homo sapiens
atgagcccaatacgcaaaattaaccccctaataaaattaattaatccacgtcattcatcgagactccccactcccatccaacatctgccgcatgatgaaactatcggctcactccttggcgcctgccatgaatcctccaaatcagcacaggactattcctagcctatgcactactcaccagacgcctctaacccgcctttacatctgatcgcccacatcacgtcgcagacgtagaattgatggctgagatcatccgctacgcttcggtgccaaggacgcctcaatcattctttatctggctcttcgctacacatcggccgagggccaatagttgacggatcatgtctctactcaataaaacctgaaacatcgggcatgtatcctcctgcttgcaacgatggcaacagccttcataggctatgtccttcccgtgaggccaaatctcattcatgaggggccacagtacattacaaacttactatctcggcatcccatacatgtgcgactagacatgagttccaatgagtcctgcatcgaggggtactcagttataactgttcccaccctcacacgaattctttacccttggcgggtacaatacttggcccttcatcattgaggccctaagcaggaactccacactcctattcttgtggggagaggtgatcaaacaacccccctaggaatcaccgtccaatccggattaaagtcacttgcaccttacgatacatcaaagacgcgccggcttactttcttccttttcaccttacgaaattggagatttgacagacatctagcgacagatattataccaactacacttagccccccaaataaccgagaaacatgcgaaatccgccgccaaatgg

SEQ ID NO: 719474 - DNA, 405 bp, Homo sapiens
gcctcagccaaaattcggccgaggcaaataaagataaaaaatggaaaaggttgttttcacacacttgtaagcatgttggtataagaacctaagtcctgggtagtgtaatcaggtgccattattctttcacctcctccaagttgtgcctgaagttgcaacaagtcaactgccctaaaagcttattcctacattgaaaaaccaaagcccagcaaaggaatagaattctacttgaaaactagcacataggtgaaagagttaagcaagatgaatgattttttctgttttgtttgtttcccaatgcaaaaaaatgggtagggtccaccatactggtaattggggtactctgtatatgtgtttttctttgaacgaatcattaatcccctgtttttttaaatggtctttttt

SEQ ID NO: 719475 - DNA, 556 bp, Homo sapiens
aggtcacatagctattatttggtagagttgggatgtgaatccaggcagtgtggtttcagagcctgtgctcttatctcctactttttgatcttgcccccacacatgataattgtttgatttgtctccttactgctgagcacttcaaatgagtggctgtttccattgattttacttatctagcacttatttttattttgacttctgttactggctttagttttttaccctcacctttggaatatctctcttcaaggtcaccactgatttttatagccaatacaatgggttatttaagcttctgtttctctttgatcttttcctggcttttgataacagtagccatttatatggaattacaactttgacttctgtgatgttgaacttgcttgttttcgccttgtctcactgaggcaccttggttttcttctttctctacgcattccttagaccattgccatcttttggattgagtttgaatttaggtgtgttatataagaagccccttaatgttaattttatatttaaatcaggacgaataaaaagatgaaatacaaaa

SEQ ID NO: 719476 - DNA, 444 bp, Homo sapiens
  misc_feature (430)..(430): n is a, c, g, or t
tgaaaataaaattgaagtatttctgtagattcatctggcaatgttaagtccacagcaggctgacactactcactcacaattcaccacaatgggaagcagatccatgctggtgttacagacagtctcttcctagcactactcaaaagtcacagggctcacctcagattacgattggtttaaagcaaagtgcatacagagattacaacaattttaaggacaaaagaaatagaaaataaggtcctattttgtggtcccaacaacaaactcaaaaatctgatagatggaggctccaatgagcttttttataaatactttagtttaggtacagttatacagaaagtcgagttcgtttcaaatcttcaaaaaaaaagttcctgttattcctcaaatggtgcttgttatggtttaacatttctgttaaatgcgtgcnttgagtctcgtgcc

SEQ ID NO: 719477 - DNA, 1079 bp, Homo sapiens
agcgggctttgagctcctggttatcgctggggccgggccgcgtcggagatatgcaggcgactatgcagtggcacacaacggtgcctcccgccgcacatggcgtgccctaccgagctcctcgcgtgcgtctgcgggtctacgtttcgccgcagcgccggagccatctcgacctgtgcccggctgactgactgcctgcctattgtctgctgtcgttgcgtgcgactgctgcgagcacctggcgatcggtggagactgttggctcagcgttggtgagcgccccggtggctgcggtcgaaggtgcccaggggctctggcccaagggttggtctggatctaggtgctgccgcgctctaattcccttcatcctgtgtgatcattgccgctcgctgggtcagcgtccgtggaatcacatcgatttccaacagggagcttcgtcgagatccgctctagtcgatccggaggtgcacctcgcgctattacagcttgttcgtttggtgaatacttgggcacgaccaaatgagttcgtaaccgcaaggtaggcttgcgaaactttcgccaagcagatagtagggcaaaacgaggtgcctaatcggcctaggcggacccaatcctcgctagtggggatgacgccatggggctgactgcggggggctttccccggaggattggcgggaccccgacttggcaggcactcgaacgccacgcaaaactagcctagtgttcttgttcgtgcccatgtaacctgtcttgggacttggcactttgcgtgaaaattattgtgggcaaggtgaagggcccgctggcttgcgtatgtccctggtagatgggtttggccccggttggtccttttggtcatccgacggatgccaggcattgttggagcccagaggtggtgaagtaagatttctacacccctggtgaagcggcggtttagggtgaggggcagctacggaggggcgccctgtctgggcctccgccagggtgccctcagtttcgtgggcctggggctccgttagccatttgtttcctttacctcccttgttggcctccgcgcctctgggtcctccgttgggtggggg

SEQ ID NO: 719478 - DNA, 315 bp, Homo sapiens
atgaaagcattactttccatgcatttgccacagaatggtaatggagtctttacatgggtggtatgtctctcccctccataagttaggggtggtgcttggtggaggcattcagagaaattattgggcatgccactagtgatacttagggtcatgggtgttggggatgatattgttgagctagtgaggcttgtgtgggtgaccatcccatcttggagatgaatagttagatgttgcagctgctgcttcatgtgaatggatagtctcggtggatgtatctactggatagggcacaaaatcccggtgggtaccgagctc

SEQ ID NO: 719479 - DNA, 145 bp, Homo sapiens
  misc_feature (145)..(145): n is a, c, g, or t
agaggacacggcagcagtacgggccagcttgctggaagctcgggagcgcccctacgtagggcggctccttcaggttgaggacggtgtgcggaaccggggactcccccaacacacacggtgcgttggcccaacggggatcctctan

SEQ ID NO: 719480 - DNA, 562 bp, Homo sapiens
caccaagaggtgtggtgcacaccattcatgagaaatctatccccatgatccattcacctcctatccagggcccacctccaatatcggggattacaattcaacatgagatttggcaggaacaaatattcaaacatcagggtctctctatctcagtgtctctgcctcttaatttttattgttgataatttacatgcaattttataacatgctgttacttaaaattttatgacttctcatgttatcaaaagaaagcactgaacatatattaatatttatgtaatctagtgtataaatataaaatcatttgattaaccattttacagatactgaaatggctgtacagagagattaactttccaagattttacagctatttggtaccaagcctgggcagtcagacccatctgtgtcctggcctgtgtgtatctgagtgtagttttgtatgtgtatgcttcacaggcaccagctctaggggcactggttttgtccagtagctcagaaccttccatcacaacaccccactcaaacaagccctgtcttggggacacctttgaagttgtac

SEQ ID NO: 719481 - DNA, 1021 bp, Homo sapiens
  misc_feature (105)..(105): n is a, c, g, or t
  misc_feature (113)..(114): n is a, c, g, or t
  misc_feature (125)..(125): n is a, c, g, or t
  misc_feature (136)..(136): n is a, c, g, or t
  misc_feature (148)..(148): n is a, c, g, or t
  misc_feature (158)..(158): n is a, c, g, or t
  misc_feature (181)..(181): n is a, c, g, or t
  misc_feature (576)..(576): n is a, c, g, or t
  misc_feature (613)..(613): n is a, c, g, or t
  misc_feature (824)..(824): n is a, c, g, or t
  misc_feature (827)..(828): n is a, c, g, or t
  misc_feature (865)..(865): n is a, c, g, or t
gaagttgctttggaggtcctggaccgcggagtcgtgccatgtcgcaaggatcccaagcaacccggcgcggacgatgcgccggacgtggcaggcatggctccgggncagcatgnngggcttcgtgntgactgtcaancaagagcgcggngagggtccangcgcgggcgagaaggggtcccangaggaggagccggtgagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggaactgcgnatgggttctccaccttcgatgttcccatcttcacgtngaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcnccnncagcttcgcctcactgccggtgccggcacgggcgaancgcccacgctgggcactctggacttcttaactgggcccggcttcacagggaccccatcgaagcgcgacccgcccagcacgagaaggctcatcgtccggatcacgcaaatcctggccccggtcgccactggcacctgtgaggactggccggcccagc

SEQ ID NO: 719482 - DNA, 1305 bp, Homo sapiens
  misc_feature (389)..(389): n is a, c, g, or t
  misc_feature (397)..(398): n is a, c, g, or t
  misc_feature (409)..(409): n is a, c, g, or t
  misc_feature (420)..(420): n is a, c, g, or t
  misc_feature (432)..(432): n is a, c, g, or t
  misc_feature (442)..(442): n is a, c, g, or t
  misc_feature (465)..(465): n is a, c, g, or t
  misc_feature (860)..(860): n is a, c, g, or t
  misc_feature (897)..(897): n is a, c, g, or t
  misc_feature (1108)..(1108): n is a, c, g, or t
  misc_feature (1111)..(1112): n is a, c, g, or t
  misc_feature (1149)..(1149): n is a, c, g, or t
gccgggccctgagagggggcgggggtgcagtggtcccagggccgggccggggtctttcctggcccgggggaaaccggaccagtgcctcccgtgggggtggcaatcgcccaatcaaaggattcttggtggcgcccgccctcgaggagcttccctgctccctggatccggtccctcctcagcgcatccgggcccgggcatcccggggctctccgatcgcggggtaccccgagttcgcggtctgccatcgggcaagcccgggcgctactcacgctccgtcccgcgatccgtgttccagtgtccggcccggagcggcgcatgtcctcacggccccaaagtctagcccggacgcaggccgcctgtgccgagctgggcggccaatggctccgggncagcatgnngggcttcgtgntgactgtcaancaagagcgcggngagggtccangcgcgggcgagaaggggtcccangaggaggagccggtgagaaacgcggctggcccaagggcaagaagcggaagaagattctgccgaatgggcccaaggcaccggtcacgggctacgtgcgcttcctgaacgagcggcgcgagcagatccgcacgcgccacccggatctgccctttcccgagatcaccaagatgctgggcgccgagtggagcaagctgcagccaacggaaaagcagcggtacctggatgaggccgagagagagaagcagcagtacatgaaggagctgcgggcgtaccagcagtctgaagcctataagatgtgcacggagaagatccaggagaagaagatcaagaaagaagactcgagctctgggctcatgaacactctcctgaatggacacaagggtggggaactgcgnatgggttctccaccttcgatgttcccatcttcacgtngaagagttcttggaccaaaacaaagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcnccnncagcttcgcctcactgccggtgccggcacgggcgaancgcccacgctgggcactctggacttcttaactgggcccggcttcacagggaccccatcgaagcgcgacccgcccagcacgagaaggctcatcgtccggatcacgcaaatcctggccccggtcgccactggcacctgtgaggactggccggcccagc

SEQ ID NO: 719483 - DNA, 372 bp, Homo sapiens
taattcgcactttatggtatcatcgtcgacacgttcctgttcgaatagtatcgcgattatggtctttaatagcatgatgacatagtctctgtagagtacgttgactatagagtttacaagcgtaggactcgtagacgcactagtaacgctagcatggttggaatacatctgctgttgtagacgctgcagctgaaagaccagatagttgcaatctgtactaaatgtctcaatgatgcatcgagtctggacgagagagtcagttaaccaatgacgtggattatcatacagacgttgatcgacggccactcatgtacagactggcacgctggtacgtccagtcagtaccagcttagggtttaaaatgaggttcag

SEQ ID NO: 719484 - DNA, 440 bp, Homo sapiens
  misc_feature (13)..(13): n is a, c, g, or t
  misc_feature (46)..(46): n is a, c, g, or t
  misc_feature (87)..(87): n is a, c, g, or t
  misc_feature (103)..(103): n is a, c, g, or t
  misc_feature (138)..(138): n is a, c, g, or t
  misc_feature (156)..(156): n is a, c, g, or t
cctcagcctcccnaaagggccaggatacagggcaggagtcacccgngcccagccagccataaggcatttttaaatatatttttaggncaatgcagacatccgnacaattttcccctaaacgttggcaacatgccctantcattacaggtccagtanttttccaggattttttttttttgtaaaatttacaaagaaatgtggaaatcttagttgtgcattagttgagttttaacaaatacctaggctttatcgcaacctctatcaagatacagaacattgctgtcattctagaagcctctgtaatgtgccttccccagtcaatctctttttccatggccccagcagccatcattctttcaatactttaaaaaacattcttatctgaagggaaatttcatatgtgccaaagtcatctctagatttctccaagtcttaaccac

SEQ ID NO: 719485 - DNA, 215 bp, Homo sapiens
accagtgtgccaagcagataaataccaggccactgatttaccacccaatttatctgatcatataatcttttaacaaacaagaaaaatggcaatatctggtgcacagtattaaaaagcacaagttgcgcattggcatcagaagaactccaaaagtgcccttcataaaaaggacacctcactgtagaaacatctatgcacttagtaagccctactca

SEQ ID NO: 719486 - DNA, 699 bp, Homo sapiens
  misc_feature (222)..(222): n is a, c, g, or t
ggggttcactgcaacctccgactccctggttcaagcaattctacctggcttggctcctgagtagctgggattacaggcgtgtgtcaccacgtctcggctaatttggtatttttagtagaggcagggtttcaccatgtcaagcgggtcttggactcctgacgtcggtgagtccaccgcactagggctcccaaagtactgggattacaggtcgtgagccactgntgtcccggccgttttacttaaagtgagcttaatttgtgaactcttagtgattcatatatgtacataaatctgtgatcccatttcttattgcaccatgtcaggaacagctttatataaatgagtggcgttcattattggcactattattgagtagtatcatggttccattacaggcctattaacatcatacatgtcattagtcttgaagaagaactatgtaaatatatatgtgtacccatgacgaatttctctctaaagcagggcttagaatctgcgtggcaacaagtttcgacacgagcataccacatgaattcaggatgttacctcaatgctaagagtcatgttagttaggacacaggcaggtcatcatgagctcaggtagaaaccactagatgctttgacgtttatgtagcttttagaacttgaacacagtttggaattactctggaaccaagcacttattcgaaacacattatc

SEQ ID NO: 719487 - DNA, 89 bp, Homo sapiens
  misc_feature (79)..(79): n is a, c, g, or t
ccttctacgtctcatcactgagatacacctaggtgttggaatcatagctattatatagctgtacaacatgatgtagaanccctcaactg

SEQ ID NO: 719488 - DNA, 223 bp, Homo sapiens
  misc_feature (144)..(144): n is a, c, g, or t
gggaaagtcttccgccagggaactcaagatggtggggaagctggttgtccacctcaaactcacttttccagtgtagaaacttctgccagggaactcaggatggtggagaagctggttgtccacctcaaactcaattttccagtntagaaactgtgagttcgcgggagatttccagcagcttggtgccaggcagaatgggagagggcatctcatatatggatct

SEQ ID NO: 719489 - DNA, 432 bp, Homo sapiens
atgatggtaggggctgacggagtagtaggaggggtccactccaagtggggggtgcgtgaaatgggcgtgggaccaacaggacaggggactctaggtttatgagcgctccatacccgttccacagcagcggggtacccagcgccagcctcccaggtgagcctgtccttatgtatagggtccaacctctgatgcgagcagtcaagtgtctgccccaatcctaaggtccccggatatgtctctagcgactggaccatctcgtgttccgtgggactggggccagcctctggtctgcccacttccctctcattagtcagatagccccaaaggctctatctttagctcccagagaacttttgggtcctcagtatttcccttcccctttccttcctattccccacaactgggggagggaagggagaacaggggcacctg

SEQ ID NO: 719490 - DNA, 775 bp, Homo sapiens
aggaagaggagtgtcagttccttgataccgtctgggagaactgagggtctttctgagaaaggaactcagataagacaaacataagtttcaacttttaagaccaggagggtcaatttctatttttttttttttttttcaaaaaaggccataaacatcagttctaggggaaaatagggccagttcaataaagagggcttgggtactgagcactccattgggcacacaaacttgtgtgcgggaaaagattgaaaagatagggatgctggaagagaagaccgctgtgttgaaccaattttccaggacattccccgggagaccgtgtgaaggacggggtggacaggttggggggagaactcagagcttaagggtgtttgtgactcattttttacacattattagggctggtagccccactaagggggggggccataaaacaagaagtgggccaacttagaacagctaaggggttaccatagaagcgggagaccaggggtggggaaaccccggtttagaggggaaacagagaccaggaagagccacgcccggcctctctgaaactggggcagagcagagagaagagtctcaggcctggggggaagggtaattggaacggttttttaacgaaacacaaaaacccctattgggttctttaattggagactggacaaatctggttataatgaggtaccatgtgtctttaaaccaaaaaagcacctttgaaaagtcttacattggggttctggtaatcttccctctttttaagcctcttttatgg

SEQ ID NO: 719491 - DNA, 490 bp, Homo sapiens
agtcggtacctggtctggtttctcacatgaaagtattttcttttctcaagtccataaatgagaataaatagacgtaaaatagatcttttcgaggatgaagtaaatggaatgaaaaacaaaacccaagctgaccagaaatcatagagggaagaaaaggttataaatatatggatttgtcagagtgattttaagctattaggaatcagttaaatgttgggggattttgtctgagaatgggctaaaggagaatgtcccttttgccttctgaagtttccctgaaaatcactaataggaggcagataaatagtagaaaaggcatacaggtttctgcaatgtgtgtacactggagccattagaacgaagacccagacacacgatgcgtgcagaagcttatctaccacatgaagtttacagaaagaatggggtcttggatcacaggaaaaaaacaacgacggttatgtgacaaaaggaccctggttagcaccagtgg

SEQ ID NO: 719492 - DNA, 144 bp, Homo sapiens
cattaaatgactcaaaggagtgaatctgtacatgtcagtcacagggttggcttgggcaccaccgtagtgtgcgccactgtgcccctctgaccacctgtagagcctgacctggctgccacagagacctcagagtgccagaagaaa

SEQ ID NO: 719493 - DNA, 422 bp, Homo sapiens
aaggttcaactttgtgagatgaatgaacacatcagaaataagtttctgagaatgtttctgatctagtttttatatgaaggtgtatccctttccaccataggcctcaaagcactccaaatattcacttgcagattctacaaaaggagtgtttcaaaactgctcaatcaaaggaaaatttcaactctgtgagttgaatacacacaacacaaagaagtttctgagaatgcttctgtctagttttcatttgatgatatttccttttccaccataggcctcagagcactccaaatatccacttgcagatcctacaaaaagagtgtttcaaaactgctctatcaagagaaaggttcagctctgtgagttgaattcactcatcacaaagaagtttcggagaatgcttttctctagtttttatgtgaagc

SEQ ID NO: 719494 - DNA, 148 bp, Homo sapiens
tcagacggtcctgctgatatttctggagtccgtttaaggttgtcaagtagccactgtttctctttaggccctatacaaaggcaagaaggaaagacaagatcataaatattaatggtgacaccactgtagtaataaattttcatatgcc

SEQ ID NO: 719495 - DNA, 447 bp, Homo sapiens
aatttccaagaacacttcatttattaagatattgtcttcatgcgaacttggtatcctgtttccatcccagccttctataacccagtaacatctttgttgaaaccagtgggtgagaaagacacctggtcaggaatgtggaccacgggccacctcgggctcgcccatggtgtcagactaaagacaaacaaggactctctgtataaggtactggtcgtgtgtgtgttagtggagatgaagcctgtgccctacagacagggagtcacacagacacttttctataatttcttacgtactttgaatgttcaagtataaagtctaatgttaaatttgattgaacaattgtatatttgtgggatattttggaatggaacaccaaaaaatggtaatagtggttctttctggattgaagacaaacttttcttttttaaaataaattttattttatat

SEQ ID NO: 719496 - DNA, 257 bp, Homo sapiens
  misc_feature (4)..(4): n is a, c, g, or t
  misc_feature (187)..(187): n is a, c, g, or t
agantaagtaaggccaaaagtagatttgttgaagacaatattgtctgccaagactaaggaaaaaaaaaggtctatataaataatatcaaaaatgaaaaagacaactacagatgctatagagattttagaaagggcaccatgaataactttatgtcaattaattttaaaactcacacaaaatggacancttcttagaaaaatttatttattaaatttattcaactaaatagaaatccagggcaaaactgtaaaatgtg

SEQ ID NO: 719497 - DNA, 722 bp, Homo sapiens
  misc_feature (276)..(276): n is a, c, g, or t
tgccttcagcctttaaattctccatgcattggccagatcttggcccattagactttagtgagacgcaaccatgggtatatataatgacccttttgtggaacacgtagtttatagacgagtatactctacagggaatttgcccgaagaccctgttactgattggcaccacgttgtgcgtcaccataccaaccttgttcataggaccatgacctgccttcccacacctctcaacgtctgagccgcgttagtagtgaatgtataagagaagtatccaanccggaactcccgtgctttgttaatgtctttaattaagctggccccgttctcacgggacactcttaaccacgatggccacaaaaaaccaaaactttttttccaactcctatgagtggccaactgaagttcttaattgttgggagaagaacacctagtcctacctctgcccctaatgaggtgtttggaggaggtaccacgccactattatagggggtgtaatgtgtgaattttgtttaaaactctactgtatattgaaatgagaattcactttatttgtcttgacacaatgttccaatgatgtagacttgtcttagaatggatattcataagtactcaggacttttaagatgccgatgccccccctgaggagctataattcctaatgtgtattgtattcccaccccattttactgggactattgaataaatcttttattttttttcca

SEQ ID NO: 719498 - DNA, 127 bp, Homo sapiens
ccgaaggacaagagctggactggaggcccctggagccagatggaatgagggtgacagatcacttttctgtgtgtactctgtccagttcctttagaaaaacatgggtgctcagaggactcccaaccct

SEQ ID NO: 719499 - DNA, 810 bp, Homo sapiens
ctttttcttattacccataaaaatgggtgagctgctaggtttctctgtctacgcctcccgagaaaagaaaggcatagttataggaaactggaaagataatgagtggccccgtgaaaggatcattcagtattatgggcctgccacatgggcacaagatggctcatggggataccgaacccatctacatgctcaattggatcatacggttgcaggccatcttagaaataatttctaatgaaactggcagagctttgactgttttagcttggcaagaaacccaaatgaggaatgctatctatcagaatagactggccttagactacttgctagtagctgaaggaggagtttgtagaaaatttaacttaaccaattgctgcctacaaataaatgatcaaggacaggtggttaaaaacatagtcagggacatgacaaaggtggcacatgtgcctgtacaggtttggcacgagtttaatcctgagtctttatttgaaaaatggtttccagctataagaggatttaaaaccctcattgtaggtgtattgctagtgataggaacttgcttgctgctcccctgtgtattacccttgctttttcaaatgatcaaaggtttgtagctactttggttcatcagaaaacttcagcacacgtgtgttatataaatcactatcgctctatctcacaaatagactcaaaaagtaccagatgagagtgagaactcccactaaaaagtgaaaatgctcaaaggggggaaataacgtatgagaccaccactttctcctggtgtccttcccagtttctcccaaactccca

SEQ ID NO: 719500 - DNA, 1563 bp, Homo sapiens
gtcctctgccagtctcgctccgaggtccccgcgccagagactgcaagccggcgctcccagcacgccactattccaccgcgccctcgttcgcctcttctcctgggagccagtccgcgccaccgctgccgcccaggccatcgccaccctccgaagcatgtccaccaggtccgtgtcctcgtcctcctaccgcaggatgttcggcggcccggagcaccgagagccggacgagactccagccggagctacagtgacgtacgtccacccgcagcctacagcctgggcgagcgcgcatgcgcaccagaaccagccgcagactctacgcctcgtccccgggcggcgtgtatgccacgcgctcctctgccgtgcgccatgaggagcagcagaggcccggaggtgcgcgatcctgcaggactcggaggactacatcacaggccgacgccatcaacaaccgagtccaagcaacacccggaccaacgaaaggcccactgcaagagcggaatgacggctcgcccataaatccaccaggagcgcaactggaagcagcagaaaaggacctgagggccgaagctcaaacaaggcaacggccaaggcagcgcgccggcggacccgctacgagcaggaacgggaagcgccacgcagggccggcacacgcaatccgcacggggacacaaccggacagaatacgggcccgcaaaccggagaatcgcaacagacacacgaatccgatcacaccggcaccacaagacgacaacgcacaagaccaaaacatacgttgctgtctctttgcgcctcggcgtgcgcttgcgtctccgaggcacgaaaagacgacaaccaaacgagcaacagacacaagaaagaaagaaacaagagaacaacaagacaacacaagtgacgcagacaacaacacgaaagaaagaacgaaagacaaaagaaccagagccagccaacgcacaacgaaagaagaaccagacaaaacaagcgaggagcgccgcagggagcgaccacacccggcgagacacgagggagaaccgaggacgcggaggggaccgaacgagccggagaccccgaggcccaccgcgaggggaggaagaagaaggaggagaagcaagcagaacacccacacgggcgagacgacgaaggcgacacaggcaacgacaaggagcaagacaagagacgacaggggacagggtgaagaagcagaaacaggaagcagaacagagcaccgagcgcagcgaagtgaagacagaaagaacgaggaggagagaaggacagaagcgaaggggagcacaaggaaggccgcgccgaggggcgacgggcaaggggaagaagagactcagaagaaagacagaggagcgaagcaagaagagaagaagaggaagagcgcaaaacgggcagcaacgcaagaaagcgggacggccacagagcacacacgaacgcagagcaagagcggcaaggagacgacagcacagaagccgcagcaagagagagagaaacacacagccaagcagcgaagaaagcgagagaataagagggcatggaaaagacagaacagaagaagcagag

SEQ ID NO: 719501 - DNA, 90 bp, Homo sapiens
gagacagggcctctgtctgttggccgggctgaagtgcagtggcgccatctcggctcagtgcatgcaacctcccccttctgtcgtcttctc

SEQ ID NO: 719502 - DNA, 107 bp, Homo sapiens
ctgtgttgaactgttcaggaagtggatttaaggaggctcctctgtatctcaaagtagcggattctggagtcaccctgtttgggaggggcgctcagcaccagcacggt

SEQ ID NO: 719503 - DNA, 168 bp, Homo sapiens
agcgtagattgcgtagatttggacctgggatcaattggtcatagctatctcgtagcacgctggttgtgtacaaagttgtatgatgttagacagttaatagaatagaaatttttaaatagccttgttcctcatcaagtgactctgtagcctcttttatttttccttttt

SEQ ID NO: 719504 - DNA, 665 bp, Homo sapiens
gacggccctgagtggagggaggggagggaggggagggaggggaggtgagccgtagcctcccagcgcggctcatgctggtgcctttttgagctccttgtgcacgctctcgcaccggtgggaacggccgcgcgcgtccgctgaaggtggtcatcctgccggctgcctccgggccatcaccaatggagcagctggatggagcaggtgcgcccgcatggaagcaacatcgacgtacttcgaggttcgttcgacgtgctaccatgagtcattattcctcatctcatattcaagtagcttactattaattcttagggaatccttgattgatcatccgttcattcttagagatcgtctttgattggactatgatctgtccttgacacgtcaaaggctctagaagtatcctgcaggtggtagagtttgctgccattccagcaagatagcccaagaatgaagctgagtagacaagagatgccaatgacttggaagacgattgcagatgatccaaaaatataaggaagttaatttagaaatctagtgagtggaggaagagtaagaacattgagcaaacctgagactctggatgggggagatggacggcgaagacgagtagagactcatagatagaagaaccacagcatacttatgagaatatattaaatatagaa

SEQ ID NO: 719505 - DNA, 232 bp, Homo sapiens
tacagtccgcctatgttcggagtctgtcgtcatggaggctgtggataatggatccggagcatatgaatagtatgcttgaagaaagcgtgcatgcagatgtgaagaaatgctaggtggggttggttgatgccgatggtcactattatcaagcctagtgggctggaagttgagaaggctacgattttttggatatcatttggtgtgattgcacatagggctgtatttaaggtgg

SEQ ID NO: 719506 - DNA, 243 bp, Homo sapiens
ctgagtgggtcccagcgttatccctgagcctgacctcctcccagcgttatccctgagcctgagttcctcccagcgttatccctgagcctgagttcctcccagcgttatccctgagcctgagttcctcccagcgttatccctgagcctgagttcctcccagcggtatccctgagcctgagttcctcccagcgttatccctgagcctgagttcttcccagcggtttccctgagcctgagttcctc

SEQ ID NO: 719507 - DNA, 1013 bp, Homo sapiens
gggagtctcctcccttttggtccgctgcaggcccgcaggcccgagtgtcgccgccatggttcgcggagtctgccgcgcgctggtgtcggcgcaatgggtggcggaggcgctggggccccggcgctgggaagcctctgcaggcttgtggacgcctcctggttaccatggccgaaagttggggggcgcgacgcgggaaggccggagttcagaagggaggggccaacatcccagggggggccggttattctttcgaaattgcgcacccagtggcaaggcgacccggaacttcgccttaaggaaccaatttgtctgcccaggtgggcacagaaggacatttggggggggagtaacacacaaggccgctctggtgtgttggggcacggcggccacccaaggtggtgaatataagcgacgggccgagaggaccagggggcctcatactcccgggcccgcgcggtgtttatggagagaatgggtccggagctattgcggcccaacaacgcctggtgttcaattggcatatgatgcggggcctcccggacatgtgggttggggcgccagaaaccatttcgcgggatacagttcggggaaaagacgcaatggtggctcacagcaagagatacacggcagcataagtacgggacccgggtatttagaaaaaagactaacgaaggacattacagcgaaaacttggaaaccgcgcgcgcctacaagcgggtgagaaccaccagagcaatggggcaacgttaccggaggaacgaaccccgaacccccagaaaagagtatgaacgctggccaattccaggacggagaatcccttaaaagatttcttaacacaggggtctgggaaaaacatagagagaccgcattagcaagaaacaagggccggtaaccagtggcgcgtgtggcttgctgaaaccacgggaaggcgaccttgggaacaaacgaccatcacagacgggaggaaacgccacagagaaataaggggacaaccggacagcgcgacccaattg

SEQ ID NO: 719508 - DNA, 806 bp, Homo sapiens
  misc_feature (707)..(707): n is a, c, g, or t
  misc_feature (768)..(768): n is a, c, g, or t
agatgaccctactgctgagtgataccagtgtcttgctgttactgaagaaatgtccaccccgttggaaggagatgacggacactatcacgcatggaagaagtagactaatctctggctgagggatgacttacctgttcagtactctcacaagttcctctgataatatattttcaaggatgtttttcttgtattttggttaatattaaaaagtctgtatggcatgaccactactttaaggggaagataagatttctgtctactaagtgatgctgtgataccttaggcccttaaaccagagctagtaatgctttttgagtttcatgttggtttaattttcaccagattggggtaacgtgccctgtaagacgtatgtaacactgatgttaactttgtgtggtctaaagtgtttagctgtccagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttccaaaataactcagacccngtcttgtggatggaaatgtagtgctcgagtcaccttctgcttaaagttgtaaccaataccngatgagtttaaagaaaaaaatagaaaaaaaaactcgac

SEQ ID NO: 719509 - DNA, 803 bp, Homo sapiens
  misc_feature (707)..(707): n is a, c, g, or t
agatgaccctactgctgagtgataccagtgtcttgctgttactgaagaaatgtccaccccgttggaaggagatgacggacactatcacgcatggaagaagtagactaatctctggctgagggatgacttacctgttcagtactctcacaagttcctctgataatatattttcaaggatgtttttcttgtattttggttaatattaaaaagtctgtatggcatgaccactactttaaggggaagataagatttctgtctactaagtgatgctgtgataccttaggcccttaaaccagagctagtaatgctttttgagtttcatgttggtttaattttcaccagattggggtaacgtgccctgtaagacgtatgtaacactgatgttaactttgtgtggtctaaagtgtttagctgtccagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttccaaaataactcagacccngtcttgtggatggaaatgtagtgctcgagtcacattgacgccttatagttgtagcaatacagacgagtctcgctcgctcggggggtgcgggcgcgc

SEQ ID NO: 719510 - DNA, 193 bp, Homo sapiens
aagatacaacagacacctatgcatgaaacaaggatagacgagacatataaacgactggaccgccggataccattgcgccgtgactacaccctacgggacttcggcatacggaccgggcgtggccagtggcacgttccgctatggctattccgataacctgactctggagagccacgctgaagcctccagcgaa

SEQ ID NO: 719511 - DNA, 784 bp, Homo sapiens
  misc_feature (779)..(779): n is a, c, g, or t
  misc_feature (784)..(784): n is a, c, g, or t
agatgaccctactgctgagtgataccagtgtcttgctgttactgaagaaatgtccaccccgttggaaggagatgacggacactatcacgcatggaagaagtagactaatctctggctgagggatgacttacctgttcagtactctcacaagttcctctgataatatattttcaaggatgtttttcttgtattttggttaatattaaaaagtctgtatggcatgaccactactttaaggggaagataagatttctgtctactaagtgatgctgtgataccttaggcccttaaaccagagctagtaatgctttttgagtttcatgttggtttaattttcaccagattggggtaacgtgccctgtaagacgtatgtaacactgatgttaactttgtgtggtctaaagtgtttagctgtccagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaagaaccacatcaggccccagtcctgtgagatgtagatcgagcgcccgcagtgacagtccgcgtagacatcgaaaggaagacagatgcgnccagn

SEQ ID NO: 719512 - DNA, 110 bp, Homo sapiens
tatgtggattacatgtgaaccctaatccaatgctattgaaacttctaaaactaggaaataatcaggagagaatctattcatgcactagttggatacagctaaattcttta

SEQ ID NO: 719513 - DNA, 135 bp, Homo sapiens
tacaactgatctataacatgttttctcaatcaggctttagtgactcctccagcttcaagtggccttcactactcagaaaccaatactacctcttttgctttcttcgttcttcttctatcttcttgagtggtatca

SEQ ID NO: 719514 - DNA, 867 bp, Homo sapiens
agatgaccctactgctgagtgataccagtgtcttgctgttactgaagaaatgtccaccccgttggaaggagatgacggacactatcacgcatggaagaagtagactaatctctggctgagggatgacttacctgttcagtactctcacaagttcctctgataatatattttcaaggatgtttttcttgtattttggttaatattaaaaagtctgtatggcatgaccactactttaaggggaagataagatttctgtctactaagtgatgctgtgataccttaggcccttaaaccagagctagtaatgctttttgagtttcatgttggtttaattttcaccagattggggtaacgtgccctgtaagacgtatgtaacactgatgttaactttgtgtggtctaaagtgtttagctgtccagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttgtaactggccagttacaacagctcctagtaggaggtgccagtttgtcagagacatttatattggaaatcgccacgtgatagtgtgtgatcctctctatacaagaggagggtatcaatggagaaaccaactcaatcaatagacttcaatcagcatgataataaccccagctgtgtactgg

SEQ ID NO: 719515 - DNA, 287 bp, Homo sapiens
tgggtggatcaccagaggtcaggagttcaagaccagcctggctaacatggcgtaaccctgtctctactaaaaatacaagaatcagcgaggcgtggtggtgtgtgcctgtggtcccagctacttgggaggccgaggcatgagaaacgcttgaacctgggaggcggaggtagcagtgagccaagatggcaccactgcactccagcctaggcgacagaacaggaccctgtctcaccaataaatgaataaaaactacaatcatttgagggataaaaatctagccttcaact

SEQ ID NO: 719516 - DNA, 584 bp, Homo sapiens
actacatacttccgaggggaggagtcctgtgtatagatgccgttcgtttctggcagacccctgacccctgcgtgcaccctgtgccatgcagtgacctgagccaccgctcaccgcaggtgtgacagcgtttgcagtttgaatctaatgaaattaattgcctgctaagtagaaacattgattctcttcagaggaatatcacagaattccagtgtcttcacaatgtaacgtttgcaatgtacagggtacagttcaaaatcactcaacatatgaagagccaggaaaatgtgagccattctcgaagggaaagacaacagatatcaattgtgttatgacctagctgttggaatagtcaaaaaagcactttggagcaggtttagtgtctgtgctcagtgaagaaaagggaaatgcacgcataatgaacaaagtgccggaaatctcagcgaggaaacatgtttaaatgagccactgtgcttggccaagatctgaaattttaaaattcactgaatgaacataacagaagggaaataacagagaaaataggcagagtcctcaaagacagaggaatacaaatcatccaagctgga

SEQ ID NO: 719517 - DNA, 273 bp, Homo sapiens
gcaatctcctgcctcagtctctgagtagctggtattacaggcacgtgccaccacacctggctaatcttttgtattttctaggagagacgaggtgggaacgtgttggccagtgctggtctcaaactcctggcctcaagtgatccacctgccttggcctcccaaagttctgggattacaggcgtgagccactgcacctgtcctggattgtgatcttgaagtgataggaacacgtgtgtcgtggggttcgtttgtctttggtggctttggctcata

SEQ ID NO: 719518 - DNA, 245 bp, Homo sapiens
acagtaggtggagtgagtaagcgtaacgcctcagtcgctacgtctagccaggcttgtcactgatgtctcgctgcatagcgctcagtcctcatctcactcaagccggccgtgttggtgcactgcagatccaccctgtggaaacattacatctgcaatatcttaatcctagcgtcagtgaagctcatcacaagacatgggggttaaattatgttgagttcttcttggaccaaaccgtgttttgatct

SEQ ID NO: 719519 - DNA, 624 bp, Homo sapiens
tgtcccgaagactgagtacccttcctaaggcgattaattgtccgcatacgtctattacacatgatgataatgtgtagccacactaatatctgagtctaagtccgacataggctagtgatcatatgtaaccctccctcgcgacaaaatcaatggaaagaggaacgaccgccagacaacagaacccgtgtcagggtgcgcaagagctcgcggcggggagcagaggactaccagaaatgcggaatccacccctactgcaagacagggtcttagcaacctgggtcagaatggtggcaggggagcgatcgacattcgtctcaggatagccctactggccctacctcagagctgaaacttaaaaagcagtgttgtgcacaccagttatctacctcgagctcataaaaattctatgactgaatacctccctgggactcaagacacctcccgagtgtttgggcacacccctgggaggcgggagcgcataaaatctcaagagagtcccgagtgtgtggccggccccttccacccacagcggatgataatctaagacactcccgaagtgtgccactccccttcaacctcaaggatgaaatctcagacactctgagtgttgctcatcccttcact

SEQ ID NO: 719520 - DNA, 620 bp, Homo sapiens
  misc_feature (606)..(606): n is a, c, g, or t
agctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcgacaccagcctgggcaacatggcgaagccccatgtntagaaaaaaaagaa

SEQ ID NO: 719521 - DNA, 144 bp, Homo sapiens
gtgggcgtctagaggatccctataagtagtaccaacactagcattagtacacgactattacttaaacacacacatacacacatacacacattcagtgattctggtgctataagtgagaagcacgaatgtgtgtatgtgtgtatg

SEQ ID NO: 719522 - DNA, 981 bp, Homo sapiens
ggcgagtgtcgcgtctgcagtgtgtggggttcgcggggcggggggtagagttgagcatttctgtcatctgcacaataattttagccaggtggcacgtgtctggcctgtggagtaagacagtacctgcctcttgcctctgacgtagggttctggcctatcaggaaccaagacattttcagtaatggaagaaggagcttccagagctggggaagatcatcatttccagtggtcagcttgaccctgagcatgcatacctgcacaccaacttcatgggaagagcccagaatagacagaagagagagaacatactagagataagctagcccctaagagttgaacgacaatgggccacggaccagctgacacataccaggaaccacatgaaaaatgccacagaagtacatgtctgtgcggagaagagcaaaggaagaacatacacggggaggggctcatagacacatacgacagaatgatggcaagatgaggcatacaaccacgggaacgacgctgacaagaaaaacgggacccagatccaccagacagagtctagatacaaacggacagataaaagatatggaagaaacatacaaatcaacaccatacagaacatcacacatcaggagggcaaatcggaaggggcacaccaacaggaccaggaaaaaacagcgttcctataccaccacgataaggagaagcacaaaagagggacagcaaaaaacagccacacgactgggacatagaggcaaagacaacaggggaaagaccacggccccaaccaaacgacccaagaaaatctgggagcgccaaggggtatacagtcgggccagttccacaaggaacaggtagacgaaagagcactaactaggacaacaagacaaacacaacggcacatgaacggtagaaaatagacagctaagaggaggaggaaaataataggaagcgaaacaacaagagacgagggcaaccacacatgaatacgat

SEQ ID NO: 719523 - DNA, 347 bp, Homo sapiens
agctcccgtagctccgagctgctaggggaggcagctctaaacacggtactccacgaagatgacatattgcactcacaagatatgtttaacgaagatggtcttaatgacagcacatcttcaataccagcgagcttgccccctccatgaactatatgctgcagaatcattatacctgggctgctttcatggactctgtgcttcagcactttgctgtgggggccacagtgggagtgaaggtgggggcgcccaaggatgactttctcgaaggcgcagatgcctgagactacacaagaattgggggtcgatgagtcatgagcggacaccaccctctatggacctcccctgtc

SEQ ID NO: 719524 - DNA, 262 bp, Homo sapiens
ggtgaatttcagttctgggctcggcacacagagtcactttttcctcctgggattccaggctgcaatgggaggaacttccacaaaagtctctgacatgccctggagacattttcttcattgtcttggtgattaacatttggctccttgttacttatggaaatttctgcagtgggcttgaatttctcctcagaaaatgggattttcttttctattgcattgtcaggctgcaaattttccagacttttttgctgttttcctttgg

SEQ ID NO: 719525 - DNA, 555 bp, Homo sapiens
  misc_feature (291)..(291): n is a, c, g, or t
tgcaaatctggcagcccccgagaggggtttggaaccttagcacccaagtctaagtcaacttgcatagtgtgaacatggctacgcctcgttcattccgcgtccatgccgagccccctgatgcagcattcaaaggccgcacggaggttgagccgggcacagaaactacaggcaagcggtgaggcagccaatcaccagcactgccaacagacgagctcatcgtgcgcccttgtgtttgagaacgcttaaaagttctgattccacctagggagaccatggacctggcaccccggntacacaacacttggtgtgctcaagaaagcaaagcacacatcaagaaacttgacagaagcgtggcaaacgaaataagccaagtaccaagctcgagaattgggaacgagaacagagatttttaaagtggcgactggaacagctgcagggtcctcaggagatggaacgaatacgaatggacagcattggatcaactatttctttccagaaatttcggatacctggaatttccagaagcgaagaaggagcattgcaagtggatgttga

SEQ ID NO: 719526 - DNA, 232 bp, Homo sapiens
gacggtggtacccagtgacgtcgactcgagtactggacggatccgtctagatcagcaggactccagatatactgatattatggcggtcagcacggtgctcactgtgtcgagggaacttgtacagggaggcatgcaccgaagtgtgaatacacgtcgaccaggctccaggtaaccgatatttggaggtcagcactggtgctcacgtgtcgacggaacttgtccagggcggcat

SEQ ID NO: 719527 - DNA, 248 bp, Homo sapiens
cattaccatccgacgtgatgagcattatccgcgtttatggagttgtattgcataccccttgtagaatgggcacatgtgtaggtgacccctgtaaggggaggtcatcactgatgcccagtgtactggccagagtcgtacatggatatgcacagccttggatagcaacgtacattgctggggtgttgaaggtctcaaacataatctgggtcatctactcgcggttggccttggggttcaggggggcctcg

SEQ ID NO: 719528 - DNA, 440 bp, Homo sapiens
  misc_feature (353)..(353): n is a, c, g, or t
aaaagttgctaggttgctgtgaggaaattcgcaccattgcactccagcctgggtgaaaagagcaaaactctgtctcaaaaaaaaaaacccaccaaaaactgcttctgaatggaattgtacatacaattttgatgaaaaaaattatcaagtgcataagttcataatagaaaaaccaataatactccaggcacaagttagtactaaaaaaaatatgttgaatattctctaatacaacatgctttttcccttcatgaacaatttgtgttttactgaggaagagtcattgtttatgggtaggacattaggaccacagatgaatatgtacttttaaacactcttaggttactttcttnaatttttattatctggctggctttccatggcttctgttttatttttccattctttcccaatggtccccattctaggtaaatttggaa

SEQ ID NO: 719529 - DNA, 298 bp, Homo sapiens
cctaacgtggaatcgcgccgaatataagacaagacgccatcaaacttctggaagagaatgtaggcaaaacactctctgacatcaaccttacaaatgttttcgcaggtcagtctcccaaagtagcagaaataaaagcaaaaataaatcaatgagacctaatcaaactgacaagcttttgcacattaaaggaagccaaaaataaaacaaaaagacaacttagaaatgggagaagatagtttcaaataatgcaactgacaagggcttaatctctagaatatgcaagcaacttatacacctc

SEQ ID NO: 719530 - DNA, 727 bp, Homo sapiens
agcgttcaaaatatttgatttttaaggtttcaactcagaacaaacgattgccgagtttttgtttgtattttaaagagatggggtctcgctatattgcccaggctgtactccaactcctgagctcaaactgtcctcttgcctcagcttcccaagtagctgggactagtcttgggcaaccacacccagctctgcagagtattttttttttctgaaacgtactgtcaagtaatattaacttgaatttcacccttttttcttaaataaacggttgcttaaaaatctctattagtagatgaagtgatttcccccctcctgttttgtttttttttttcttaagagatggagtcttgctttgtttcccgggctgatctggaactcctggcctcaaggcattctccctactagctggaactacaggcggttgccaccagcaaggctcattctcgacattgtttttgtcttaactagcttttgcatttgtaatattttgaaagcagtacacaagttatttttccctcctttttaaagatcaaagagatgaaaatttaatttttcaaaggaaagtaagaatgagttctgttgtatttttactgaaatattcttgaaagacactgttttatggatagatgagacgtaagagaaagtaaaggaattaacatttattgagttcttttttcaggtattgtgttaaatgctttacatatattaaaaacatttgaatctgaaa

SEQ ID NO: 719531 - DNA, 459 bp, Homo sapiens
  misc_feature (1)..(1): n is a, c, g, or t
  misc_feature (137)..(137): n is a, c, g, or t
  misc_feature (187)..(187): n is a, c, g, or t
  misc_feature (225)..(225): n is a, c, g, or t
  misc_feature (255)..(255): n is a, c, g, or t
  misc_feature (265)..(265): n is a, c, g, or t
  misc_feature (290)..(290): n is a, c, g, or t
  misc_feature (317)..(317): n is a, c, g, or t
  misc_feature (343)..(343): n is a, c, g, or t
ngggaacatacatgacttagagtgaaaataattctagaaaggtttcactgggtgggtgtgcgggttcttgttctggcactgcttctttcggtgcgtggggcttcatgtattttgcggtgttcttggcctcggtgtcngccacctgttttttggccgggcgggtttgggtgtgtccggatggtttggngcgggggggtggcggtccctgtgtgtttggtccgggcnttggggggcggttcgggtttgggggttgtngggcttggcnggtttccgtgcggccggtggggggntttgcccgtcgtttggcggtgggggtncccccccgctgggtttgcgggtcaancgttgggtttggtgtctgttcgtgtgtgtgtgtgtgtgcttgtggtgggttgggcctgcctttcgtcttttctttggcccccctccctgtttcccacccctttccctcgggttttc

SEQ ID NO: 719532 - DNA, 1863 bp, Homo sapiens
  misc_feature (655)..(655): n is a, c, g, or t
tatcctactcgagtaacgggattctattcttgtagcgatgcggacagaacattagacacagactgcgaaatctcgaacgggactccgagacgccgttccgtagagcagggtcaagcgaaatggcgccataccacgtctaacccgtatgatcgtcagccagaggacgagagcaggttctctctcatgaatgtttctcatttgtgacgctggagattacctcgtgctttgtctgtatcacatcacacatacacaataccaacgagaacatacgcacagcacagacagagacgagagacagacgagagcgctctgagagagatactttgcgacgctggtggtctaccctcacgcgccgccaagaacatacacacacgcttgtgcccttactctagagaacctggtgtgcgcaacagaggtgtgggcgagtggtggcagcggcgacacgagagaacatactctctatcacgaccaggagttgctcgacacaactactagaagatcctctgtgttcgtctctcctccggtactacaatagcaccagcaggattactcagccacaagcagccctgtaggcaccccgcttagttcataccactagcaccatcagtcttcttcctcaagtcgtccgtcatcctggttgcggcgtccaccaccngccagctagttggacggaactgatacgaacaacagtgtcgtctcttcttgttcccgttgcttcaacactacccatggcccgcggcgctcaccaccaatctcttgctcttgttgcaacaacgaccaacaatcacagcgacaaacaccaccgacaacaggaccactactaccttcttcctgccgatggactacggactcggtggcgattcacacgaacacaatcgcgcaggatcgcaacaaacacttacacccacattctcgagcacccacgcaatgccggcggcgctcgtcgagcgctatccaacaaccggctccctgtacggacgggttctagccaccagcaagggaggtcttccactcatggaatagcatcgtcgcttactccacacacaagcgacgcaccaccaacgttcctcctcttcgatcacacacgcaccaaacacctctttgttggtcggagaacaaataggcctcctttcatcctcagtatactagttactctatagatactcgcgcccactccatgacgcagcctgcacaccaccggtggctgtactcttcctccttcgacggggcgcgccccatccataaccgcccgctggtgcaccgctcgcgttgtgttgtctcatgtgtcttaccccccccgctcctggccattactaggtgtactcggcctgatttcaacccacctatggccgaaccaccccgcccgcgtacgatactccggcccccgccgctagctggggcccattctttccggggcgcacggccctcttgctgcggcaaggcacccgccccctcacacacgcgatcagacccgcctcaaccgcgccttgcactcgcgcgcacaacagcgacaccctggcacacgcagtgccctcgccgaatgcctggacgctaccccccacgccacacaacgcaaccatcctccaccctcccacccgggaccacacccgaaccaccgcacctctcctgacagcagacacacgcccgcgcgactacaatcggccccgctcggcgaagcacccccaccgcggcgcgaccgccgacaacatcaaaacaccgcgcgacctccggccgacccgacgatagcagaccgcggccaccagcaccgactccgcaccaccacagccggacccccgagcgccacaacgtagtcggggccaaacaaccacaacacacacgacagcgaccaaccacaacagggcc

SEQ ID NO: 719533 - DNA, 1531 bp, Homo sapiens
  misc_feature (1404)..(1404): n is a, c, g, or t
cgataggttcgttgtttctgcggtgtgggtgacgacgcgcactgtgggtgtggtggtcggcggcgttgtgtggttgggcagccgtggtgggcgacctgtggggggcgttcgtcgctgtggggtgtgggtgcgtctgtgttgacagccgaagtgtgttggcgatgcgtggtcgggttgtgccgtcacgatgacatcgtggtcccctcacatagttggtgcgcgacggcccatgctggtgtgttgccctgcgtgtttgttggttcactgcagtcgaggtgagatgcgcggtcgtgctttgttcgcttcgtaggtgtgtttctctccgtcgtccccatcctttggtgggggccccccgctctgggtcgggctccccttgttgagggagaacggcccccgtgcggggccctcaaccatggggcgaaccgtgtcaccctttccaccgggggagaaccgccggggggtttgaacacgcccaggggggtgggggggcctccttgtcaagtcaggtgcggggggtcgcagcatcttgttctgtctcagtcgcgcggtattttcctagtcctggtcctggcctagcatgccggcaacatgggcgctctggggtgggtttccggggccaagttggtgtgtaaaagggtgggtttggtgttgttataagagaagcggtgcgcaaggggtggggggcccccaaccacctgggtggggattcacggccgcgagactcccggtttatatagtggagggggccccgctgcacgggatctgtcttttgcgaggggggggggccacggtaaggaagtaatgagggataaaaggggagggggccgcgagaaattgtctcccacccctcagtcaccaacagcctcgtgtgagcccacttgaggccacgcaaagtcgtgtccctctcggggaaaacgtcccaccttggggttgggaatgtggcctctcccgtgtcaccacgccccctctggggagaggggggccccaggcacacctcctcccagagaggaggctttgcacaagcgccctgtggcctcggcctcgggtaacactgggcccctctgcttgtccacacgtgggctgtgcgccaccgcttgaaccacacccgcaccacattcccccaaaccccacccggcgccccctgtggagacccacacccaccccccgcgagggagggagacccgcgcccccgcaagaggcctacggcaccacaccctccgagagttttctgcggggccccagaaggatcttataggaggagaagcacccgaaggagccccccgcagaagcaccccgcccccgggccccaagcctgtgccaccctcgtgataagcaagcctcggggcctcccacactctctggcccgaaggaaagggcccccaggcacagaccacgcctcgggcncttctaaccacgccactttgtcccgagacttgaacttcgtgtcccttccattggtaaatgcgttttttatagaaactcccataatatttcctttccttttaaaaaatatttgttttaaactttaata

SEQ ID NO: 719534 - DNA, 101 bp, Homo sapiens
aatgcccgtggatagggagtttgtttgggcctttgttgtaatagacctcctagatagttccattttttctattcattaacgtgccctgggaatccaaaggc

SEQ ID NO: 719535 - DNA, 555 bp, Homo sapiens
tcacggattactcaaactcctggtgctcaaaccattctccgtgccgttatccttctaaagcactgggatcacagattagagtcgctgtttgggaaaaccctttgggttttaagacagtttccatgtgattaagtgaacaataatctatttctacttgttttatgaacaattttatcaaatattattctagaacctgtagagatactcatatgattttttttcatctattaatatcagaaattatgacttactaagccattctcgtatctggtttgaatcacacctggtcacttgggtttattcttttaatgtgctagattctatctgttaacatttttcacttagaattctttgccccatattcatgtgatagtccaatcattctattttgtctttattctatttttgtcagtactctgcatcactgttagcctagcttgctaaaaagaatttggaagctttccctgtgctctgagacattaaatagtacagattgagtatcctttatcctaagtgcttgggaccagaagtgtttcaagatttttttggattttg

SEQ ID NO: 719536 - DNA, 264 bp, Homo sapiens
gagtaatggatgagtgtggctagcacagagctgcgggtcagcccctcagtgagagggagttgctggtcgaggtgcaggtgctgaggcatgagaaacccagaccgcccagaggccacactgtcaacatcgcccagtctggccccggttgaagacatgcagtttcctagggactgggtctctttaacctagttctttggaaccccaggggtacccaccataattgtgtcgtggacactacagcaggtattttgcaacgagaaatcg

SEQ ID NO: 719537 - DNA, 222 bp, Homo sapiens
aagaggtcccccgtcacattggcatatgaggagcgggcagggcagagaagaggagacacgggtctggcagcaacagcttctactaccagccctgggggcactcaccccggtgatcaagcaatcatggtcaatgacaaagtgactatggaagttataatggtattaaattaaggctaataattgggatatttaatttaatggggggcggctcgggtaacttta

SEQ ID NO: 719538 - DNA, 233 bp, Homo sapiens
cggaccactcggagagtgcagggtggtggtcactcctgtgatcctagcactttgggaggcaaggctggtggatcacttgaggccaggaagaccagcctgggcaacatggcaaaaacccatctctacagaaaacacaaaaacagctgcatgcaccttatagtcctcaggaggctgaggtgggaggattgcttgagcccaggaggttgaagctgtggtgagccgaaatttcagca

SEQ ID NO: 719539 - DNA, 200 bp, Homo sapiens
ccagaacacaggtgtcgtgaaatctacccctaaaaggccaaaattgggaagggaaagactcatatcaacaatttggtaattggcacgtagattcgggcaagtcccacacttcttgccatcttatctattaattcggtggcatcgacaaaaggacccttgataaattttagaaggaggcttcttagataggaaagggctcc

SEQ ID NO: 719540 - DNA, 349 bp, Homo sapiens
  misc_feature (2)..(2): n is a, c, g, or t
  misc_feature (12)..(12): n is a, c, g, or t
  misc_feature (51)..(51): n is a, c, g, or t
  misc_feature (93)..(93): n is a, c, g, or t
  misc_feature (98)..(98): n is a, c, g, or t
  misc_feature (110)..(110): n is a, c, g, or t
  misc_feature (199)..(199): n is a, c, g, or t
  misc_feature (206)..(206): n is a, c, g, or t
  misc_feature (286)..(286): n is a, c, g, or t
  misc_feature (300)..(300): n is a, c, g, or t
gntcctcatggnctcagtcctggtcctcagtagctctcgtttctgtgtggnccttgcatggaatggaactgtgcctagcattccttccctttntgatnttcagttgcatntacgtgacagtggggttctcagttctcctgcatatggaggtagtgtctgtgtgtgctctgtaaggcacgccagggatttccacagaacnaaaaacnaaaggttgcaaaggagaccaggatatacgaaacaaaatgactgagtatttcagagagagcgactgagttaattcacctantcattcattgaagnaaattaatggaacacctactttgtgccacatgctgtggtaggtgcaggg

SEQ ID NO: 719541 - DNA, 165 bp, Homo sapiens
tgggggggggggtttttaaaatcccccccccccccggggggggggggccaatgcccccccgggccggggcttttggtttttttccgggcctttggtttttttttttccccccaaatttttttttttgggggggggggccccctaaagtttttttttggggggcca

SEQ ID NO: 719542 - DNA, 98 bp, Homo sapiens
  misc_feature (94)..(94): n is a, c, g, or t
taatcctgatatcatctgcaagcgatcttctgttatttggtatttttaagattcgaacgccaatcttctggtggcttagtttaggaagtccccntacc

SEQ ID NO: 719543 - DNA, 1859 bp, Homo sapiens
  misc_feature (1)..(3): n is a, c, g, or t
  misc_feature (1844)..(1844): n is a, c, g, or t
nnntcgggggtcggcgtgcaccggctagtagtgttgttttcttctttgttgctgtgttctcgttgggttgtctgttactttgttctgtgttggtgtgtgtctgtttgtttcagttagtgtgtctgtgttgggttcttgcctgttgtgttttgcttggtgttagtttgttttgtcttctttgtttttcgctgttttttcttgttgcattctgtctttctttgtttgttttgtgttcctctgcgttttgattggtcgtcttctctattgttgtttgttttgttcgtagtagttgtgtccctcgtgcttcttcgtatgtggcggtgtgtgttgtggctttgacagatggttttgattgtgtgggcagtctaatatctttgctgcgtgtgtcgttgttttataggtcgtgaccgggtggctccgacgtatgttgttcggctgtggttggttgtggctgcagcttgtctcacgtgttgtggtggtgtgcttttccgttggtgtgttgatgtgacgtagttcacaactgtggtggggtatgtgtttctcacatcaggtgtgctgcctggagttttttttttcgcaggtgggtagtgacctctgtgtctacatgtgtcgtgtctgcacgtgtttccgtgagagagcttgttctcctccggtgggggctcctgaagggccatcatgcgtcgccttttctctttgttggtggggcccacacacagatgggggggtagttcaagtgctgctggtgatgtctttatgtttggtggggtgtttgtgctccgcccggtgggggattgtgagtttttatgaatgtttttctcgttgtgggttgcgtcacccgtgtgggtttctcccacatggagtgtacatcgttgttttctggggcgtcctctatattgttcttgctctccctctgtgcttgattgtcgggtggcttttatttggggcccaccccacaaatgtgggtgtgtggttacacagggggtgtgtgtgacactctttgggaggcccgtgtctcgcgctcggtgtcgccttatgctctggctgtgtccccctttgggagggaagcccccacgggggtgccctggttgtttttgtggtgtgtccgctggccccccgtggtgtgcgcaccgacgctggtgtttgtgccccccgcgtctttcttctgtgtgcccaacaggtctcggtggggtgctcgtctcttctgtgttctcccgttgtcacgtgtgcacatggcacccacaggggtcacacatgtgtggcccgcgtgtgttccacacaccacatctccacacaccctccagtttgtctgtagccacacacatggggaccacattttccggcgctccacctcaccgtctacgaggcccgttgtctgagatgaccacaacacactgtggtgacccacaccactggggccacttgcgggtctccttcgtccgtgtgtccacagccgtgtggttattagagaggggagattgtagtgagaatgtctcccttgtgttctgttgtgtgtttatggtgcacgtctggtccacatgcccacaggtgtgcgcgcccctgtctctgagcacgtctacccaccacgcgtcttgaggcacgcacttgtccgccggtcctgtcacggggtatatgtccgccccccgttcgtctcccacccacgtctcgtctccgttccgtccgttgaacgtgttggaactagaactggcctcgggcctgccccgctcagcgttatccctctggttccataattatttagatattttaattttttatttaatttattgaaataaaattaaattgagaaaaaaaaagaaataaaatacttcgagcatatagctcggggncgagaagagtatgta

SEQ ID NO: 719544 - DNA, 543 bp, Homo sapiens
  misc_feature (41)..(41): n is a, c, g, or t
tctgattcaacattgtgtttttttgagcaagggggaaatantaagtcacaccaaaaatttttatctggcataaagtataatagcaggatgaatcaaatttcatttcttctcttgcgcctactggcaaaagaatgtgccaaaaatagagaaagagggtaagatgatgggaaaaaacagactaggcggcgacataaatcatggggtccaactctacaacagggtatttaattaatatcaatttctgggatctaaaggggggacatggaatatggtttaaaacttaaacactcaataacattataaaccaaaaattcaaaccttttaaggggcctatatgggagaatcatattttaaaggggggaaaggggggcctaatactcttactgggttaaaacccatttaaaggcgaccataaagggggaggggggtttataaaaggtggtttaaaggtattagattttactcttccaaaaagctcatttaccataaatccttttttttggtcaacgggagggggttttcttcccattgggcccaggtgtg

SEQ ID NO: 719545 - DNA, 463 bp, Homo sapiens
gtcactctaagctgtgtggctttgacatcagttacttcatctctctaatcctctgcattaggtatttgattttatttacttatttatttatttattttttgagacagagtttcgctctttcacccatgctggagtgcagtggcgggatctcggctcactgcaacctccgccttcccgtgtcaagtgattctcctgcctcagcctcgcaaagtagctgggattacaggtgcccaccactacgcccagctaatttttgtatttttagtggagacggggtttcaccacgttggccaggctgctctcgaactcctgacctcgtgatctacccgcctcggcctgccaaaagtgctgggattacaggcgtgaagccaccgtgcccggcgggagtagggttatttaaatagactatctcaaatccttaaataatatgatgagagtggcatcgataaacacggggatctct

SEQ ID NO: 719546 - DNA, 98 bp, Homo sapiens
ggatttgctggtgcagtacaactaggcttaatagggacatgccttagtcacaagtaataaagtaaacacagaagctgcaaaaatccatcaccagagga

SEQ ID NO: 719547 - DNA, 878 bp, Homo sapiens
gcatttgaagaaaaaaaataagtctgtttgtcatatttaagtagcctgtggctatttttatactgatttgatatcatgtcttttcatagtcgtatttgtgccaccgtaaacataaaaaaaaaaaaagatttccaaaaggccgtttccagacccggggtttaaatagcagtcatggaattggtaagcttagtagttgcagaattggaacactagcgtggccctcagttatcttaccagggggaagttcctgttacaatgtgtggacttttctttcactatgtgtaagaaataccccaaacttgaaaagatggtttcggaccatatgcttgtatgtagaatattttggcagacgcagaaggattattgtagacgtggtggatataatttccagaagtcatatacattgtaagctacaatttggaggttgctttataaaccttagatattttttttaacttttaattcatagcatttgtaaaaataaaataccttgtggaaaagccctttttcacaatatccctaagctagggaagagggagggaataacacctcacgtgaaaagatggcctcccagtttctggaatgaaaagctaccggttggaaataaattaagtgtgtggtggcagattttgttatccccttattggggtaagggatatttaatcactgggcaggcgggagggaagggtagggttggctgattggagaaaccttacgggagtcccatataggttgagggaccttaaaaaagacaaggggggtagtgacccaaaaccacaggggctttgtgattaagagagcgtctagaaaaaaaatatatgtggggccagattaaaaggggcaggaaaagttcatagaagaagtgataaacgcgcaga

SEQ ID NO: 719548 - DNA, 124 bp, Homo sapiens
  misc_feature (42)..(42): n is a, c, g, or t
gataataggttttcaaatgtttcctcgtcacccaaaacagantaaatgtgcaaacatcgataaacaggggaaaaatcaacaagatcctgaacagttaaaatctcttcttcattctcatcctctt

SEQ ID NO: 719549 - DNA, 143 bp, Homo sapiens
  misc_feature (71)..(71): n is a, c, g, or t
tcaagccagcctcctgccacagcctctctagtagcggggtctacaggcacacaccataagtaagcctggcntatttatctttttttgtgtgtggtggagacaggatcttgctatgttgtccaggctggtcttgaattcctgag

SEQ ID NO: 719550 - DNA, 695 bp, Homo sapiens
  misc_feature (323)..(323): n is a, c, g, or t
tcccctggcaccacagcccccatggatcgcagcttctagtcgtctttccgatcttccgacaatgcccagtccgtgacccctagtccggatgcactgccgctccctggcaccagctcgagctgcaaggtcgctgtacgacttcgagcccgacgaacgacggggagctggtgcttccatggagggcgacgtcgatcacgcttgaccaaccagatcgtatgagaactggtacgagggcttgctggacggccaagtcgggcttcttcccgctcagctacgtggaaggtgcttgtgcccctgccgctatgtgactccaccgcggtgtncgccccgcctctcggcgccctgccgttccgatcactttgtggccgggcgtgtttctactaagaatggggggcttgtccccttgcctgtgtccccacgggtctttgccccccttgcctcgtccccgaggaggtcgcgaaagttacttggatgccaccttgacgccggtggcgaccctaacacctggggggacccccccgggtcccgcattgtgggaagtggcctacacattcgccccgttggtagggcccaggcggaaaccccccaaaacaagcctttgagcgtgattgcggtagggtgagggcctttctaacttccattggcggggattgcgggattgaggagggaatgtgctcccattggtttgttaacca

SEQ ID NO: 719551 - DNA, 395 bp, Homo sapiens
gtactgcagagcacaggagcaaatctccctactcaaggccaggagcccaacccttgctttagcatgccctgtatgtgagacatggagtaaaaggaaattttggaactttaagtttcagtgagtgtcttgctgggttttggacttgcatgaggcttgtagcccctttgttgtggccaatttctcccttttggaatggtaacatttactcaatgcctgtatccccactgtatcttggaaataactaaattgctttagcatttgcaggctcataggcagaagggacttgccttgtctcagataagactttggaattaggctttttgggttaatattggaatgagttaagactttgggggaccatgatgggggcatgattgtgttttgaaatgtgagaa

SEQ ID NO: 719552 - DNA, 534 bp, Homo sapiens
ggcagttactgagaactcataagatgaaactaaagatccctcttcggatccacagtcaagcgcacctgtaacacatcctgacaaaaagcccaggagaaaggagcgccatggattattacagaataatatgtcagctagtctttgctggtcgacattgtcggctgtgttctagcagttgttctccctatttccagctcctggatgtgcagcgattgcctcgagaatgcacgctacaggaaaagccattcttctcccagccgggtgccccgaatacttcagtgcatgggctgctgcttctctagagcatattccattccactaaggtccaagaacgacgatgttggtccaaacagaacgttacctcagagtccacttgctgtgtagctaaatcatataagcagggtcactagtaatgggggggtttcaacagtgtgagaaccacatggcgtgccgactgcagtaacttgtcattatcacaaatcttaacatgttttaccaagtgctgtccttgatgactgcttgatttttctggaa

SEQ ID NO: 719553 - DNA, 1501 bp, Homo sapiens
  misc_feature (60)..(60): n is a, c, g, or t
  misc_feature (620)..(620): n is a, c, g, or t
  misc_feature (908)..(908): n is a, c, g, or t
  misc_feature (1007)..(1007): n is a, c, g, or t
gggtctcatcaatcagtgaagttgactcctctgttggtgctgcatccgtattagggtgtnttcgctggtgggacgcatgtcgccgctagaaaggcctttgtcttgacctccagaaaacgaggggttttgttttgtggcagagcgagccgcaccacaccgactggtggttgcctctcggtggcctctttctcgccagcacatcgaggtttttcctcgaagtgaggggtggtgtatttccttcgttgtcgctcctctggtgggcgtcgctcttctcgtgcctcctcctgctttgtgtggaggtgggtttcccaacgggatgtctcctgctgtggttgttctccttctccctctggtgggggccgccccaagttgtgagccttccctccccttggtgtggtagtattttcgggccggcggcgtccacaatataccctggggcgcctcgctcgacagggtcaccaacaccgcttgccggacgcgcaaagcaaattggtgcggagcacacgcccacaacacaccaggggatgtaattttgtccgagaggtattcggggccgccccccgtgccgacattacggggtgcccgccccgcgcacaaaaatggccggtgttctaattagngccggcggagaccatatatgtagaccgcttatgagtgtggtgcccgttgtagacaaacccccccgtgtgtctgtgtgagcacacaaagcgctctaaacagttgtggcgcgcccgagggcaactcacacagagtttgagagagttttggcacacatggcgcgtttattattttggtgtgttttgctttcgtgctgttgtgtgtgtcttggtgtcttgttgctttttttttttttcggggctttgagacttctcaccgggagttttattataaaatactggggagacctngtgtgtgagacagcgtgtgacacacagccacagtttcgggtgtgtggaggaggcgagagacactgctcccccacaaaagtgtgtcaccacacttgtggnggcgcgagaggagacttttgagattgccacacacattggttgggttttgtttaaaatatggtcacatgtccccacaatatatgagagaatgtcacattggtacacacgggagaaggtccctcgtgccacatccttagaaagccacccccacacttcttctttataaggaggaaatggcgccacagtcctctttcccacaagtccacacacacacggggagaggtgaataagcacattgctcttctgggtaaaatataatgtaaatgccaaaatttttttaaattttctgccttaatacttttttattttgttttaattttgagatgaatgaggccttcgtgcccccccttcccccttttttgtcccccacaacttgaagagatgtaatgaaaggcttttggtctccctgggagagtgggtggaggcagcccgggcttacctgtacactgaacttgagacccagttgaattaaagtgcaccaccctttaaaatga

SEQ ID NO: 719554 - DNA, 154 bp, Homo sapiens
  misc_feature (23)..(23): n is a, c, g, or t
  misc_feature (42)..(42): n is a, c, g, or t
  misc_feature (45)..(45): n is a, c, g, or t
  misc_feature (52)..(52): n is a, c, g, or t
  misc_feature (56)..(56): n is a, c, g, or t
  misc_feature (63)..(63): n is a, c, g, or t
  misc_feature (89)..(89): n is a, c, g, or t
ccggcctatgccctgccactgancaaggcgcctgtggacctnctnggtgttncccncaacaanctcatggcaatggcccaggagactgnagataacctgtactggggctcagtcactggttctcagagcaatgccgtgtcgcccaccccggctc

SEQ ID NO: 719555 - DNA, 336 bp, Homo sapiens
  misc_feature (254)..(254): n is a, c, g, or t
  misc_feature (320)..(320): n is a, c, g, or t
  misc_feature (329)..(329): n is a, c, g, or t
ggcatggtggcacgtgcctgtaatctcagcctcccgagtagctgggtctacaggcgcccgcaccacgccctgctaattttttgtatttttagtagaggcgggatttcactgtgttagccaggatggtctcgatctcctgacctcgtgatccacctgccttggcctcccaaagtgctggggattatagccgtgagccaccgcgcccagcacatgatacaagatttatctctcttcctttcctctgcttccctggntctttgacaacctcatcttcccaagattcttcctaacccttttaagggggggaggggatttcaaantttaatttncaagata

SEQ ID NO: 719556 - DNA, 430 bp, Homo sapiens
  misc_feature (43)..(43): n is a, c, g, or t
  misc_feature (65)..(65): n is a, c, g, or t
atgtaatgtgatgcgggtggtattgttcatgagttttggtagntatttcatgtgcattgccgccnagatgcatatctacacagagcatcatctatgctctatactcctctttcaacacccacgatcctcttccccgactgcctttctccagcctggcgatagtcttgagcatttccctaaactccgctgtccgctgttcattcccacaataccgattgaaatgatcaaccaacatctgcgtcggcgccgatcctccatgggcgacgaggaagtcacgaatcatcaccaggaaatctttgcctttaggctgttcgcgaccacgtgcacggccgcctggagtgcttgaacagctggaagacgcggagccaccttgcctcgactgcaggtttgcgtcgacgcggccgcgaatttagtagtagtaggcggccgc

SEQ ID NO: 719557 - DNA, 1014 bp, Homo sapiens
  misc_feature (1014)..(1014): n is a, c, g, or t
agcggcgcaggctttcgaggctctcgtcccgccgtgcgggatgggagcgtcgcccctccggtcttcctcgtacctccgctggattcgcggagctgattctggggtcacgagactgccttacacaagtgcacgagactcgggcagggtgcttgatggtactacaggacgccgaggtccgaggatcgtgggcccatcccatgaccgctgatacgtacgacggtcggggaccactgcttgacttgatggtactgacgggatgcatatgctgtcgcgactgaccatggatgagctgcggcgaggcccctggagcgaccctcgcgactggggatggatgaaggagcttcggacttccagcgaggacagagggccggctgcctgcttgctgcatggactgcggggttcatgtccaaggtcgctgacgggcggtcgcgttccgatagtagattcatagtgctccagggatggtagccgggtatcagaacctatgttctgacccgacggagtgcagaccctccggtctacgaggggtgtccgtggtcttgctaatctgagaacttgagagtggtttcagtaaataagcgtctaatgaacgtgccgcttgatggagcagccgttgtacagagttccacgctcgtccaattgcatggctctaatcacgtgtcccagcattctgggattgaaaatgcggggagggaccaggaagcagtcagggcggcaactcgaggttgccgtggtcgtgaacaagctggccttgaaccatctggcatggggctccttatgcacaagaggaccccccttgatcaacccaactagggggcatggccttcagcgggaattgcacaatggagacagcgggggaagaaagcttggtggtaccacatggttgaccgccatgtgttcaaatgccttgttagcgttctattggcagaaaatgaaccagggtgagttcttgaagcttctcatagggcccctagtaagagaaggatacaggcggccccttaaagttgccccccn

SEQ ID NO: 719558 - DNA, 718 bp, Homo sapiens
  misc_feature (36)..(36): n is a, c, g, or t
  misc_feature (84)..(84): n is a, c, g, or t
  misc_feature (130)..(130): n is a, c, g, or t
  misc_feature (351)..(351): n is a, c, g, or t
  misc_feature (391)..(391): n is a, c, g, or t
  misc_feature (457)..(457): n is a, c, g, or t
  misc_feature (504)..(504): n is a, c, g, or t
  misc_feature (524)..(524): n is a, c, g, or t
  misc_feature (542)..(542): n is a, c, g, or t
  misc_feature (557)..(557): n is a, c, g, or t
  misc_feature (565)..(565): n is a, c, g, or t
  misc_feature (569)..(569): n is a, c, g, or t
aatcagtgagcatgaagataggtcacaggaagtatncaacccaaagaacagagaaaaacaaagtcaaaaaggagaggctacaangacagacagataaaacatttaaagaaacaattacaacttcccaaantctaaggtaagcactaatctacagatccatgaaacccaagaagccaccaaatacaataaatacagagaactacacctagacaaactgtagtcaaagtactggcagataaagacaaagaggaaaagttgaaaagagaaagaaaaaaaaacccacaaggaagtaacgatatgattgactttgcatcagaaaaaaaaattttgacagaaggcagtggaatgacntactcacagcgttaaatgaaagagaaaattatcaagtgtncaatgaaagagcaaagtatcattaaaagtaatgggaataaccgcaattacttttgcaccaacctantatattcttacataactatccttcaaaaaggaaggcaggtgaggatnctgggaagatactgaaagangaagcaacagaaatcagntccccacctagacantaattgcncggncagaatcaatttgatgtgaggaagcttgtcctccaagtactgaggttctgcactctgatcactgattgctgctttttgtcatagaagagcagacagaagtgatcacctttgcactttggcccaatgttgcagtccctcctccttggctg

SEQ ID NO: 719559 - DNA, 307 bp, Homo sapiens
tgaagagaggtcagttgtgttacaaggtggcctttgcatgagtttggagagtacccctcgaagtgctccccgagcatgcttatccgcgatgcacggcctgaagacgcgttatgcatgggcgtgctgggcatgcaggtttttctcgatacctacgccacagaaggcattcgcgactcaatcgctgccgaggcgctgcaagcgtttgcgccccagacgatttccgcgctgatcgcccagccgggcacggcgattatcgtcgctgaatcaaatgggcatctggtggggtttgcccaggtggcgatggaca

SEQ ID NO: 719560 - DNA, 800 bp, Homo sapiens
tcatggaggtgcacggaaatgggaagaggcccagtccagagaggtgagcagatgagctttgctgtccttgccttcctggaaccgcactggtcctcccctttgcttataaaagagagagaatttgattgctgtggttgtaatgtctcaaactttttttgagacaaggcctggctctgtcgcccagactggagcgcagtggtgcaatctttgctccctgcagcctccatctcctgggctcaagcgatcctctcacctcagcctcctgagtatctgggattacaggcacgtgccaccatgaccagctaatgttgtcgtcgtcgttgtggtcgagtggttttggagagatgaggttcttaccgtgttgcccaggctggtctcaaacttgtgagctcaagagatctgccgctcaactcccaaagtgctgggattatatggatgtgagccacatggccagccaatgtctcagactttctgtggttattttggttgattccaatacctagctgataatacatctaaaatctatgggagtagcttccagacatgagtattgtcgggactctttcagatgctgacaaccggtaagaaaactctatctagaagaatttatgggtcgactggtccagaagctcagagtacagttctgctttttctgatgctgttgtgaaagattggggcaaaagaaagaaggaatgaaaaaaaaaagaaataaattcggcaaggctttatataaaggattttgggctggaaatggaaaaatgcgcaaatttaaatttgggaggaactttgggaaacaaaga

SEQ ID NO: 719561 - DNA, 453 bp, Homo sapiens
  misc_feature (409)..(409): n is a, c, g, or t
aggtttgactttgcacagctgccattactgctgctactcagattcttctctcaacagttcttatctatttatttatttatttgagacaaggtctcactctgtcatccaggccggagtacagtggcgagatcttggctcactgcagactcgacttcccgaactcaggtgatactcccacctcagcctctgagtagctgggactacaagcatgcaccacaacacctgtctaattttttgtattttcagtagagaccagtttttgtcatgttgcctaggcttgtcttgaactcctaggctcaggtgatccatctgcctcagcttcccaaagtgctgggattacaggcataagccactgtacctgcctggaacttaccttttttttttttttaaaaaaaaaaattgtttacantacattaattttgtggggtaatgtatttcaaagcaaaaatttta

SEQ ID NO: 719562 - DNA, 1651 bp, Homo sapiens
gggagaatgctcccagcgaggggctgaagaacgccactagctctgcgaacgctggaaggctactcgctcagctgcttcatccacaacacccttttctactcctgcttgctcctcagccgccactggggcgcgagcgcggctcaacggcgctgacgcaagctaccgaccacgtcaacgctgccaaaccctgcccacgctccgctccggccccaatccccatcagcctggcgcacgcctggccctgaccgccccactctcaccctgcgcacgcgctcccccctgaaccacccctagcgacactgccaccacaaccccgaaggcccatctcctccagcacccaccctgcgcacgcacccgcccacacacgcgcccacgcgcacgcgccacctgcccaagcatccgagcctgccacgcacgcgcacccaccagcacctccctctctaccccttgcccacccaaacctccacgcaacttgggctcaaccgcccacccaacgccccacgcaggacacaatccccccccacgccggacgcaccgtctcttggtgtgttaatcattgtcatacggagaaagaagattcaaatcctattaggaatatggatggggaatgggggggcaacaacggaacaaaaaagaaaacaacttataaatgtccaaaagagccacgaccggaaaaccaacctctaaccgccaaccgcgctttcaaccccataagctcaaccccacacccgcacaaaacaacccactatcccttatccgcccccttgacaaaacgccactcactactcgcacttaacaacaaccccccccctatataaaaaacggcctcacgtcttacacaccggccgcacccttcatcccaacagccactcactaggaaaaccccccctcacttatcacatatcaccccttactatggcagacacttacatccccaaactaccccaaacaatctaccccttaggcacgcgcgcacaactaagcgcgcaacaacccctttcttctaacccaacttcacaacaaacacagcgccctggcccacccacaattcattcgggcgacacccacgaacccgtacggccattcgacaaccccctcgtaaggcagcgcaggcacaaacagcgcaccactttccacccacattatgggcggggcgaccccgccgcgccgcctcaacagacgggcctctcccccatcagtgcataggcaaaccccccacggccagcacacccacacacacctctccccacccacacacacctctcctacccgcgccaccgcacgcgcactccccaacccaccgcgcgacggacccccccatatcggcgcacaacgcgctcgaaaccgaaacccaaacaagcactacaccacacgcaccccacacgcatcacgcgcctcgcgcacacacgcgcacacaacccccaaacccactagctaccaccacacccccgctctagcggccaacaccacacgcggcaccacaacacaccacacacaccgtcatcacccacaccgcacaggcaccccatacccccccccccctcgggcaccacaccgcgccccccaacaccagccaggggcacaccacacacacacaacaccacaaagcacccttcaacatccacacccccctcgggcgccctcaccgcgg

SEQ ID NO: 719563 - DNA, 277 bp, Homo sapiens
gagacgagatgggaaaggcagcgcgcgggcttcgctggtcagtagttctctgatgtgaaaggggcggcacagtcatataaacttgatccaacctctttgcatcttacaaagttaaacagctaaaagaagtaataataatgaaggcgatgcttgtggaatgtgcagtgcgtatagggggcgcacgcctcattacgatacgcctgcttgcttctcctgtgcaatcgtgtctttggaaggcagtggatttttctcttgcgtctcgtctcttctcttgtgt

SEQ ID NO: 719564 - DNA, 280 bp, Homo sapiens
tgtactgggccacatatagcccatgttgaactcgtccgagttacctagagaaacattgatccgctccatattcggactgtccagccgtaggtgcagggtcccagtgcagcaataggtgtaagacagaagtctgaaagggactagcacgttctcaatgcttcttatctaagaatttccgacgggacccgtgcagaggtttcgcaaacttggtcattcctgtttccatcttcttcttctcctccttatcctcaggcagctccagaccctcctcggtaactga

SEQ ID NO: 719565 - DNA, 130 bp, Homo sapiens
aatcataccttcatcaaaaccttcatcaaaccctgatctcaaccctggtcatcaacccgtcatcaaaccctcatcaaaccctgctccacaaatccatttaatatattgtcctcggatagggtttcgatga

SEQ ID NO: 719566 - DNA, 218 bp, Homo sapiens
cccttgcacacccgataaatccgaaataccgggacttcatccttggtctacagcctatgtcaagtgaaatcgatgggggttcacaatacccgggcctcgctcctctcatcgtgagaacacgccctataactaaagtgcctcctaccaccagttccctggggatagactccccccagtaggtacccctgctcttccctaaactgacattacacgataca

SEQ ID NO: 719567 - DNA, 832 bp, Homo sapiens
agcgggtttcgcttcgaagattgtttcagaagcgttgggcggcgggcgtccctgagagaaattagaatctggaaactgttcttcaggacacgaaacccattagtttggaacctggacgaacttcctttgcatcacgactcctacaaactgacacagaacccaccttttacgcgtggtgacgtgtgaccacaggcacgctggcactcaccacgctgggagctgctacgactgacaacttaaggaccagaagcccgagcaatggctcaagaaggtacttgtcactacggcacatcagctccaagacaactacaggacgaactgaacctgacacagactacaactggctgtagttctctcacgacgagctggcttcagcaggttgacttgcagcgcattccaggctatatactctgagcatccatctgcgcgtgaaataaaactgctttcccttcaggtttccaacacacacgctcattcagggttatcctagtgctgcgttcgtcaacaccacacacttctccacgaacgggcacaaacctggcttactccagagcgacacggatcgtgctcagacttttctagctccaataccattgcactcactgacactacacttctcactctcgctcagtctcacgcagttcctctctaagcagcaactatgttccacactcgctcacacacagtccataacaactggacagggaaccttacgagcactcacgtacacattctttcagccagatgtccccagaacagcattgcacaacaggctgacacgccggacacgcactctcagtgttagacactcttaacatcccaaaggactgtg

SEQ ID NO: 719568 - DNA, 1681 bp, Homo sapiens
gcgcgcgcgctaattaatgagaacgccgtttggaggtgtggagcagaacagcaaacgccggttgtttgggcacgaccagtagtagtggctagcgcggtgggtggaggtggctccgaaccgacagggtgttggtgcgaccgaagaaaagcaccggagggcttttgtttgtagagcacgccccggcgcgccctagttactcttttactgaccgcgcgtgctctgttagaagggtttgtacgccgggaggggctcctgtgggggtggcgcggaaaatattgtccggcgcccctgcgggaagcgggtacacaaaggtgccgctttatgtggaaatgatgtgagggtttagacaacgacacgctggctgccgtcgtgtggacgtccggcctgttggaacacgagggggggcgccatgcgttgtggtgcgtacgcgacgcccgtgtggtcgctgctgtgtaagggtgggactctcttgtcgccgggggctgctgttataggcccaccagattgtgggagatgtgtgtggccagaacgatgtgtgcgcgcagcaagcgtgcgccgcgtagttggacgcggcgcgtgccgcgttgtctgagatggaagtggtaatggggggcgcctgtgagcgtgttggacgccctggtgactgcacacgagcgttggtgacgccgcgatgttaagtgcgccccccacgaatgtggaattggtggcccgcccggcagatgggtgtgaacgtcaccccgggagggtgtagtacgccgctcacagcattgtgtgcgccgcggagggggcgccccgacgccgcgacacacagaacacgccacacaggtaggtgcgccccccagaaagaggggccgcccttttctgggaattgacacccggggggagttagtattccccccttaatgtggtggaggtggcgcccctgccccagggaaaagttttgttgttgttttttttcccccaaagggaaattttttgtctctgggaacccccttttgtgggacccccaaattccccagagcccctttgggccccccgtgtacccccccccccacatttaagaggagaggccacacatgggcccccccccaaacaaagagctcattcttgcacctcgccctttataagtctcccccgttagaaagggtctccccacatctctgtgtaacacacacagttctcggtgagttacattcgcccactccagaggaggttatccaagtctcacactggtgtagactctctcacccaataagagtctgtaatgtagagaaacacgccacccggaacaccccacaagtaaaattccaagaccacggtgcgttatttcacacaatgtgtttacctggggtcttcttaatgttgtacaccgtctcgtaccaagccctctagaaggtaccttctgagatcttctccgttccacaccatttctcgacggcaatttacggcgtcaaacacgtttgtttgtagccaccacgggcttccaccggacttctacacggtcacattaattggctcaaactttccgtcacactagtttgcgttcaatcccccacactaaataatttcacctttaacatcccaacatccctttggctttgaagcccccgcctgatactggccttttgtaaaatgtggtttgactatttctgtaagtctccatctattgatgagggtctta

SEQ ID NO: 719569 - DNA, 434 bp, Homo sapiens
  misc_feature (21)..(21): n is a, c, g, or t
tagaggatccccgccgtacangttgcggatgctttctggtaaaatagctgaaagaaaagaattttttttagagacggggcgcagtggctcatgcctgtaatcccaacactttgggaggcggcggcaggcggatcaactgaaggtccagagtttgagaccagcctggccaacatggcgaaaccccctctctactaaaaatacaaaaattatgtgggtgtggcattgcgcacttgtagtcccagctactcaggaggctgaggcaggagaatcgcttgagcccgggaggcagaggttgcagtgagccaagatcgtgccaccacactccagcctgggcggcagagcgagactccatctcaaaaaagaaaaagaatatatattttttaaaagctagaagtgatcgcaactggtacggcgggcgcaactggtacggcggg

SEQ ID NO: 719570 - DNA, 727 bp, Homo sapiens
  misc_feature (194)..(194): n is a, c, g, or t
  misc_feature (304)..(304): n is a, c, g, or t
  misc_feature (341)..(341): n is a, c, g, or t
gcctcccaaagtgctgggattacagctgtgagccactgtgcctagccctagctcagttttaaaaattacatttagtaggtcttattctccattatcagagaaatgcagattcattctagaacctttggaaaagatagacaaacacaaaagaaaaatatctcccattgactaccctccagggagcactggacccnaactaggatctggttgcttttctgtgaagatgtcctatttcatctttaaggattatgatcttttaagtaatggaagttgtgcttcatattttaagaacttttaaaatganctttatttcatatttaatttatatacaataaaaggcnctcattttaagtacacagtttgatgcattttgacacatgtgtagacatgtgtaaccaccaccctaattgagacacagaacaccttccatcgcaggagagagggttccctcacttccctctgcagtctgcagccccccaccctccccagcatgcacactccctgccccaggctaccccaacctactttgagtcatccaggatttttccttggttttagaatttcataaacatggaatgaaacagtagactgtgttttgcattcgacttcttttgtgtgatgttctcaaggttcacccatgttgttgctagtgtcagtagtttttccttttctgttgctgagcagcattccagtctgggctggtgacaaagtgacaccctgtctccaa

SEQ ID NO: 719571 - DNA, 407 bp, Homo sapiens
agtgcaatggtgcgaacttgatttactgcaatctgccggttcccgggtacaagcgatactcctgcctcatcctctcgtgaggtagcgtgtacgtacctgcgagatacagtgatcatacccggtcatactgtttcatatttgaataaagacggggtttcaccgttgttgcccaggctgatcttgaactcctgagctcaggacaatccacctgccttggcctccgaaagtgctaggattacaggtgtgagccaccacgcccggccagttgtattcagttcacttcatgtctctttgtatatgaatttcagttcttgactttactggtcttgtgtctcctccgtaattaaatcagcataaccatttggtgaatataaaacttcatgtggttgtgtgtagtggctcatgcc

SEQ ID NO: 719572 - DNA, 501 bp, Homo sapiens
gaccgcgtgtactctgtcacgtcagtcactcagtctaattcagaacgcttgctggagagctagtgtggtcatatggagaaaagaagatactctagctttttgagttgtaggaattcttgcactggttctttctcatccttgtgggctgatgttccttcgatttttaaagttgctgtcctttgaatgagttttttttttttcattaatgctattggatgaccttggaggatatgtctggggatcctgtaagtactgagatgactgacgtgacagaaatagaattcagactatagataggaatgaagattattgagatataggagtatgttgaaacctaatccaagaaagctaagaatcacaataaaataatacaggggctgacagacaaaatagccagtatggaaacgactgtaactgacctgatatagctgaaaaacacactatacagactttggtaatgcaatcacaagtattaatcgcagcatagaaacctgaggaaag

SEQ ID NO: 719573 - DNA, 758 bp, Homo sapiens
  misc_feature (742)..(742): n is a, c, g, or t
acagccctacctggcaatgcagatgtgtccccaaaaggcactgggggcagctggagtgctgtgcctaggcgggctcacccgggcagcggttcgctctgattgcagcggtttcccaccagctccttggagagctggcagatgacccagccccacagcaggagccgggaatggcagaacgagatacaacaatttgatatccacttgccagatgagccgggtgtcctcagtcgcctggctctgtgcccaacctctttttacataaacacttatgaattgagccaggaggaaaagcactctgattatgaattgagcagaaggaaacaaagttctgcagataaacaccaatgaaacaaaaaaccacgaataagaaaaatgacagaaaaggagaaccttcccagaagcctcctgccagtgaacggtcaccagagcaagagcatggaggccctgggttttgaactgtgagataaggaagatgatgaaaacctccctagcagccaggcaagcacaagattcctgtgaaatccaggtctaagtgttttgacaacagaagtaatattatgtcataggtgagagctgtgagttgctgaacccaaagtgagttcaaatccgagctctgcctcctgctacctgtgtgactttgagaagttccagcactgctttgtgcctcagttttgtcatctgttaaatgggcgtaatcacagctcctgcctcagagttgttgtaaattaatacatgtaaagcnctgaaatcaaaaaaaa

SEQ ID NO: 719574 - DNA, 199 bp, Homo sapiens
actagtccaaggtgggctggtcctatgaaaaaagtactaatacctgtgtgagtgttttgggtaaagacagagttatcaccttttctggccttaagaatatatatatttcgggctaagcacagtggctcatgcctgtaatcccagcacttggggaggccgaggcaggcggatcacaggcatgagccaaccgtggactagt

SEQ ID NO: 719575 - DNA, 299 bp, Homo sapiens
gcactttgggaggctgaggtgggcggaccatgaggtcaggagttcaagaccatcctggccaacatagtgaaaccctgtctctactaaaatacacaaaattagcccagtgtggtggtgtgcgcctgtagtcccggctgctcaggagggtaaggcgggagatcgtgtgagccaggaggcagaggttgcagtagcaatatcgcacattgcactcagccaggcgacagtccgagactcatctaacaacaacaacaaaggtgatttactttctacctttcatctgtcgacaggactattatagg

SEQ ID NO: 719576 - DNA, 320 bp, Homo sapiens
  misc_feature (291)..(291): n is a, c, g, or t
atccccggttctgggtagattggcaggacaatgtgggagcagatggcctgcctttgcgtgagagggctacctgcacatgccctcccccaacaagatctcttggactcagggcttaaaagcctggctggttgtgagtgtgtgtccctgtgtgtgtgttgcgggaggggaggactggggctggaagtccagcaccccaaggcaagatcttgtccctcctgttccttgggaaagcgtttggccttgacgggtttcttcgggcttctacccctcaccctttctggccagtgatcnccgcaggggcaacaagcccccattctgct

SEQ ID NO: 719577 - DNA, 119 bp, Homo sapiens
  misc_feature (84)..(84): n is a, c, g, or t
gtagggttagctggtcagtagtacttttgggggcactgcttgcctatggccagggctatgctgcaggtagtctacgtaaggctngttctctactagtacgtatactgtctagtctacgt

SEQ ID NO: 719578 - DNA, 105 bp, Homo sapiens
cccagtactttaggaggccaaggcaggtggatcatttgaggtcaggaattaggacaccagcctagccaacgtggtgaaagctcgtctccacaaaaaaatacaaaa

SEQ ID NO: 719579 - DNA, 249 bp, Homo sapiens
ggacagtgaaattttggtggggcagctgctttcctttgacattggtgaccagccagtctttgagatacccctcagcaaagtgtcccagtgcaccacaggcaggagttgaggtgacattggatttccaccaaaaggttgacgcagagtgtttttctaatggaggtgcgtttttacgtcccacccacccagagaggatgtgtgtggacccctcttagaggcctctcccccagaatgtgtttgtaaaagcgc

SEQ ID NO: 719580 - DNA, 161 bp, Homo sapiens
caggatctttccagtgtcagtgcctctctggctaccatctgtccagggaccggagccactgcgaggacattgatgagtgtaactaccctgcgagctgtatcgggggtgatggcatcaatacaatcggtcctcagatttttttgccccaggaaataggctac

SEQ ID NO: 719581 - DNA, 401 bp, Homo sapiens
aaggtgccgtctgatgcggcagaggctgacaggaccaacctccaagaggacaaaaaggcagagatcgagcaggcccgagtcggcatctgaagtgagggagagagttcagacagtcgcagcgtcaacgatgagggtagcagtgaccccaggggcatcgaccaggacaatggcagcacgtccccgaggatccgcagcccgcaggacaatgagagtgactcggactcgtgagcccacagcgagatgctgcaggcccagccccgcagttgcaggctccgagtgggtcaccccagcgtcgcctcctcagctcgtccagggacgcctcaggtgcccacgcgcagggccacggggtgtgccactgcagttctcccacaggggtcccccagcgcgtcccaggcccctgg

SEQ ID NO: 719582 - DNA, 447 bp, Homo sapiens
  misc_feature (50)..(50): n is a, c, g, or t
  misc_feature (80)..(80): n is a, c, g, or t
  misc_feature (92)..(92): n is a, c, g, or t
  misc_feature (153)..(153): n is a, c, g, or t
  misc_feature (232)..(232): n is a, c, g, or t
  misc_feature (234)..(234): n is a, c, g, or t
  misc_feature (248)..(248): n is a, c, g, or t
aacctggaaccaaatccattcccattcagcaaatgttgatcaaagtggcntgtaggggatacagagatgattgcatacanagatgaaaaagnaaacgtttctgccagggccaggcgcggtgactcacacctacaattccagcactttgggagncaaggcaggtagaattgcttgagtttgagttcgagaccagcctgggcaacatagttgaccttatctctacttaaataanantaatcagccaggcnatggtggcatgtgactgtagttccagctactttgggaagctgaggtgccattgcactccagcctggtcagcaagagcaaaaaaaaaaaaaaaaaaaaatgtgcacatcaaagatcatagccccggcacatcgaagctgcaatgagctatgattgcatcactgcactccagcctgggtgacagaatgagaccccgttgca

SEQ ID NO: 719583 - DNA, 261 bp, Homo sapiens
gcatatccgatcggttgtattctctgctgcagagacgccgaaggccggtatggcagccattgtgggcccagacggaaattgactagtggtcttaggaagccccatttctaaccagatggcacgtgacaaacacgcgtgctgtattatgccccccaggcagagaaacaaactcaatgtaccggccccgcgaaaggaaatctcggcaacaagagaaagggccccaggagacacgccaagtcgacagcgctggtaatcagcccg

SEQ ID NO: 719584 - DNA, 1362 bp, Homo sapiens
ctggctgccgcatggtgcttattcttttttagtgcagctgggagagagcgggagtgtgctgccgcgcgagagtgggaggcgaagggggcaggccagtgaatgagtgcgcagtgagcctttgcagccacgtcgctgctgccttaccctgtacttgatgttgcttacgcgagtgtagatgcgtggctgctgcggcagcgtgcggggattacttatgctgctagtttcggttcgctggacagcgtgcgtggtgctagtctctggctgtgcagcgtgcgtgagacactagcactatgtcggaggagcagttcggctgcgggacggggccgcgcgtgcatgcggcaacgtgccggcggtaggcggcatcggccgggcgatgcaggagggagccatggtggcggccgacacaagggggcagccggtgtgcggcgggaacagcggagcccgggaccgagggtgcggcaaccgcgctctggcaggcaccgacaggtcgggcaggcgccgagatcggagcgtggcgcgacagcttgacggccagctaacgaaccgacggaggactgcaaggccattcaaatctcctcccctacgaacacctcttgcaggccatgccgacccggcaccacgccgggcaaccacacttggcaccacccttgtctacatcaggacgcgccttacgcttgcgcgcccagctatcagagccgtaaacgcactcgtcgcaccgtgacctacctttctcccaagcactttctgcgctgcagacgctcggctagccacccttgtcccgccgtccctcgcagccgcttaacggaatccgcttaagtccacgcacggtcggtccggatccacacggcgcagcacgcaggggccgctctagcgctgcacatacttctctacagcgctaacactctgcggagccacgtgttccgcacatccgcctcgcccacatcttgcacatccaaccacgcacaagaacacaccacttatccactttgccactattggcctcaaaccgcactctgaactatgtcacctcccttataacacagtgtgttccaccaacaatccccctgttctcaactccctccaaacactcgcacatcccccccgctctccaccacacacacacatttcctctcgttttcatacactcgatacccccctagtcatctttcccgcaacatatctaccgccccgtcttactcgctcggaatcaaccttatactccgtcgcaaaccacccctcatacgcgtcgatcacctctctcgccctcacgcctcgttcgccaaccctcatatcatcagcctctcccctctgtgctctccatacagtccacctaccaacacaaaaccctacttcattcactcc

SEQ ID NO: 719585 - DNA, 105 bp, Homo sapiens
gcatgtgatgtgatagcaagcaggggcgcagagtggagcaggagactcatgaggactgtacagcgtgtgacgggtcggccacgctcttcgatgcggagtgaacag

SEQ ID NO: 719586 - DNA, 456 bp, Homo sapiens
tctggtccgccccaaaagacgcctcggttcccccagcgtccctcccctggatactcgcctggacgtggctcgcccgcggtcgttcctgcaactgcacggtcgggagtccctctccccagcccagcccgcccggagtcttcgggggacacttcagaaagatcgggtgagtgtgattcccccgtggccatacccggagtccctcccccgccccacctccctccaggcgctgtggcgcagcccgcgactccgagccccggggctgctggacacccggaggggttgaggtccgggcacccagagaggcggaggtccgagcccccgggcggagagcgggcgggtccacaggtcgctgcgggtcgcagccccctcctgagcgagccttcgcggcccgcccccggcctccgctcgacccccccagcctgacgtcaaggggaagggggcggagagccgcggccg

SEQ ID NO: 719587 - DNA, 391 bp, Homo sapiens
tctaccagttctgcagcccttctatcaaatagtccatatccacctcatctactcctcagctcaatgcaacctggctaactccctaccattctatcaacgcttcccatcaccaaactcaatggtctcctccattctttgcttctgtgatctctctacagcagtggtccccaaccttttgtgcaccagggacaggttctgtggaagaccattcttccatggacccaggggggtggtttcagggttaaactgttccacctcagatcatcaggcattagagtctcataaggagtgttcacacgcacagttcgcaatagggtttgtactcctctgaaaatctaatgctgctcatctgtcaggaggtggagctcaggctgtaatgaaggagaaatct

SEQ ID NO: 719588 - DNA, 126 bp, Homo sapiens
gtctagattggactttttaattaaggatgtcttaattttggacttttaaaaagggttatgacaagggatttctggatttatagatcacaggggctttataaatgatcaagatacatgtacaaacaa

SEQ ID NO: 719589 - DNA, 297 bp, Homo sapiens
acacacgagataaagatatacatagtgtatccattctataaggtggcatatcgtatctcttgtagatgattgatagagataggattatatataatactgtacagagtttagaacataataggcactcaaaaaatattagccaggatcacgaggtcaggagatcgagaccatcctggctaacatggtgaaaccccatctctactaaaaaatacaaaaaatgagccagacatggtggtatgcgcccgtagtcctagctacttgggaggctgaggcaggagaatggcatgaacctgggag

SEQ ID NO: 719590 - DNA, 157 bp, Homo sapiens
tgagagaggagagaagtagcgaggcgtctttgattgtgtagtaagggtggaaggtgattttatcgcgaatgggaggttattcctaaggggttgtttgatcccgtttcgtggcagaataggaagttgagttctggtaaggcttgcataattaagggcc

SEQ ID NO: 719591 - DNA, 857 bp, Homo sapiens
  misc_feature (184)..(185): n is a, c, g, or t
  misc_feature (206)..(207): n is a, c, g, or t
  misc_feature (222)..(222): n is a, c, g, or t
  misc_feature (231)..(232): n is a, c, g, or t
  misc_feature (271)..(272): n is a, c, g, or t
  misc_feature (317)..(317): n is a, c, g, or t
  misc_feature (340)..(340): n is a, c, g, or t
  misc_feature (353)..(353): n is a, c, g, or t
  misc_feature (378)..(379): n is a, c, g, or t
  misc_feature (409)..(410): n is a, c, g, or t
  misc_feature (445)..(445): n is a, c, g, or t
  misc_feature (515)..(516): n is a, c, g, or t
  misc_feature (526)..(526): n is a, c, g, or t
  misc_feature (543)..(543): n is a, c, g, or t
  misc_feature (550)..(550): n is a, c, g, or t
  misc_feature (553)..(553): n is a, c, g, or t
  misc_feature (565)..(565): n is a, c, g, or t
  misc_feature (583)..(583): n is a, c, g, or t
  misc_feature (614)..(614): n is a, c, g, or t
  misc_feature (617)..(618): n is a, c, g, or t
  misc_feature (633)..(633): n is a, c, g, or t
  misc_feature (662)..(662): n is a, c, g, or t
  misc_feature (757)..(757): n is a, c, g, or t
  misc_feature (760)..(760): n is a, c, g, or t
  misc_feature (763)..(763): n is a, c, g, or t
  misc_feature (772)..(772): n is a, c, g, or t
  misc_feature (781)..(781): n is a, c, g, or t
tgtaagggcacatccgcgagctgccgcccagcgcgcagacagagcccaggtgagcaagagaacgggcgggcggtggggctcacggcctagggaggcgcggaggcatctggcagaggcgggtcgggctgggccagctggggtagagcggaggagctgggtgcctggctgaagctggggctggtgnngctgcgtgagcgctgctgggnngcaccgacaccaccntcaccggcnngcctgggtgctgagtgtgccgcggtgtgggtgcgcgganncagtcagggcgcagtgtgggcagcgcgcacgtgctgccagcccgnggcgccagaatcctgcgctgcgnggcctgagagtgngctgccgctgccctgccgcagcctnngagctttcctgcgaacctctgtggcgcccnntgacggctggcggctgacgtgctaccgtgctcaanggagtggcgtgctggagaagcgcagcggcgggctgcttgcagctgtggaagcggaagcgctgcgtcctcnnccgaacgcgnggctgcagctcttcganggccaanggngcacggggcggncggcccaaggagctcagnttcgcccgcatcaaggccgtggagtgcgttngannagcaccgggcgccanatctacttcacgctggtgaccgaaggggngcggcgagatcgactttccgcttggcccctgggaaggatcccggcttggaaacgcccagaatcagcctagggcctggtcaagttcaaagaaccanganggncatccaganagtgcgggnccggcagagcctcgggaccgggacctcgtggtcctagaacaccgggcgcacatctatccttcattgtaccaacaac

SEQ ID NO: 719592 - DNA, 109 bp, Homo sapiens
agtaggtatgagcggccggggacttgggggcgaggtggacccccggcttcaggcctctcgttagcacatctttccccaggtcgtgtcatcgctccacagtgacatgcgc

SEQ ID NO: 719593 - DNA, 285 bp, Homo sapiens
gacaaagctggacaaagcagatgtgatgaactggatgtgcaagcgcaagatataggacttcttcagcatcagattggatcacaacatgttcctaacccatgaggtagactgatggatcaataacatcaggatacagccatgtgctccaccctagccccaacacgctgccccttggcttactggctgctgagtggcacccccgccccgcagggttgtctacaaccggagctctgggctcgtgtccaacgcccctggtgtccagatccgcgtccccaccttgtccag

SEQ ID NO: 719594 - DNA, 460 bp, Homo sapiens
acatccttccggtcaggacatagaaagccacctcaatcttgccattttgcaattttcacaatggatgggctggcattccatgaattgaaacacttaattcttctcctttgaagccatgtgaatagtttctaatggttttctgtgatcaataattttgcaataaagggctaattcacataactgggcttccttttcattttttttgtagtatcagtctcccaaaatgaaattataaggtcaacaggaataaaaaatatttatgacttgatgacatccagtaaaaaattgttttccaaaagagatgtgctagtttcacagtaattgcttcggcactgagtattatcatcaacaaaaatcttttgagcatttgctttgtttttggaaacagggtctggctctgtaacccaggcgggagggcagtggcttcaacatagctcactgaagccttcatttcccaggc

SEQ ID NO: 719595 - DNA, 1827 bp, Homo sapiens
  misc_feature (411)..(411): n is a, c, g, or t
  misc_feature (449)..(449): n is a, c, g, or t
  misc_feature (1016)..(1016): n is a, c, g, or t
  misc_feature (1185)..(1185): n is a, c, g, or t
  misc_feature (1812)..(1812): n is a, c, g, or t
gcttggacgcctacaatctggttctgatcgggcacggtgtatgagctgcatggtagcctggagaaccgcgttcagctggctgtgttacgaggaccctacctgcagtcgccggagtgtgcctaggaaggtaccgcggaacgcggctggcggtggtcagtgcgctaacgaagtatgcttggcttatgtacgttatgacgatactagctgtagtagcttcgagtgtcgtgaagcaggagcgatcctggcaccctcgtggtatcaggtgcgtataactcgcccaattggaatcaggactggtgcgcttgtcccatgttcgtggtgtacgcgacttagggggtgcctctacacagtgcatgtccggcacttaatgcgcgccggttactacacctgcggggtactccagtacggggnctgtggaacacgctgctttgcatacatgctacttgtgntagaggtgtcgccaagtggggtgcaacgatgtcggtgggaacaggcgagcctccccgtagttgattggggtcagcgcaatccgaacccatcgcgggatctgggaaaggcctcttgagactatttcaccttttgtcgttatacatgggctaaagcaagtttccacttgggggacagggaatccgccatagggggttaattgccagtgtaacggcatttctaccccatgggagatgccaatgcgagggatttatagctccccatacccctttggttttgaacggccatgggtgcggtagcgccaccagggaagttacatactaaagtattggctccaatgcattgtcatttcttcgcccacctcgtaattcgttgggggaatacggtgggacgcagtggaattacacttcatgtatgccacccctacggaaatcccgaacccggggaccgtgtggggagaacacgcgtgttgcttagccttggatttttagcgaaggtaccctaatttggggttagaatcgatatggccccatccgcgggaggcgttgccacattttggttcccacatntggcgaattacgtgcggtgcaagaggcgaggttccatgccgttccgtatggatagggaacagcgggcataatatgccgagtggcgggaaggcgcctagatataaacccttggttgcggtaccttgggataaattttccccgcaaatattgtgtgctcaattgtcaaacnttggggtggaccccaaagcgaacccgtttcggaaaacgcggctataaatccaggggggcccctatttgcccacacgtaagcaatgagaggggagaaatgtaaacacaaggactcgggttatggtgggcacaacaaaagtggccagtggtgcacacatatgttgtgtgtgggctgtatccaccgacgtggtgacacaggggttgtcaaaggcaaggttgtcaacagagtggcgccgaacacgtgataagacgagatatgagggggccgccacagaggagggacacaccactgtcgtgtgtgaaggctatatgggtgagccccttgttgagcgacttgcacagacaggtggaaaggagtgatacaccagcaaaggcaagacatttagccggcgacttattgtgcatgagatcgtgaaaggggtggaccaaggagaggtacaccttaatgatcggtgcgaacatagagtgtgagaggcgggcccatgcatcatcacaaagaagaacgagagacgaagaagacgagattgaaggaagacggcaatcaactctaatgagaagccgaatcatcagatgcagaagaaaacggatgtgatcgttgatgattacacactttccatgtggagtgacncaaaggagtcatgcc

SEQ ID NO: 719596 - DNA, 140 bp, Homo sapiens
  misc_feature (1)..(1): n is a, c, g, or t
ngtttattgtcctaaaggcaggtcccggattttccaagtcaggcttataactaaagcttagggttttttttgttgtgtggtttttttgagatggagtctcactctgtcgcccaggctggagtgcagtggcacgatctcgg

SEQ ID NO: 719597 - DNA, 188 bp, Homo sapiens
tcgacgctctataaccagctgatcacccaggataaggtcgatctcctggtcgccgattccggatcggtgctgacggcgcccgcggtcgcgatcgcgcgcgatcacaagatgttcctgttcgaccagaccggcaccggcgcgagcttcttctccaaggacaatccttatatcgcgctgatggccgaccc

SEQ ID NO: 719598 - DNA, 696 bp, Homo sapiens
  misc_feature (1)..(1): n is a, c, g, or t
  misc_feature (172)..(172): n is a, c, g, or t
  misc_feature (323)..(323): n is a, c, g, or t
ntccccaaaaaaaatttcccaaaggccgggcacatggctcaatgcctgtaatccaaaatttctaaattacaaggtgtaagccgctacacctgccaaaatgttcttatttttgctttttcaacgccacatatacctgaagcatcctctttctaataagtcctcatgacctccntatggcatgcagaaaagcccaccctatggctaacctgcttggaagaagccagaaaagcgattctgcctgtaccttagggctgaagaggtgttgaaagaacccactcagcacccttgcttggccctgggggtggcctccaagcccctcagcncaggcctcagccctgccgcaccttgtctttcaggtcccgcccagctgcagaccctccaggctggaggaccagccgccctccttccctcttggatggaagtaaaaagccaagctttctccccaccctctgtgggccacacgtgcacttgcacccaccacacacacacacacacacacacacacacacagacacacagacacatacgcacacacgtgcacacatgtacacacggatacacacacacacacacacacacacacactgcatatctgagcacgcccctcgcactgggtctcaccttgcaccttcttcaggattttatatgtgaagagatttttatatagattttttccctttttttccaaaacacttt

SEQ ID NO: 719599 - DNA, 468 bp, Homo sapiens
cacgagggcacgtcagattggctgcgatttcctcattaccgggcccgcacacagcaaaattctcggcgaaaaaatgctcggcagcacagcggcccgcattgtccggcgcgcatcgcagcccgttctggcggtcaggcggcggcccgaaggtccttacaagactatcgtggcaggggtcgatttctccgaggcatcgagaaccgcgctcatgaggggccgtgcgttttttccatcggctcaactgactgctattcatacttacagtgtttcgcctaactgggccggaccaaacgcagacaagtcgatcgacgtcgtcgagaccgaggaacgggcccgcgttgtcagggaggccgagcaggacatggctgacctcgttgcaggcttaaatgacgcgccgggtcgtatccagaccgtcctcatggagggcgcgcctgaaacgacgctcgcggacttcgtcgacaagaagtg

SEQ ID NO: 719600 - DNA, 361 bp, Homo sapiens
ccatgaatacaatccagtcatatgttgcctacatgcatgcactatagcggtcctactgttctgtgagcagttctaagagctcatcacagattagatcgtcccgagtataggtagttcatcagcgctataagacagatatccatggctgccataccgtgcggtctgacgttatgtttgtctatatgcagctcattatgttcgtaggcatcatagagtcctgttccactcatcccaggtctagtcacagctgtgacaaatggctaaccatattagtgcgtcagtgctcaccagcgtcagtatgtagcagaaggaggcttacgttcacaccatggttcatcaagactagcccacaggcacacag

SEQ ID NO: 719601 - DNA, 507 bp, Homo sapiens
  misc_feature (9)..(9): n is a, c, g, or t
aataacctncttttacaatcactaatatctctgtccagcttatgatatcattaccctcagagttcaagaagactgagaaaataaaatcccttaagtagattacattcgcttcctattctgaattggttttacttgaattaatctaaattaataaaacatttacagtcaattataccaataataagattcaaccaatctgctctggtattttaatgtgataaacatcctaatttactaacttatgcaaatttggtgctatagtttttatcttttttaaagtttccaacttgctatcaaaatcatagttttccttattttttgaccaaaacaccatccagaaatttcaaacaggttctacttttttccattcaacttaagctaccatacttttttcttctgctattagtgttctgtttagttatgctcttgttataaaatcagttacaatatataatccaaaacatcatcctacaaaatacttttaactgttctacctatcctttttct

SEQ ID NO: 719602 - DNA, 87 bp, Homo sapiens
acatctgtgtacttctgtgccagcagtttatctttgggtttcggctatggctacaccttcggttcggggaccaggttaaccgttaca

SEQ ID NO: 719603 - DNA, 403 bp, Homo sapiens
tcatgtccgtcccaacgatggtctcagtgttacgacctgctggattagagcgcccgccatcacgcgcgggtaatttttgtacttcttaatattgactagtctggccaacatggtgaagccccatctctactaaaaatacaaagaattagctgaggtgtggtggatcatgcctctagtcccaggtactcaggatgccgaggacagagaatagcttatacccaggaggcgggggttgcagagattgtgccactgcacttcagtctgggtgacaaagtgatactccatctcagaaaaagataaatacaagcatttgaacagtattatgtgcgtgcttacaatgtcaattctaagtaacagtagtttaccaagtgtagagtaagtccttggagatggccatcgtagg

SEQ ID NO: 719604 - DNA, 166 bp, Homo sapiens
  misc_feature (14)..(14): n is a, c, g, or t
  misc_feature (42)..(42): n is a, c, g, or t
ggtgtgaactaagnttgctgctaaagtaatatatcctgtttntattcccaagtgtataatgttggtgtggagttttcatgacagaatatacacattttgtaaatctgtactttttttcaaatattgaatgccttatttttgaattctttagatttttaaattggag

SEQ ID NO: 719605 - DNA, 913 bp, Homo sapiens
  misc_feature (546)..(546): n is a, c, g, or t
tggaaatggattttgttgcccaggctggattgagtggcacagtctcggctcactgaaacctccacctctccgtgggtttcaagcagtttctcgttgccgcagccctcccaagttagcgtgggactacaggcattgcgccaccacgccaggctaattttggatattttatagataaagagtggggttacaccagtgtctcaaactccttgacctcaggcgactccacccaccttcagcgtctcccaaaggtgcgtgggattataggcgttgagccaccgaacctgtggcctattgaggtggctctttaaatttaggaacaaattctatgtggaaaggaaagtttgactgaagtttggcccacaggagattgttgaaccgtgggcgagtgcctttcagtgaaaggtttgcccacctttgggaacgccccaagtttatcacggggggtgttttgtgcggaagttgcgaaaaaggcttctcgtggcaagctgtgccgtgggtttgggccaagaacccctgtgcctctccccttcccgcggcggccaaccncctatatttcccctttccgtgttcctcccactttgcattctcaggggggtgagcgtgcgtgttccgtgaaaacactttaaacactgtggggaagaaaacaagatggggcagctcaccgcgtcggactccctaggggggggggggccatttaactcttcgttagaaaacttttctcagataaaatccccaagagatttataagagacccccccccaatttatattttcccacggtgtggggccaattgttgccggcgctcatagagccaagttaaccccgtgaaagtgcccctggcgtgtcgtagaaagaaaccctgcttccacagggaagggacaggtgggtgggccccctgggacaatttgggccc

SEQ ID NO: 719606 - DNA, 399 bp, Homo sapiens
  misc_feature (67)..(67): n is a, c, g, or t
  misc_feature (268)..(268): n is a, c, g, or t
aagaattctaaatgaagtacacatccaattcagtgagaaattttatgaactcagcagtaactacttnctttagtattgcctattctcaaaagtttttgagacctttaaagattgagaaccccaaagagctcttgtttatttgggtgatacctgtcaacatttgccctattcaaagttcaaacaaatttgcttaaaaataacaataaattaagcgtattgcattttaagatagcatatttttaggaaaaccgtttttcaaaattaaaangctgtagtgcagagagcagccttgctttccacttgtgcagctctgccatctggctctgtagatctgccatggcattcacctgcctcacggtcctgcctcatacagcatttggaagactcccggtgttctcg

SEQ ID NO: 719607 - DNA, 364 bp, Homo sapiens
ggatccggtcccatcacagttggaggaggagtgcgctgctcaggtgcgtgccgggccatagagctgttcagcatcggtgcctgaggagacaggtgacaagcctcgtggttctgggcagtgcatggagctctgcgggaatgactcggtgtacgcctaacgctcctccgtgtaccggaagccaggagtcgcggaggcgaagatccagtacgcgatcatcgggactgggaagctgcgagcttgctcagggggggtgtaaggaggtggtggaactcgaagagggtgggctcgggggcgtgctggtcattcgggtgggtaaaggccttgattgacctgctggggggaggattcttcacttgtggccctt

SEQ ID NO: 719608 - DNA, 1130 bp, Homo sapiens
  misc_feature (1130)..(1130): n is a, c, g, or t
agcggggcggtgtatggagcgcggtggcgcgcgagcgtcccgtgggacgccgtcgctgctgacggcggcgaccgcggctcggaggtcgtgcgggggtctcgtgaggcgggtcgtctcagtcatgctgtgctcagtagtgatggtccaagttgttactaagagtgcttgtctcgcgtgaaagtgccttgtgcatcaattggtggccagtccatgttgtgatggataagtgctgtaggaaaggagatgcatggatagagacagatttgaatcattgccttaacacaggttgagtcggggaataatagagtactggaatgtcaggacacttgcattgagagggatatacagcgaacaaagtgggatctattgacgaagacctaggaagcacgtaaaaacgaagcaagattcatggtgacagcgaacagagaacttgtgcagcaatcttgggcgcaatgtgcagattcagactgttaagacaaacccgggggactactttgcaaggataagtccaatgcgacctaacggtccgacacagaataccgaagtgaaatgaacttatagtgtggagcagaaccgcttaagtacggaaattgcccgcttaaaatggacctaaatgtgataagaacaacacagatgttggaagggcccggcgcaaaattgctgaggaagaagaaatacttgaatagagagaacttgattaccgtgaccaagaattggtcatgcgatgaaccagagaaacatcacaggggtaatcacgcgaatatgcaagtgatcatacacccaaggaaaacgatagagcaagaggctttcttataccttgtggaacatgggtggagatgtgatcaacccatgaattaatttgacctgattggttacagatagagaactggaggacatgtatgagagagaagacataggattacacttgatgaaaagcggagaacaagtgtcttcacatgacaagagcatagtcgcctagaggagatacgaactttagagagaagactcttcgcgagagaaggaacgacagcacaacatgagcaggtcgctcaaaggagatcaaccaccaaaactatggggtgattgatagcggctctagtggacgtaccccacgatagtagtaaggcctn

SEQ ID NO: 719609 - DNA, 240 bp, Homo sapiens
tgcaagtgactcacgtggaggataaacatttgtgcgcttctaaccccccgcttaacaccacagaaagcccctaggaccccaggagggggagccttaggagagacctagcgcagccctccagggacaggacggacttaaccacggagaacacgtgcttccaattcggaacttcaaacctggaagtttttcacatagaggataactcaggctgatcgcaacatatagggtgtgtaggggggc

SEQ ID NO: 719610 - DNA, 324 bp, Homo sapiens
  misc_feature (228)..(228): n is a, c, g, or t
actaagaccctcgatcgagttctctatcatatgtctgtatggattgatagggaagctttgttggaatacagagccagaagaatcatgaataaagaccactaaaagtcgatgaccaggagcagtgatgagctgaggacatgaagaagccatgataggatgtagatgaactcaataacaggtgagcgagctgtccagctgtacaaagaaagccaggctgagctgagggtnacaggaagaggaatctctagaggattgtcacagctgaatatatccataagcagagcatgagaaactgatgcattgacaaacgtgtccagggctaag

SEQ ID NO: 719611 - DNA, 192 bp, Homo sapiens
caggaccttgtctagccccgccagtgcctggaatacatggcatgtgccactacgcccggctggttttgtatctttggtggagatggggttctcatgctggtcaggctggttcaaatctcccgacctcaggtggtccgtccgcccagtcctcccaacagttgctgcgattacaggcattagcaagtgcagcca

SEQ ID NO: 719612 - DNA, 335 bp, Homo sapiens
tgctcaccagcccatgtgggttctgactgctcttggaaagttgttctctacttttgtagtcattatttccttggcctcatacattctttagcctcatgttcacgatttagtcttcagtgacttgagaggaccccatttcagatttctggaacgttttctctatatagattccctctcactgatactctctgctcaggcaaattccatctcaaaatccttgaactttggctgggtgcagtgtcacgcctgtaatcctaacactttgggaggcagagacagtaggattccctgagtgcaggagttggagaccagcctggccaacatggtgaaacccc

SEQ ID NO: 719613 - DNA, 330 bp, Homo sapiens
  misc_feature (32)..(32): n is a, c, g, or t
aatcagaaaccctaggcttggggtcctttaantattagattttttaaagctccctcagtaattccaatggccagtccagtttgagaaccccccatttaaatttccagtttggggggatttgaaaatttaagcccttccccattcgaagcccgctaaaaatgtagaatgattttgagccccttgtgggggataataaaagaattaatgtggcttcaatgcttggagcctttttgttcaagtggccccggtttggtgaaacagggctcccctgtcatttgcccgtcccggcatattttggagttttgccggaaataatattcccctaattga

SEQ ID NO: 719614 - DNA, 842 bp, Homo sapiens
  misc_feature (281)..(281): n is a, c, g, or t
  misc_feature (304)..(304): n is a, c, g, or t
  misc_feature (307)..(307): n is a, c, g, or t
  misc_feature (325)..(325): n is a, c, g, or t
  misc_feature (339)..(339): n is a, c, g, or t
  misc_feature (345)..(345): n is a, c, g, or t
  misc_feature (385)..(385): n is a, c, g, or t
  misc_feature (433)..(433): n is a, c, g, or t
  misc_feature (487)..(487): n is a, c, g, or t
  misc_feature (506)..(506): n is a, c, g, or t
gctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttttttttttttttgggtatctgtcaatgaaaatanggtatgacccagtttttacctantcngactagaagttattccanttcagggtctgaantagganttttaccttaaaaaacaacaacaaacaaaactatcacacnggatagataagaagatgggttaaccagtttggtgtagatctttggggngctgaactatgacttgagccttatagatggtaaaatagggatagtgggaactantgtccagaataaatttttnaaactttattggcggttaaattctggtgaagttccagttatctaaattaattttcccaatttctgacattctcacggtttcagattggcagggtacattatgtaatagtagggttcggaaaaaactctggtctaattttaactagtagtatttggattggtaccgcataaattgtgttacactggacttcatttaacattcgctggtgtctgattaataatgtgagtcctgatttaagattgtgtgcgcaagtgtggcgtttaaaacttttgcaaggttgttggcgagataggtttttttggaaaaaagtatataactttggggtgcccgaaatgg

SEQ ID NO: 719615 - DNA, 359 bp, Homo sapiens
agaagaggagtgggtcttgctatctcacgggtggcagagatggaagaaaatccatctataagtggacccataaacttcaaacctgtgatgctcaagggtcaactctgtaataaaaaatgtgcgtgtatgcgcatgttctcactcataggtgggaactgaacaatgagaacacatggacacagggtggggaacatcacacaccggggcctgccggggttcagggaagcggggagggatagcattaggagatatacctaacgcaaatggcaagttaacgggtgcagcacaccaacatgtatacatatgtaacaagcctgcacgttgtcaccatgttactctattaacttaaagtaaaatta

SEQ ID NO: 719616 - DNA, 485 bp, Homo sapiens
gagagggctctcctcccagccggcccctgcagcctcgtggagggcaggtacaggtgccacctcggatgggagcctgggtccctgctgccgctcgtgcccctgggtggctgggaggagtaggccctctccgggggctgaccatgtggcgtcagccgtgggaagccccactcctccatccctggagtctgcctgagtccctcgagccggagcgcttccgcttggactgtgcccttgccgtatatactccctcttcatgaattcttggttgtgtgacggacggcgcccccgatgttacgtgtgatctttccccaggaagaagcacaataaacatgcagtgataccgaggcacaaaaccccaacatacacgaagagcacgggctcgctgcggggtaccacgatctattcccctcgggggggcaataacattcagccgggtaccccccgcctctttggctcccaaaggtggcccctaataaggtagaaca

SEQ ID NO: 719617 - DNA, 246 bp, Homo sapiens
caactcttcatacgtgatatacaaaagatgcgggaaagaagaggaccctctatggctaacggagatgaaacagttagctctatgacacacttgatcgaatatgacagacactgaaaatcacgttttcatccccctccaacacctctacctgttgcccgccgatcacaacctggaatgcagtctgaaagattccctaggggcctaggatccaactgcccactgtaggactctgtaggcctctgtatt

SEQ ID NO: 719618 - DNA, 88 bp, Homo sapiens
  misc_feature (12)..(12): n is a, c, g, or t
cggcacgagccngatccatatgaaaagcgtcattccatccgatggtcccagtgttgcttgtgtgaagaaagcctcctaccttgattgc

SEQ ID NO: 719619 - DNA, 763 bp, Homo sapiens
ggggctggtaccggccggagatgttaaggatggacggtcaggtgagacctccatgggcgcagggaaggacgtgaggagtgggaagcgggctggggaggacccccacagcttctagcttccctggacaggtacgtcttctaccaaggccctgccccggagctaagccagcactgacatgcgtggtgcctccaggaccgctgcgggtggtaaccaggtggaagaccaccagcaccccagggatgaggaatcccgttcgtatcgccccagccagtgataattaaagctgctcctccgcataagaagaagaacaagaaacaaaaaagggattaaggaaacaagggggttcagcgaaagaaaggaggcggggcgcataacgagtgatacgcacaaccggccagggagtggcccgcccatgtactggccgcgggaccacgcccgcccgtgggtcatggtgtccggacgacgtgagcacacccaccaatattacgcttgcggccggaacattgatagagccctcgggtccactgtcgcgatgggtacacgcgtggctgtgataaatttcacccaggagctacgttcgtatgctccctgcttggagacatacacctctccggctaccactcatagcaagagaaaactattgtcgtagcgagcaggcgagcctaccccacaatcatttatgctatagtaagagggtcgtgcagctcaccaacaacgtgtgcgtagggagacagctaaactctcttctcttcgaaatcagaat

SEQ ID NO: 719620 - DNA, 1047 bp, Homo sapiens
aaggtggcggttgtacaactctctgatcagtgtcttttcagcactcttgagcatttactatggctcatttagtctacctttagtagcgcatggttgggaggaaaaagtgcatgcatcattcctatcactcttctcttgattccagccgatagctactgttggccttgggctcagatggacagacgacgatgaggctgacgcagatgatgaggatgccagatgacagatcgcacgtgaaggatggaatcagcaaaagaaactcagggagactacagccagccaatagtagagaaaagctgcagaaagttgagaccatgatgcaaagaccaacagaacggggtcagaggatgaataagaagagcagggtgaagagggacaacgatgacggcacgacgcatcgccataaaaactgaacgagtgaacgcatgactgaatagtgatcgccgcgaggggaacgattgccgagtacagtagcaagaaagctcataattgtaactatcctgtgttactttggcaagcaacgagacatcgtactctttttagatagacattgctcagaagggctgccaatatatggacgattaggtatcccaacataaatcaatctggagatgtgtccaggttggcacctccataggaaccaaatttatcagttgcagcattgaaatattggtattgaaggtggcgattatagtggacatggcctgtgctgtggatgaatgttgccatatgtctctaggccatacgtattgtttagaattgcactcgttgctatagcgagatggattctaactgaccaactaagggttccttcggagggccaactttacgagcatacacgatggctcaataggcgggcccggggctaagtacgcagtaacaaaccctggatgatggccagcactgaccggcgctggaaataggagaccgacacccggaagaagcagaaagagaaacaacacccgcgtacaccaaaaattcgcccgcaacacaggcgggcaaaacaggacgcccagcaaatagaagcaaagagtatacacggaaaga

SEQ ID NO: 719621 - DNA, 334 bp, Homo sapiens
agctcaagttaggaagaagtaaagaatgtggccttaagaaaggacactttggccaggtgcagtggctcatgcctgtaatcccagcactttggaaggcctaggcgggcagatcacctgaggtcgggagttcaagaccagcctgaccaacatggaaaaaccctgtctctactaaaaatataaaattagtcgggcatggtggctcatgtctgtaattccagctactcgggaggcggaggcaggagaatctcttgaacccaggaagtgaaggttgtggtgagccgagatcgtgctgttgcactccagcctgggcaacgagagtgaaaatccatctcaa

SEQ ID NO: 719622 - DNA, 426 bp, Homo sapiens
  misc_feature (333)..(333): n is a, c, g, or t
  misc_feature (345)..(345): n is a, c, g, or t
  misc_feature (355)..(355): n is a, c, g, or t
  misc_feature (392)..(392): n is a, c, g, or t
tcccatctcacaaaaatacaaaaattatcgaaggctgggcacagtgctcatgcctgtaatcccagccctttgggaggcagaggcgggtggatcacctgagggcaggagttcgagaccagcctggccaacatggtggaaaccccatctctactaaaaatacaaaaattagcccaggggtagtgcctgtaatcccagctacttgagaggctgaggtgggaggaatgtttgagccccaggacttcaaggctgcagtgaggcaagattgcgccattgcaccccagctttggggacagagtgagagaccctgtctcaaaaacaaaataaggctgggcncagtggactgtnccgggacgtncgtggttcacgcttatagtcctagcactttgggaggnccggggtgggcagaattgcctgagactcaggagg

SEQ ID NO: 719623 - DNA, 115 bp, Homo sapiens
gggttttgccgccagaacacagggttgtcgtgaaaactaccccctaaaaagccaaaaattggggaaagggaaaaaggacttcatattcattaattggtcggtcattcggacaagg

SEQ ID NO: 719624 - DNA, 132 bp, Homo sapiens
tggtttttggtaccacaaaaaacttgtagaaattattttcaatattaaatttgggcgtttttaagggatgtgttggctattatctgtatttttaaaaaaaatatttgtggtatataaatatttatgtgtttt

SEQ ID NO: 719625 - DNA, 709 bp, Homo sapiens
  misc_feature (271)..(271): n is a, c, g, or t
ggcaacagggatggaagatggatggagtgcagctgggtagtctagtcgatgtgtgaaagtacaatactatgcacatcaacgatatcatcccgagagagtgtggacgcaggaagaggaggcctcccaagactaggctggtatgtcaagaggagtgggggacaaaggttcatgcagtcgataataaggccaaaggcgacaggatctagctcagaaccctggaaatagaaagagatctgaattatgatatagccttaaagtgggtgcttgctgnttgacgtcacagaggcgacaagtccgaaagtcagagagaagatacatgggtacatagactgaagatggcgagaagaccctgcaaaatctgctgtacagagatatgctacgagagctttgacgcgtatgcattcgaaccacgcactgccgagcctcctgcgctgtgaagcgtcactgatcaccggagaacagatgtgccactgcgtattacgcattcagttctcacccaagatggcccaagtaccaatggaagtattagggcagagtcgcactttcgtctgtcagaccagtcggtaatggaagagctaaacagtgcacccgttcaagagagtccaccgttggacatgcgctcctggggaactcacatggtgctagaagggggctcaatggggtgaagttgaaggagaaccctacctttctatggggtaaatccgtggat

SEQ ID NO: 719626 - DNA, 377 bp, Homo sapiens
ggtctctttacgatcaggtgagtcatctgctgaaatctttataatagacttctaccttgatggaatgggttggactaacgaggaaccaccattactccaaggcccagagcagagctgggccatcaactgtctccacacttcctgtattctaggtgccaccctgatccctcattgcctttcagctgcatgtctaatccccaccccacccctcatctagttggctttgattccaaggacctaggactggagtagggctttcacaaataagacagcaggaatgtaatgcaacctaatgagcagactaagaaagcatctatacagaagaacagacatacaaataccaaggcagataagagtgacaaaagacaaaaaaaaaa

SEQ ID NO: 719627 - DNA, 121 bp, Homo sapiens
ggacccgtcctctgatccagtctgggagttcaatctacaggcccagatgttggccaggcatggtggctcacacgtgtaattccagcactttgggaggccagggtgggcggatcatgaggtc

SEQ ID NO: 719628 - DNA, 744 bp, Homo sapiens
agcttgggcaacatggtaaaaccacatccctacagaaaatacaaaaaaaattagccgggcatggtggtgcacacctgtagtttcagctactggtgggagtggtggggatgctgaagtgggaggatcgcttgaggctgggggttaaggctgcagtgagctgtgatcccgccactgcattccagcctggatgacagagggagaccttgtatcaaaacaaagaaagttgtaaggagtctttattctggatgtagcatatggtttgcaaaattttctcccagcctataggatatttaattttcttaactatgagatagttaatattcttaactgtcttttaaagagaaaaagttttaattttgttgagatccaatttatctattttttcttttatggtttatattttttgcttcctctccaagaaatctttgcttaagtcaaagtcacaaatatttttttccctatgttttcttctagaaaactttaaagattaactcatacatttaggtttattgatcgcttttttttccaacgttaaattttcgtgtatggtgcaagttaaagggtcgaggtttgtgtttgcacgtggattaattcatttgctgaagagactgtcttttccctttcacatcagtacctttgtttaaaattaactgattatgtgtttgggctggtttctggaacctctattctggtcatgatttttggtaactaatttcatattgcacctctggatggagttaagga

SEQ ID NO: 719629 - DNA, 99 bp, Homo sapiens
gggattaaactttctagttaaatgttttaaaagggttcaaaagcagggttttttttttacttgaagacattcctttgcattaaaaatatttggaagcca

SEQ ID NO: 719630 - DNA, 459 bp, Homo sapiens
  misc_feature (10)..(10): n is a, c, g, or t
  misc_feature (17)..(17): n is a, c, g, or t
  misc_feature (51)..(51): n is a, c, g, or t
  misc_feature (65)..(65): n is a, c, g, or t
  misc_feature (102)..(102): n is a, c, g, or t
  misc_feature (104)..(104): n is a, c, g, or t
  misc_feature (119)..(119): n is a, c, g, or t
  misc_feature (182)..(182): n is a, c, g, or t
  misc_feature (455)..(455): n is a, c, g, or t
tgtgtccctngcctgcntgcctgctgattggctcttgctcttaatgtgcanacatgctgtgttanacttacccctaccaactgttacccaccaagctttccnanagcttccctcccatnacccacgtgcagcataaccccaggccagcctgaggagagttgctgatctctttctctttggtnactggccatccttggaacaagtagctctcaacctgttcccacaggctggatgtggtttctgtgctttgagagggtcccagcctgggcaacatggtgaaaccctgtctctactaaaaatagaaaaattagccaggcatggtggcatgtgcctgtagtcccagctactcaggaggctgaggtgggaggatcacctgagcccagggaggtcgaggctgcagtgagctgagatcatgccactgcactccagcctgggtgacagagtaagacccgggntcag

SEQ ID NO: 719631 - DNA, 118 bp, Homo sapiens
atagatatgagtatgagacattttttttttttaactggtagctcccatttttaccacaaaaggggtacttggagatggatgatggtgagcagcgggttggtcggctatccttcccctt

SEQ ID NO: 719632 - DNA, 148 bp, Homo sapiens
cataccagtcgcccatcacatacttggtattcctgcctgcatgcgaacttctgccaagacgcgcccagtcatcctgtatcaacaggcgatcttcgatagacaccagtgcgtagtccttgatgaacgagaattgtacagcgtcagccac

SEQ ID NO: 719633 - DNA, 779 bp, Homo sapiens
ggcaccttcgttcttctcagcaccctgtcctggttggggctgttccgggaatgacatcctatccctgtggatcatctcagggtcctgcccagtcccggtccctggcctcaggtgaggacctcacgggattcctggagattcctagcagtggaactcctatgcccctgcgctcccaaacgtgaccatggatcgtgagagtggcccattgggttcctgccatatatgactttcagacagagtctgctgtggtccagtgccatatctccaggagtgaccagctcggcctcctctgctcggcagagctgaatcatccctgtcggaagcgggttgagatgcggctttctgctgcatcccagctactgattgctcgacctatgggcactccccttcacgagctatcggcgatcgaatcacgccgttgatgctccctacctacagggtcctttgcgatcgtgcggcctaccactgtgcgaaaagtttcgtcagcttcccgtcacagtgcttcatacgaatgcaatcatggagtccagtggcatcatggcatggactaattctccctacggcgttaacaactgccaagcaacgcttcgcatccgtcgttttgatatttatggttaaagcgttatgaacaatgtattaagaaagagtgcagctcgagagagattcagagatggaacacaccagaccccagatcacaaatgccaacaaccccccagcacctcccagcacccccagccccacgaccatcgttctgaattctgacgacaccgtgagcctaa

SEQ ID NO: 719634 - DNA, 985 bp, Homo sapiens
  misc_feature (442)..(442): n is a, c, g, or t
tattgttgctcttctctgtcacttcggcgatgctcccccgtggtcgtagggcgatgttttgcttcggcccccgttccatcaccgctccctcgttattgccggcttcttttccgggcctttccctgcctttggcccaaagacagttgcaaaaacgggttccgcccgatcccggattctgcccaggtccgcgctgctttcgcacgccgagccggttcctcccagggcctgccttcaaccttcgagccatacttgcacccaatgagaaattagctttaggaactagagagtccccgcaacaatggatggatttgaaagcccaagcttacttctggcacagtatcctaccaggccgccacatgcagcatgtatgctctataccatccctgaccacttatgatgcacattggaaataaagtcgttcccagatttaggaagtgctttnggagtacttagcatcgggactcgccaatgttaggacccgggttgtgtgttggatttgacatagatgaagaccccttggaaatatttaataggaatcccgaagagtttgagtttcaccaaatattgcaccatggttccaatgtgaagtgtgctttattatctacaccagaatgtcccagatccattccgatcaccgttaattatgaatccctcccctttgggcaccccaaaataataaagggaccagatatggcttttctaaagactgctttggaaatggccagaaccacccagtatattcccttaccaccaaatcctccaactagagaaccatgttccaaaagaaagctgccagaatgggaaatccagatagattattatagccagaacttcgataatgacctgcccagcatcataaccagtttccaccaaaaagaaatccagtggaccattgaagtggacctaattcggttttcctttttaaagcccccccaaccaaagtcgttttaaacctattttaaatgaataaaaaattggtttacta

SEQ ID NO: 719635 - DNA, 775 bp, Homo sapiens
ggttcttctgcggttctcggtgacctctcctttacggtgccctcaaacaatggcctccagtgtggctgtcctctagataggtgtcatcaatgatgtgcgacaaacatgaatcgtgctatccaacgtcattcaactcctaacgatgtgatacaagcagactctaagtgcggtacccttcgtgcctgaatgacggcacttgaatcaaccatcatctctgttgcaccgaggaccacacggcatgatcctcggtcgtcccgatgatgcggccagcaactgtcgagcctagtccacttagcggctgaacttttgtgcagcgatccatgccgagataggggactgtcgcatcctgagcctcgtatgcatgcgaatccttcaatgagacaacaagacgagacgcgcagcagggaggatcttgggtggtcaagtcgtatgtcgtcacccgagcactggtgcgccctcttactcaccccgattgagttgtggcccatgctcggaaagagagcgcgcactacacccggacaatagcttactgcgtaatctccgcaatgcctgttgccagcagcgaccgtgctggcgaagcacgtcaggggaccgatgatctcttggcaggaaaaagttgatgtggctgagacagcatcaccctgaatggcaacgcgcgatgagatcccgttctggaacccctgactagagaatcttggcagcccacactaccttgggagttgaaagctgccccttcgtgcagaacgagcagcctgggcggaacccaccagagtga

SEQ ID NO: 719636 - DNA, 342 bp, Homo sapiens
  misc_feature (8)..(8): n is a, c, g, or t
  misc_feature (10)..(10): n is a, c, g, or t
  misc_feature (17)..(17): n is a, c, g, or t
  misc_feature (34)..(34): n is a, c, g, or t
  misc_feature (51)..(51): n is a, c, g, or t
  misc_feature (53)..(53): n is a, c, g, or t
  misc_feature (64)..(64): n is a, c, g, or t
  misc_feature (76)..(76): n is a, c, g, or t
  misc_feature (85)..(85): n is a, c, g, or t
  misc_feature (95)..(95): n is a, c, g, or t
  misc_feature (118)..(118): n is a, c, g, or t
  misc_feature (170)..(170): n is a, c, g, or t
  misc_feature (201)..(201): n is a, c, g, or t
  misc_feature (211)..(211): n is a, c, g, or t
  misc_feature (320)..(320): n is a, c, g, or t
cattaganantgttatnaaaaactatacactaanaaattggaaaacctagngnaaaaaaagtcnaaaaaatatatntcctactangattgaaccnggaagaaacagaaaacctgaaanacaaataatgagtaatgagattgaatcagtaatgaaacatcttccaacaaanaaaagccgaggaccaaatggttttactgctnaaattttacnaaaattataaagaacaggtaacgtcaattcttctcaaactattccaaaaagtggaagaggaaggaattcttcctaactcattctatgaagccagaattaccctgatatnaaaaataagacaaggacatgac

SEQ ID NO: 719637 - DNA, 593 bp, Homo sapiens
gtgacgaatgcttgctgacctgggccggagctcttcccttacgcaagtctcaggcggtcgtcgtcgagttcgcccgctcgctctgaggctcctgaagccgaaaccagctagactttcctccttcccgcctgcctgtagcggctgttgttgccaggtccgctcaccatgttcgaggcgcgcctggtccaggctccatcctcaagaaggtgttggcaggcactcaaggacctcatcaacgaggcctgcgtgggatattagctccagcggtgtaaaccttgccagagcatggactcgtcccacagtctcttatggtgcagctcaaccctgcggtctgagggcttcgataggctaccgtgacgaccgtaactgggcatgggctgtgaacctcaccagtatgtccaaaaatacgtaacaatgcgccggcaatgaggatatcatgacactaagggccgacggagaacgcggataccttgggctagtattgaagcacccaaaccaggagaaagtctcagactatgagagtgaagttgaggacttgagactgtggaacaacgtgggaatccagaaggggagtaagctgtgtagaacagatg

SEQ ID NO: 719638 - DNA, 500 bp, Homo sapiens
  misc_feature (41)..(41): n is a, c, g, or t
  misc_feature (51)..(51): n is a, c, g, or t
  misc_feature (62)..(62): n is a, c, g, or t
aacaaaaaagggagagagcaatcattgtttccagaagcacngaaaggaacnacccagccgcncttatttttaattacatacggtcgccacactccatctatcaagatggtgaagcagatccagagcaaaactgattttcaaaaaaccttgaacactgcatttgataaacttttagtaattaacttctcatccacatggaaccatccttgcaaaattatcaatcctttctttcattcaatctatgaaaaatattccaacgtgatattccttgaagaaaatgcagattactgtcagcatattacttcagagtgtgaatttaaatgcattccaacattacacttttttaagaacgaacaaaaggtatcagaatttcctatagccaataaagaaaactttgaagccaccattaatgaattaatctaattatgaattttgaaaacataaccagccatagcctatttaaaactgtaatttctttaactacaaaaatatacaatttc

SEQ ID NO: 719639 - DNA, 713 bp, Homo sapiens
gatggtgccaggggaggagccagcgggcgaggcttatggcggttctgttgactccgaggttccgtggagttgtcagtgcagtaatgagcttgcgggcccaggctgaatgggtcgaagttccaggaatcgtagagatgggttctgccggaaaaggaggacaggatgtcttcgtggctcgtttgaaggctactcagaatatgggatggtattattcactgctcttcaggcccaagtggaattgacatggagaagggggcaatcatttaaatgacatagaagaggactgtggtcactgggtgtctgatgcggtgtgcgatgtggtctgtaagtcatcttatgcaaaattagtgccataagtagcaatggacatctgtggtcttaaagggggtgcatcttatgcaagttctaagtgaagtcactaaagtattggaacccaagggaggaatgaagaagcttttcaaaatgggaacgggcattagaagttggaagatttcaagcagtagtctctacgaggtggcctaggcaataaattcagtcttacgagttgtggaaatgacgaaggggatgcttgagaatggagtccaagtgaaactctgtgaagaccaggatttgacattgatttcagatcttcttagcacaggagattggtgaggaacagactcgagggaataattcatacaaataaatgggaatccagctttatgtccaaataa

SEQ ID NO: 719640 - DNA, 402 bp, Homo sapiens
  misc_feature (76)..(77): n is a, c, g, or t
  misc_feature (86)..(86): n is a, c, g, or t
  misc_feature (242)..(242): n is a, c, g, or t
ggttcaacatgcgttatcgaaagagtgttatttcgtgttcggggcccatctatcctggacacgcggcattgatgtnntcgtccgcnaacgaatgtgcacaggggtgttccagaattttggcaaaatctaaatggtcataaaacactttaaaaagaagcgccaatcctcgcaagaagttaagggtggaggaccaaaaagccatttccggggaacaggcaagctggggtaacacgaagcttacnaggtggagtaatttcaatgtgtgagcagttctgggaaacaaaaagggtaggaacagtggaagcgctaatcagaaatacgcaaggcgaagcaggccgtaagttggggaaaaatttaagaaagaaaaagcgtttaaattttgtgggaaattgtggccgggaa

SEQ ID NO: 719641 - DNA, 283 bp, Homo sapiens
acccctggttgactccctgctctctgccagcccctttctacaccccgtgggtccccacgtccccgtggctctctcccctcgtgctagaatctcgctgaggagattgatggggagggggtggtcacgcacgtgggtggagatctggtgccccctgaaggccggacagaaagggccagggcggacaaggtctttgagaactcggtggcatcccgctcctgatggcctgggtcccaccgcccctcccccagccttcctgacagccgaggcgatcgatgttgctgcg

SEQ ID NO: 719642 - DNA, 693 bp, Homo sapiens
gggaggggaaccttagttaataataaaatactacttatttgagttactgatacagattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatgggggcccctttggcccaagccattttaaacctgggaaagtttaatcaaggggcccaaaatgggggcaaattggcaaaatccccctaaaggggggggataaaaaattaaagggcccgggtttaaaaaagggggaaatggaaaaaccctggggttccccaaattaaaccccttggaaaaaaaaccctttttccaaaggggggaaaaagccaaaaggcccaaaccgaagggcctttcaaaaaatgggccaacccaaaggggaaatggaaaattgaagggtaaaattttgggaaaaaatcggggaaaaatttgggaaaataaaccaatttttaaaccaaagggccaaaattgggaaaaccctttaaaatcaaaaaatttccccgaaaagggttgaggggtctcccaattggaaaaagggtcccttttaaaaaacggggctccaaagtaaaagggaaaaaacccttataggggaagggccccaagggaaacatcccctttttttgggctcagggcccc

SEQ ID NO: 719643 - DNA, 455 bp, Homo sapiens
  misc_feature (116)..(116): n is a, c, g, or t
  misc_feature (121)..(121): n is a, c, g, or t
accaccagaccgcgaattttccccgcctgcattttggcgatcagttcctgacggttatcgctgatggtggcgtcgatgtagggcgaaccggtcatggtgtgggttgaaatccagcngcccntcctacgctgttccagtaaaatcccgacccgcagcttgctggagtcgaggttaatgccgtaaccaaaaataaacagcagtagcagcgggatcactaccgcaatcagccagctactcggatcgcgaacgatctgccgcgtctctttaagcacagcgcccgtacgcgacgccaggacaggatcgggttactcattgctatgctccttatcccagtcgtggatcaactgaataaaggcttgctccatggtgggatcgggttgctcatcgttagccgactgtgctttcaaatcgtccgggtccgctggcgattaatttcccgcggtacaccaggccga

SEQ ID NO: 719644 - DNA, 268 bp, Homo sapiens
atgaccaaccattttgtcactgtcctcagagtggtatcctttgccaagcaatgggttgtttgtggagtggccaagtggctatatggcgtgcccaacgggtgctcactttttatgcaatgtgaagaccttatgtaactttaacttttctttgaacacttctcttggattggggtaaatgagtttgagctttttgcccaatagtcccgttgtgtgggcctatcttggttggcgtgactaccaatttgtgaattgtgatgacatgttgggg

SEQ ID NO: 719645 - DNA, 568 bp, Homo sapiens
ttgccttcacacttgtctcactgcttcttatctctttgcctatctctgcctacgtgttgtctttctctggcgtcgctctctctcccttgggctttctctctccgttctctctctggctcactgtttctctctctcgctttcttgctgtctctcgctctctctcgctctcgtgttccacttccccatcttgcctgccatcccccaccctaccagccacaccaggcgcaggcccctctgtgaccagcctccttcgccctcaactccccctgcgtgccctccctgctcctgcgctgtagggtctcggtggcacctaccagacgcaggttgggatgccgaagcgagcgctactggagcgccatcgcgtatcaggctgtcccgtgtggacgcccggatcactcaatggacgctagatggaggagcgccgtggcacgtgaccggcgtggcacgaggaacctgtggcccttcgtatccgatgcccggccccacggccaggctcccaggccgctgtcacggcccgctgtcggtcactgacacaagaacaaggctggagtaaagcccgggcgggccc

SEQ ID NO: 719646 - DNA, 929 bp, Homo sapiens
  misc_feature (194)..(194): n is a, c, g, or t
  misc_feature (929)..(929): n is a, c, g, or t
gagcgggctcacacttaagcgtctgtgacaggagccggaatcgcattctcccttgtaccatggttctagccaaagatctggctgagtgagccctaagaggtagaatggaggctggaggacatgatgagcgagagtagtcactggagttcctgaagaggatgttcccttgtctacagctgctggaggactggacntgcatactactatctcctggcatgtggctacgtgcagcagaactcctggcatgactagaacgaaaaagacttgtcgaccttggtacggagaaaagggtaaagagtcagagaaagagttggttctagtgaagaggctgaaaccactgtttaactaagaagctttgagagcagctgtgggccatgggttgcagacacatacactctacactcttgcagtggctgtgccgggaacgctggcaatccagcacttctggggcaggcctggttgcaaatcaacgaatagacgtaactgtggaaggatgacaagtgggtacgcgcgagactgcagagcggagactctactatcgttcgaacggagagtaagtcggcatctatgcttgatctatacgcgggggtgatgcaatagtgacaagccactgtggctacaggagcaagggtcgtgcagtggtgatgatctcctgtcaatcgacagcaaccctagtcggacacatgtttaaaccctgtgtcctgaggagcgtggcaaagtccatagatcgtttctacctcttggagatggagtaagccagcttggtcctcgttcacccaaaggatctcccgctcagtgttcggttccatcgttacttgtcaccgtttgccatgaactggtttgccgtaaatgttgtggcggggggttcctataccaggcgaactgggtatggggcagccaaaaggaatggggagccgttttctccaacn

SEQ ID NO: 719647 - DNA, 149 bp, Homo sapiens
ttctcacacacgtgataatcaatgcctcttgtaggactcagtttttactctgtccaatggcaggaagtgtcttcttctcaggatggttctgaagattacatgcggaggatgctggtgagatgtctggaccatgataagtcctcatcatc

SEQ ID NO: 719648 - DNA, 512 bp, Homo sapiens
gggggctgaggtgggaggatcacctgagcctgaagaggtagaggctgtggtgagctgtgatcatgccactgcactctagtctgggcaacagagactctgtttcagaataaaaaaaaaaaaaaaaaagaaaaaggaaaagacaagctatattttagtcttaaattggcctttgtcaaaattaaaagcttgtgctgcaaaggacactatcaagaaagggaaagacaacccacagactgggaaaaatatttgcaaaagataaataactcaaaatattggcaaggggccaggcacagtggctcatgcctataatcccagcactttgggaggccgaagcaggcagattacctgaggtcaggagtttgagaccagcctggccaacatgatgaaaccctgtctctaccaaaaaaatacaaaaattagccaggcatggtggctcatgcctgtagtcccagctacttgggaggctgaagcaggagaatcgcttgaacccgggaggcggaggttgcagtgag

SEQ ID NO: 719649 - DNA, 444 bp, Homo sapiens
tcgaatataaatgtttttattgaagcagcagtcacatgaccttatatctagcctttagattaggcctgacagagggagccagccctaaaaaaatgatgtttctttttgccctaagaaacataacatgtttacatacatcatccaatattggaaaagagcagactcaaacacaacatggggtgggtccctgggaggtacagcccccctggtcggggtggccatattttttacagagacccccaaagaccattactaataggatgaaagttaaaagaaaatacggcccccccaaatcatggaccaccgttattcaaaaacgcagcttattcccatttaaaaaactggcccttttaaaaggtggtttccttttctttttctaaacagagtctgggaaaaactttcctcttacataaaaatatcaaagggttcccaaaggggggaaac

SEQ ID NO: 719650 - DNA, 152 bp, Homo sapiens
agcagagtgtggctagaggggaccacagtgagggagaagcagagactgtctggaaaggggtggttagattgaaagctaagggggcccagttgggacacaggggagagaaaaacaaatctaaatgaaatatatatttagcaaccaagaggggt

SEQ ID NO: 719651 - DNA, 246 bp, Homo sapiens
tgtcatatccgggacgggacagtaaccatccccgtggtccgactacagtcatgtgccaactacatcaatgaaccagctgctaggccctgctgtagaacgctaagacctacatcgccagccagggctgtctggaggccacggctctatgacttctggctagcattgcgtggccggagcaacagcctgtgttcatcgttcatgaccatcccatagtaggttgggaacacacaggccggtaacaagagt

SEQ ID NO: 719652 - DNA, 792 bp, Homo sapiens
tttctcatagtttagggatagcttgctggtgagcctgggttccctaggaatacggttatacctaaaaaacaaactggatagattcagccagactttgaccttgttaattcatgactcaacctcgacaaaggcctctccctttttttttgtggcaaaatatacataacatttaccatgttaatcatttttaagtatacagttctgtcatgaagtatagtcacattgttgtgcaactggcagtctttcatttggggactttgtggtttgatgaggtacaagaaataaaaggagggcagacaggaatgcaagtcagtctgttgtgagaagagactgcattggggtccagaagctgagtgctagttctgggtccaccctacagtgtggcagttataactcgacttcttttttctggagtgtgacaggagagtaacagcagtgcccacctgtctcatggatgctgtaagaacctcacggagcagcatctgtgggtacacgttgaacatcagagtgcagcgtctggctaagggattattttcagaacagttaattgttacatgatgggggaataagttctaacggaaattcttttttgtctttggcgttatcaagaaatccagacacagccttatgggtggacacagttcccctttccaaaggtgaaaaagggaacttaatacaatgtttttttaaaataagattgtaacaatctattgttttgaaagccagtgacatgttcattgaggaaatttggcaaagaaggaaaataaaatcatataacagagataaaaaaaa

SEQ ID NO: 719653 - DNA, 713 bp, Homo sapiens
ccttatgcgaatatgagtccaagtccatctaaatttctctcgtgcagcattataaacaagacatatagctgaaatattgtcagtcctaaaaatatctgtatttctctgcccagatttgcagtttgggtagatcgtgctgtaaggaagatatatcttgctataagatagctgccactgattagatttattcttagtctattttaatcaagattattagcctatgataagtctttcctttttcattctctaaatttctgaaattctatcatttcatgttccccaggaaagactagtaagacgtgtttttattcaataagacattatccgtcatttccaccatgacataacttatgggactttcatgtatccaagattactccctacattgaactgctggacacattaccaccatgaaagtaatttgtcgatatgtcgtacacacgtcaaacccaagacagcagtcaagaagcaatcacctttattacactcttattaaaaagaaagcatatcgttcattcatcacaaggaccatattattccccttaggatccaagataatcaaacagttcgttatagtaggaaagccccacgggccccttgagcgggactttgccaggatcttacaaagcaatttacacaacaccttcaaacaggtcatttccaatccattcatggcttttcccttcgaaccgctttcccgaggcaaagcccat

SEQ ID NO: 719654 - DNA, 88 bp, Homo sapiens
  misc_feature (20)..(20): n is a, c, g, or t
gatcataaatattaataatnaaaactgagaaactattcacaatgcattccttataaataaatgctacatttagtaactcatttcaccc

SEQ ID NO: 719655 - DNA, 208 bp, Homo sapiens
cagcgccacgatgcccgcgtatcgttcgaatcctcggcagccagctgggaatcggaagagagaacccacccttgcgtctttcgctgcggcgtcaactactacatgctctataacggcaacggctacggccgcacgggattcggcatcgcccgcctgctgaatcccgacagcctgctcgcctgaggaatcggcccccgccacgcggcat

SEQ ID NO: 719656 - DNA, 793 bp, Homo sapiens
  misc_feature (1)..(1): n is a, c, g, or t
nggacccacccctgggcgcgctttgtgcattgcgtcaagggattcgggaacctcgatttccgaggcggtttaaggggagtagggcccggcccaataattgctcaaggctcgtttgtggggctccctataattaactcttttaggagctcggattgggcaggcgccgccattttaagcgggggccccgtagggcaaggaaatttcgacagaaatgtatcgctcatggtgaaaataacgccccatgtaaggtttcaaaaatggattccccacgggggggccgaccaccagagaaaggttggtccgcccggccggcataatttcgccccagggccacaatatggtctctggcacggatggtcactcgattttacacggccgagtttaatgtctcccgggtatgagtcttggacgttcaggggtccacatagctgaaccaaaagaagtggcagagtcaaggcctgcctggcacaggtgaagaagtctcttctcagctagtgatagtcagcaagggcgggcacggaggccctgtacagtaggacataccggcccgcgggatatgagaaaagcatggtctgggcacgccagagcgcggcagccatgagccctgcttcgggcatttgcactcccccaggtctttctgtgtgaaggtagaggagtaacagccagaaccccctgcagtggtcaaggggagcgtctcctcctcccctgatcacacagggttcgtcagaatgccgccgtcccagtagatctggcatcctccgctcatctttagcctgcattcttttcaatcaac

SEQ ID NO: 719657 - DNA, 104 bp, Homo sapiens
tgttccactgagagtgtagctccttccatagagcagggcatgatgatgtactcactctgacaccattgtgagtgccacatttccttcccaaggtccttgtcacc

SEQ ID NO: 719658 - DNA, 907 bp, Homo sapiens
tagatgtccgcatgcaggatatcagtatggatcttgttccatgagagataggttgatagaatatataggctcaggtgattcctattgaagaatttgaaggaccgcctccacatattaacgcgaccacaagtgtgtctaataaatgcatgattgattatggtcgaaaccacactatgtttagatcatggctgtgacagcagggttacattttcttcactcaaatttggcgaatctcaaaattagatcctaagatgtgttcttatacatataacatgcgtttatggaaattctatattataagtacagaatcttgtttgaaaataacctaattcaatatattaaaattccaaattcatggcatgcttaaattttaactagagagtttctaacagccattctcgatatattgaccgttccaggttgaagtcagtggaactctgaacattctcctgtggaaggcagagaaactctaagctgtgtctgccccaatgcagtaatggacacactgccatgaaattacctggatgtactttttaccgaggtgaccagagttggggaacagcaactcccattaacaactgaccaagtttctcttctacgatgatatttgaccaggtaaccatttaatgctgtttttggaaagtccaaactcagaagataagtctggaaaggctggtttggacacgacagggagatgaagtcaaggtgtgttttaagatgggaattattgctagctgggaaagcaataagctcaagtgaatgtatgctcccctttagacaggtgatgagttcagtttacagtttcatgcattacttcaagaaattacagggccagcgcaggggttcaatttaaggttgggatttgacacataaaaggggtagaaggaattgtgagggggagaaaaaa

SEQ ID NO: 719659 - DNA, 348 bp, Homo sapiens
tcggtacctctgtcactgtggctggagtgctgtggcgtgatcttggtcactgcaactctgcctccgagttcaagcgattctcctacctcagcctaccgagtagctgggattataggtgcctgccaccgcgcccggctaattttttgtatttttagtagagacggggtttcaccatcttggccaggctggtcttgaactcctgacctcgtgatccacccacctcggcctcccaaagtgctgggattacaggagtgagccaccgcgcccagctaaatttattttttatactgttccatccacccctcaaacccaacacttgaccacaatgcaaaaagacaaagggaaaca

SEQ ID NO: 719660 - DNA, 824 bp, Homo sapiens
  misc_feature (439)..(439): n is a, c, g, or t
agcggagcgcggccgtgtgtgtatcacgccctacgctcgcttgctcgccggcctcagggataggcatcgctgggcgcgggagaccccgccgtgggtccgaggagttgtgggccgggcgtacgagtgaccacgcgttacgagcgctccatcgccctaatgtccgtcgagcgcgtggcgaaacgccggtgcgaacgcagcctatcccctcatggtcaacgctgctctagtctcggagacatagacgacctcatcgcggacaggctcggagcaagcgagcatgcgagggacgcagaatgtgcgaaggccttgtggagcccgacggaggtcgaagcgattgattgcagtcttgctcgttttccgttggcgacaattgtggaaatctgcgtgcgagtcattacctgccgaccatcacataacgctagactgttgtactacacanaagtatatagatcggctcaaggggattgagcactacgctattttgacaagttggaggagctttggttggaggtcttacattgggccgtatcccttagtagaatcgtgtagtgaaccaagcgagattttcgtcccgaaaacaatctgaacgattaacaccgactaggacatcgatcgcaattaggtcccgccttatgggcagagggcagatttccatagaaagtcgtagctttctcgaaagatataaattttcgtccaggcaggagccatcccagaggagttttcatgattgcttgcaaagaattgaagacattggggcgcaaaatttcgtaccttaggctcggcgggttgcacccttgtagcgttaatatcgttaggacacaata

SEQ ID NO: 719661 - DNA, 566 bp, Homo sapiens
  misc_feature (528)..(528): n is a, c, g, or t
gctataaggaagtacctgagactgggtaacttataaaggaaagaggtttcattggctcatagttgctcatggctggggagacttcaggaaactaaaatcatggaagaaggtgaaggggaagcaaggcacatcttacatggtagcaggagaggcagaacgagagaggggaaccaccgcacacttttaaaccatcagatcttgtgacaattccctcactatcatgagaacagcatgggggaacctcccccatgatccagtcacctacaactaggtccttccctcagcacatggggattacaatttgagatgagatttgggtgggaacacagagccaaccatatcagatagctaccaataagccaagacagtgaagactacaataaacacctaactcttcaatgcccagacaccaaagaacagctactaacaccaacaccattccaggaaaacatgacctcctaaatgaactaaataaggcacaataacacatcctggagaaacagagatatgtgaccattcagaaggagnaattaaaatagctgtggtgggaaaacttcaagattttc

SEQ ID NO: 719662 - DNA, 104 bp, Homo sapiens
aggccccctttccaaagcccggggggttccctttttcctttggccccccccccttttttttttagctttttggggccccctaaattggggggggggtttcccca

SEQ ID NO: 719663 - DNA, 113 bp, Homo sapiens
tcacatctcacaatttccactgctcccccagctcctggcaaccaaccattctattctctgtttctatgagtttgattccacatataattgacatcatgcaatatcttcctttc

SEQ ID NO: 719664 - DNA, 1502 bp, Homo sapiens
  misc_feature (1079)..(1079): n is a, c, g, or t
ctaaaacggtgccagtgagaggactcaacacgttgggaccaagagaagcagacagtgttccagtgacccagactcgagtagatgcccagtcagtccaggtcaaggcgcctggggacagagcgcacaacactggaggggctatttcgcccaaggtatcaggcccaggctagagcaggggtcgaacaggagctagacatgaacttgtcgtgcttgtgtcctggcagctcgcgaagagcggctgatcactgcaggagggcttggtgcaagagcttcagcaggaacccaggtggaatttgccaggcacagcaacggagggggacgtgaatgtccccaacgtaggagggacgcaaggcagaggagggcgtgccacgagcgatcgaggaaggcaggcgccgtgtctccaagtgcgaggcccacacgcagaatcgtggtcctcttctgacggtcagggagaacctgtgggctcctatgcgccaggtccttcagctgcatctgacggcggccaaggacatcgtccatttccacggtgggcctcaagaacagactggcatgtcgtcacgaggggaacctaggcagccacattcgcaaggcctagcacgcgcagcaactccactgttgggcaaaccgattcccgaatggctagtttcctcgccccggggggatccccgttgccgtcgtcccttgcaccggagggaagagctcgcaacattccccaatcacgccttgtggccttcccttcgcctgcttttgcccccctcgttggggccctgggtcgtggggtccttcgtgggcatgcccgttccgtagtagcgcagcccatttaagcctcgtcgatccgcaggggtacgttcgtacgggaagccagggcccgttggtgcgaaccctcgttggctagttgtgctggcggcacccaagggttgccccccccgaaattgtcccggccctagtcggagtgtgctgcgccgcgatcttagaacgcgggcggctaattttgcgcccaaggccatggtggaaaagtcctgttcacccggggcacttccaaaccggctgctactggacacggaaccgcattcggtccnaatcggcatctgccttgcccgcgcctccaagcccgcgcccttggaacctagcgcattagtagccacgagatactcggccacttctcatcgacccctatcggcgccacagcaccccgcggccaaccttgcggccaccggagtccgtttcccatgcagactgcgaccgggcattggttcccccttggcgcggaggagtcttacccgccgccagcgctaggggcaagcgacggcccctgcacatccgcccttcgcgggcccgcccacggctcgtcaccacgcatcctgtccttactggtgcgcgctctacggtcgaggcctgtcgtgtgtgttcccgcggcgccgtgcagccactcaccgcttcttttgtttccctcacggccacgtgttgagcagcagttctcccctcctgcgctcgctgtcgcg

SEQ ID NO: 719665 - DNA, 763 bp, Homo sapiens
ttactacatgtgaagacagttactacagatatttcatccacgtcagtatgtatcaagaaaatggaaatgatgcagctataaagaaaagctgttatttactgtagttgtagatgtattcactacagaatcatcatttttcagcaggccacagtccagccagatcctataagatccttgagaagaagcgtatagaaaaggatagacatttctgatgtaagtaaagccgcgaagcgacttaatatccatctgtcagtcatcaacttttcccctagattttttttttaactagttgtgaaagtgtcaagaatagcttccctttccaccctacctaggttccctccttgctggcataaaggccaagcagtgaaatgaaccttgggttagagttatggtaggcaaaaagaaaaggagtatttaggaaatgaatatgctataaacaaggtgcagtacagtgagagttaacaatcctaggaatcgggccggtccaaggtcccagttaccggtcattttatcttcatgattagaagtgatattccatttaactattacagaaagcagtagctatgcagactatgtaatagttcacacaaaagggttaagagcttaaaaataatttttaggaaacacaatattcagaatctaaacacgctgataaattattaagattaagattatttatgtgataaatgaaatgctcgggccaatccatacagccaaaaaaagccaagaaaagcagttatttcatttcaggttagggctccaa

SEQ ID NO: 719666 - DNA, 656 bp, Homo sapiens
ttgatgtcaccatagacagattatccgcagtatgccaaagacacctctgggcacatgtactaggtgtgtatacggcacgtgacttcattgtcagtgtacatgtgctggtctacagtaaccaaacgagcatggtacgggtaccagagcagacatacagaccagtggaacagagcagaggcctcagaaataacaccacacgtctacaaccatctgatctttgacaaacctgacaaaaacaagaaatggggaaaggattccctatttaataaatggtgctgggaaaactgactagccatatgtggaaagctgaaactggatcccttccttaaaccttatataaaaattaattcacgatggattcaaagacttaaatgttagatctaaaaccataaaaaccctagaagaaaacctaggcaataccattcaggacataggcatgggcaaggacttcatgactaaaacaccaaaagcaatggcaacaaaagccaaaattgacaaatgggatctaattaaactacagagcttctgcatggcaaaagaaactaccatcagagtgaacaggcaactacagaggggagacaattctgcaatctaccatctgacaagggctatatccgattctcatgactaaccaattacagaaaaccacccttcaa

SEQ ID NO: 719667 - DNA, 584 bp, Homo sapiens
acgctatctgacaggattgtcgcgaggaggacatcagctgatcgcagtcatacatggaagacttggctgttgtcggggaggaaatctctggctcagtgctggacttctaaccctccgcacagggccaggcatgtcttaagcacttgctaattatttgtgggatgaatgacttggcaaagattgtaaataactattgcctgcaattctaaacttactatttaaatttcatgctctatacccctgtgttctaattcatctctaattttcaagatgtagctgaatatttacctttatagagtcttcccaagtgtacctgtctgtatccctttcccaatttatagtacttattttttccactcaagagctggttggtatggtgggcttttcttcctgtattatttttacctaatcctcagaacctgtggatgtcttttcccaagactttatcaagaaaatttccaaatacacaacaaagttgatagaatttaagtcaatctaatgaacacccatatacacactacctagattttaccattatcattttactactactaggttaacaatatgcctgtccatctatccat

SEQ ID NO: 719668 - DNA, 134 bp, Homo sapiens
acttgacatgcgccagcatgccaggcctaaacattttgtgtgtgttttgttaaaatatacatatatataatttgccattttaactattttaaagtatattgttctataggcattaaagtacattcactctgata

SEQ ID NO: 719669 - DNA, 522 bp, Homo sapiens
ggatgtcggtctcacattggagatccccaagagtgtcactatgaagaatgtgtagtagctaccactcctccttcaattcagaatggaacttgccgtttctgctgtggtagcacagatttatgtaatgtcaactttactgagaattttccacctcctgacacaacaccactcagtaagtaaagtaaccaacttttctttgtatttcctttctccaaagatttgcaaaatataaaaaaacttaaaaaacattcaaggttgaagccaggcgtgatggctcatgcctgtaatgccagcactttgggaggccgaggtggatggatcacctgaggtcagagtttgagaccagcctggtgaaatcccgtctctgccaaaagtaaaaaattggccgggcgtagtggtaggcgcctgtaatcccgctactcaggaggctgagacaggagaattgattgaacccgggaggcagaggttgcagtgagccaagattgcaccattgcactccagcctgggcaacaagagtgaacc

SEQ ID NO: 719670 - DNA, 106 bp, Homo sapiens
  misc_feature (35)..(35): n is a, c, g, or t
  misc_feature (98)..(98): n is a, c, g, or t
  misc_feature (105)..(105): n is a, c, g, or t
accggacgccgtcgatggtcagctcgacgaatccnccggcattggggctggacatgagtgggtctcctcgttggtcggtggctgacgtggattacgcngcgagcnc

SEQ ID NO: 719671 - DNA, 253 bp, Homo sapiens
gcgtgaagacacatatgatatgtagtagaatatatctgaccagatgagtgacccggagtctctgggtagtaccctcttaacccagatcagctgcctgcgagcagtcattgaatcctaaaggtttacaagtatttagaactctatcaattcagggcaaaatgttcatgaagtaattcctctaaaacatggttaggaagctaatgacgtaattgcattacagtctggcattacgtttctagcaataattttacca

SEQ ID NO: 719672 - DNA, 159 bp, Homo sapiens
atcgcccacggtcttacatcctcattactattctgcctagcatactcaaactacgcccgcactcacagtcgcgtcatactcctctctcaaggactatcaaacatctgctccccctactagctttgctgctgacttctagcaagccccgactaaactcgc

SEQ ID NO: 719673 - DNA, 118 bp, Homo sapiens
gtagatatgtagatcgagtaggatccccagaattcaggagtaactgagaggatgcatattagcatttcatacgtacccacggtagcatgctgttttgtcaatcaatataaaatattta

SEQ ID NO: 719674 - DNA, 1645 bp, Homo sapiens
gaactcgcgtggctgcgccactgcgcagaccagacttcgactcgctactcgctgcgcctcgcttcgcttttcctccgcaaccactgctctgacaaaccccgatatggctgagcactcgacgaaacttcgactaagtcgaaactgaagaagacagagcacgccaagagcaacacatccactgccttccacacgaaacgattgaacaggagaagcaagcacggcggaactcgctactgaggcgctgcgccgccaatatgccacctgtacctttccacaagctattgcctttcttatctccaccttctattcagccatgatttacctttcgctacagatgccaagaggtcggatcaaggctctacatgactgtgctgccccctttcacatttccacagaaacctaactgaacaaccgaaagcgcccgcgaccttgccatttcccccatctgtcctaatctattcttggcctgcccgccgccagcgagagtgaccttggcatgctcgcgcgaccgccaccagtcgcgccgccaccccgtgcgcggtgccccgaccgcttaaaacctacagctcaaaccagcctgccccacgtgttcctcccgccgtgtaggcgcgctcacaccgaagtggcccaccctcaccggcgccaccgctccacacatgtggacgcccacctcgacaaccgccgccagccccacacccacccaccccgccgcgccccccccccaaacctcacacctggcgcgcgcgcacacaacccacgctgctctaccacgccgacgcgtccacaccgcgcgccccccaccagctgacgaataaacgcagcacaaccgcgcgcgctatatccgcaaccttcctctcacctgttcctccctataaccaccccacaccctcccaacaaccaatcagcccacacagtacttctatccattacatcacaccaacacaacaaacacttcccccaccacacgatatcagcacccaaactactcaccaaactacacctcacaactaacacacacctcatctaccacaccgtggcttcttccgagcgcccactctctatggcgttgggtctctcgtcctgcgttcctcctctcctgcaccgtctatctcgaagactccgtcccagcgcagagcccgacgcgccgacgagacgccacccggcgagccatccactcttctccgcagccgccgttgcatcaacacgcctccccgcagccacagttctcactccacacacttcccctgcccccaccccctcccctacacccacccccctccacaccacccccacaccctaccacccaccctcccccggcccccccctctcaccccccctctacccccccccgcccctcttctcttccacttcccccctccgcaccccccccctgccacgagcctagtcccgtacgccgcgacgggtcgctgccgtgcacgctgcgctcccccgcgcgccgcccgccgtggggccgcgtacgcgcctcggccgccggctgctggtctgggcggacgcgggtctctccgctcggccagagtgcgtttcttcattgagcggggggcgccggcccgtctgtcggccgtctacctgctgcgcgtcgcggcgccgccaccgcagcggagccggccccccggacgcggtggcg

SEQ ID NO: 719675 - DNA, 238 bp, Homo sapiens
tctgacggactccccacgactgtactctgcttggtgggccacgctgacggctggggcacaccctccacgtggactgacgacctgggacacccggctctactggggaccgtgtttggacacccaactgctgctgacactttaacgacccaacgacctgacggacacgacactacgacttgactcggaccccgcttgggtggccacgctggacgtgggtaccgacgactcgacattcagt

SEQ ID NO: 719676 - DNA, 86 bp, Homo sapiens
tcaaatattgcctttatctcgtctcctcagaatacagcgtcccattttccaattttaaatagatgcagcattcctatcaaatgatt

SEQ ID NO: 719677 - DNA, 424 bp, Homo sapiens
tagaatatagtgcgatgatatattacggggagcgctgtgagtagctattctctgtcttcgtacgggattgaagtagatagaacgactgtactcgtctgaccagatacacgtaggactttatcgttgacaaacgaacctttatagcggctgacatcgggatgtcctgatccaacatcgaggtcgtagaccttatggtggatatggactctagaataggattgcgctgttatccctagggtaacttgttccgttggtcaaggttatgggatcaatttgacgtataagtaaggtttcggcttttgacttggttggaaagtcttagccatgtacttgctcggagggttgggtcctgctccgaggtcgcccaaccgaaattttaatgcaggtttggaagttaaggacctgtgggatagaaaggaactga

SEQ ID NO: 719678 - DNA, 1003 bp, Homo sapiens
  misc_feature (31)..(31): n is a, c, g, or t
  misc_feature (222)..(222): n is a, c, g, or t
  misc_feature (361)..(361): n is a, c, g, or t
tggagaccaatggcaggacaggcctgtgtanttggacgaggggtgtctcctgcgcaggagcgcaggcgtaggcagcatggcgccagccggaatggcatggtcttgaagccccacttccacaaggactggcagcggcgcgtggccacgtggttcaaccagccggcccgtaagatccgcagacgtaaggcccggcaagccaatggcgcgccgatcgccccggcncctggtgggtcccatccggcccatcgtgcgctgccccacggttcggtaccacacgaaggtgcgcgcggccgcggttcagcctggaggagctcaggttggccggctaattcacaagaaggtggcccggaccatcggcatntctgtggatccgagggagggcggaacaagtccacggagtccctgcaggccattgtgcagcggctgaaggagtacccgtccaaaatcatcctcttccccaggaagccctcgcccccaagaggggagacagttctgctgaagacttgaaatggccacccagtgaccggaccggtcatgcccgtcgggagcgtctataagaggagaaaaggctcgagtcaatcagtgaggaagagaagaatttcaaagccttcggctagtactccgtatggccgtgccaacgccggttcttcggcatacgggcaaaagagcaagggaagccgcaaaacaggttttgaaaagaaaaataaaggcctcctgggacttgggatcaggcggagccatgctggtcccacgtgggtgttccgtggaccactggcctggatggggttcactgctggtaactcctctgccagggattggggtctgaaagacagcaggctgaaaaaaaaaaaaaaaaaaaaactcggggtttttcggggagaagagtataaagcactttcattttctcgcccctttaggggattcgtctttagtatagtttctttatatatatcatataacgaaaagaaaaaaaaacacaaaccaacaaccaagatactgtcag

SEQ ID NO: 719679 - DNA, 1517 bp, Homo sapiens
  misc_feature (96)..(96): n is a, c, g, or t
tttcttgtgtgtcgtcgtgtgtctcgtgttcgtcaggtttgtgttctatctcactcgtctctgttgcgcgtgtggcgggagggtggtagagtgttngtccgcggctcctttgttctttctataggccgcgtcttcgtccttttctttcgcgcggggttacttattcgcggactgttctccctgtcctttgtgggcccattagtgtgttgtttcaccacgaggcgggtgtttgttcgtatttctgcgggttttttctcccccccgtcgcccccttctatcggcgccataaggggcgcgcccagaagtggggtcgcgccctttttttaagagaatgggtgtaggttggtcagcccccccctcgttgttgctaatatgaagagtatttgttggtgaaccgtcttgtttctctgccggggcctcctcggtggcccctactattgggtgtttcaatggtgtgtttaccccaagggggtcgctgtttgttttgtaagcggaggtgttcttcttgtgagtttgtcgtcccctctttgttgatgagggtccgcctctttttgttggggatcttcttgctcccccgtggttgtgcttggtagaaggagttttcttctgggggggggtttttattttcgccctcctcgcggctcgtttgttttttttcccctctgcggatcgggggtgtgtttttttcccctccgcgggccgacgcgcaacaatgggtggttttccacctggggtggcctcacattggtgggcgccccgcccctcctctgggttgtgtttgggcgccttctcctctcgcgttgatggttgtttttccagaggaattttcccgcgcgcggggtttcgtatgcgcttgttgtttgtctcttgttgtctctttcggttgtggggtcttttattatattttatataaaacactcgcgccctcctctcttctcgagatatccgcggagagaatctctctctcttatgtgtgtgtgccgcccaccacacagtgggctcggcgcccaccactctctccgcgaatataaagaagtaggtgtggaatctttctgtgcccccggaggagggcacagccaacacatatgcttttataataataggggcgcgcacacagaaagggagatctctcccgcccccacctctgtgtgatataaacacacacaagagagaagaggagcttcgccccactctcttttttaactcctctctctccacacagaagttgtttgttgttgtgagagaaagagagtaaatatagtgtgctggagagaagacgcccacacccttgtttgtattggtggatcctctctcgtggggctctctctttgtggaagcgccaccgtgtttttgtggaaaacacaccccgggggcagaaacaaccagggggtaaaatgtgttcgcagagggtgggggagagaagagcgcccccccctccccaaaattttttttataagcttccccccctcccaataggggcccaataaaaaagagtgtttttttggtggggtgttata

SEQ ID NO: 719680 - DNA, 538 bp, Homo sapiens
atccagagatgccatagggcacaaatattaacagtacaagacagctttagttttactagaaagacttgtacaaaaaacatcagttcatggattctacatacccaaaaaactgtcttcaaattaattatagtaaaggaagtttaatatcatcctgaaagttgaaatacattacttaccagttataaacagtatgaaggttgtataatgatatccaccaaaacggatccattccacagaaacttttatgtaacacctactctcaaatattatttccatcttttttggcactcagaactaaaaatttgcgtaagcagcgcaagcaatggagatttacctcactacatcttagttttacaaagatgtggaaagcaatattagatgcatcagcttcacccaccccactctagcatccagtattatcttaatcttctacaacagtttccaacaacaaaccctctacttccatgctccatctcccacacctttacataccatgattatcttgcaaactggatcatagctcctcgacaataagcat

SEQ ID NO: 719681 - DNA, 282 bp, Homo sapiens
  misc_feature (236)..(236): n is a, c, g, or t
atacaaaaatttcaaacatcactgcggtagatatacctccagcgtcagtggggcaacatcctgaaacttgcatctccctgctgcagctagggtgccacgctgcatcacggggaacacagcctctcctggatgcaggaagctgcaagcatctggaatgcttattactttaccccacaaataaatccacaaggtcaatcttcccaggggaaatgagtgccatcgatgaaggtgttttnctgatgagaatgctaaaacgaagagttgtccctttaccagagccta

SEQ ID NO: 719682 - DNA, 1233 bp, Homo sapiens
  misc_feature (516)..(516): n is a, c, g, or t
  misc_feature (528)..(528): n is a, c, g, or t
  misc_feature (530)..(530): n is a, c, g, or t
  misc_feature (621)..(621): n is a, c, g, or t
  misc_feature (1021)..(1021): n is a, c, g, or t
ggggggtgttccaccccaccgggcgcggccgtcccatatggccccgcctctcttgctccacgttgtgccccagcactctgtcgcgggtggccccaagagggctccccgctcatcccctgtttctcaatgcgtcatgtgctgaagccatcctactcttctcttctcctctgcgcttgttcccgtgtgttggtccccgccccacttgccggtcccggccggtcgccgcacactttccccaaggtggtccccgccaacgaacctgttgcctccccctcggtgacgttactctgagaggcgccccccccccgattctagatcccccgcctctcagcagttcccgaccctggggaggctttttaagcccgcctgcccgaaacgggttgtagccctggggcccacaaggtcctttaacctaagctctttggaccccgccgcatagagagttggtctctttgtaaagagaaactctgtggccccgaaagaagcgttgtctgtgccacgcccatatcttcaatngaggaagagagngngaagcaactgtctgtaggagaaactctgagttgagaagctttccacgagaccccaacccgagaggtgggccccgagagtctcttctccctntctcaaggagttattctccaagagaacccccagagccctggtgaatgaccttgtggaagaaagccgggccgctgagaatcgcccaatgtgaagtgttcgcgcctttaacacatttggtgagaaagaaatgtgtgagaatcacgctcacactatactggagaacgtgcaccccaaactgggccacctgagcccacagaattgagcccccacatttgtggtgaaccttcacattgagagagcaccacttatcctctggaatgagagccagggtgtaaagcccctccaagagaattgggtgagcccaccgggagcccaactttgcgcccaagaatgtggaggccgccccgaaatcttggccttgtgccggaaatattcttctctttgagccagcatccacccntgggagagacccgtgaatatatgaagctatagcctcgggctaatttccccactagccctggggtgacttccctggtcaccccaaggcccgtgcacatgcacatgttggggtttccctttaccttttttatatataagttgtacccaaacatccccttaaggttttttgatttgtacccttcccttccaataaagaaatttggtaccccggga

SEQ ID NO: 719683 - DNA, 525 bp, Homo sapiens
gagcctctgtcataatgctctgccctccctcccccgaagtttctctgtggtgatgaccgcgtctctcgcctgccctccccgcttcctgacctctgaagaggttgggaagtgaccatttggatgtctgggccctgccaaggcgacagggagggtcgagagggcaggccggctgcttcctgcccctcaccctttccgccgggcctgcttgtgctgcatttggtgccaaggttagccagtcccccctgttgtgttccgtgtgcgtttcactctgcctcatctttccatcccgtcgccgtgacccggcagcgtccccaaagaatggaaacgtcagcatcaggatatggggccactctctgtgagtccagcatgtacctgtctctccctagatgtcccttcagcactgggactgaacagtgccgcgactctgggcttgaccagttcccaatctcgtacttcatgtcccacaagttcttcagcacaagtggggctaatatccattccaggtaaactgggccatcttaacaa

SEQ ID NO: 719684 - DNA, 110 bp, Homo sapiens
cctgtttacctcctctccctcaattaaagaactaatacttatgagtggctcagagagcaaacattaggaacaactcagaactgctatggaaaacaagatagcaattctcc

SEQ ID NO: 719685 - DNA, 199 bp, Homo sapiens
  misc_feature (111)..(111): n is a, c, g, or t
attttccagcagatagtgtatgtacttttctcttaaaatttctgtctataatcctaatttaagagtgtgagactcaaaggaaaataagtgtgcttaaatggcacagaattngtttatcataggtctagtgctggaatctgggacagtgttgaacaagatcagtataagcatttcaacattgcattttctaattaagatg

SEQ ID NO: 719686 - DNA, 703 bp, Homo sapiens
  misc_feature (401)..(401): n is a, c, g, or t
gggggatgcaccttaacccggcagagggggggcgcattttaatatcccttcaattcgctcacggatcaccatctgttgtaaaaccctctaggctcagaactttcgcaaaaatcaagactgagttacatccttgtgagagagttcagcttttgagccttgacattcgctatcttcacaatctggagggggggctaccccaaagagcgtgccttgggatgcacagatgatctcacaaatcctgaaggatctgcgtgattctgactctgagctcatagtgttatacgacaagtttgagtcaggcttgcaatctgaggccgtcattgtcgatgacgcaccattttattaaacgcctgctaagaccgctacttgtgatgctgctgatgtacgattgacattacagngcagggctgatcagacattttcctatcataccccaagagatttttcttatatatcgaaaggctaaaaaattaaacccctttggccttaatcaccttgtttacagtcctacagtgtcaactggaaaatactggtaacaactccaaactttggctgaaaatttaccgaaggtggatcacttctgaggaaaatttacttcctgggggtaagtggtgggtaactcctagcggaacacgttttttacccttggaaaccacccccataaaaatgcttgtccaacaaagcgtgggcccccatgtccccc

SEQ ID NO: 719687 - DNA, 329 bp, Homo sapiens
agagggtgtatacgtagacagaatccaatattacaacaatacttgacgctagaaggggaagttggttaaaaatcacatcaaaaagctactaaaaggactgctctaatttacacaaaaactaacgcacaacgcttctggaatagttagaagaattcggaatgccttaaatatagtatcttagtattcgaaaaatgtgaaggactttcgtaacgcgaaataattcacgatcaacactaatcaccaacttaatgtatatgcatcgaactctgactaaagataatcatataaatcctgaagactagcattactagacagctgacccacgtgct

SEQ ID NO: 719688 - DNA, 125 bp, Homo sapiens
gcaggacccttaagattttgagcatcacacaatctatgccacaaaatatccttacctccaaaagtttttcctgccctgttatttatttatttattgtaataagaacagttaacataagatcttgg

SEQ ID NO: 719689 - DNA, 493 bp, Homo sapiens
  misc_feature (264)..(264): n is a, c, g, or t
ggttgtccggcagcgccgcgctggcatccggggagccgctgtggcagcgtatgctgccacggggactgggaagatggcgccgcagaggtgagattccgggaggtaaacggttgtcctccaaccccgctggaaatccgtgttcttttctgaaacgggatggtaataaatggctaccatatttttccgtgcgttgtgaaacttgtttcattatttgtcgggtattaaagcgggtgtcctgtggcgatacccaagtagtcccgaacnaggcttaaacccttaaggtaaccttggggcatgggtggggtggattggcttgccctcttcgcgtatgatactcggttggggggaaatttgggagaagggttaaatttccggcccagtggttatatctgtgtagcggtaaccaaacacggggaaaaaacccattcatgcccaagggcggaacaggaatggcacggcatccaggataatgaacgcgggtggggcccttgga

SEQ ID NO: 719690 - DNA, 245 bp, Homo sapiens
tcctagcgtagactgtcatcacttccaaatcagaacaagacaaaaagctcaggcttgagttgtccactagtgcataggttccgccagtgatgaggagctcgtaaggcaggatctctacatccttctggacaacacgatgcaagcacacagcatgtcctgcagctggaatagttgcatagtgccagtgttggcccagaatcacaatgcatcatgataacttgtagcttctccacaaattagagcct

SEQ ID NO: 719691 - DNA, 137 bp, Homo sapiens
  misc_feature (99)..(99): n is a, c, g, or t
ccatgcccatgtgctccccaactcgtgatcttgaatgtggtgcttccagtgatgtgtggtgcctgatgaacttgactgtcaactcatggtaaactgccnattctccctgatggatgtgatgaatgcatgcatgtggt

SEQ ID NO: 719692 - DNA, 560 bp, Homo sapiens
  misc_feature (1)..(1): n is a, c, g, or t
ntacacatgctgcaacatggatgagcttgaaaacatggacatggcaaggcgcagtggctcacgcttataatccgagcactttgagaggccgaggcattcagatcacttgaggtcaggagttcgagaccaacctggccaacatggtgaaaccctgtctctactaaaaatacaaaaattagccggatgtgcttgcttgaacctagaaggtggaggttgcagtgagccaagatcgtgccactgcacagagtgagactctgactcaaaaaaaaaagaaacatggaggccaggtggggtggctcatgcctgtaatcccagcactttgggaggctgaggcgagtggatcacaaggtcaagagatcaagaccatcctggccaacatggtgaaaccccatctctactaaaaatacaaaaaattagccgggcatggtggcgggtgcctgtagtcccagctacttgggaggctgaggcaggagaatcactcgaacctgggaggtggaggttgtcgttagccaagattgcaccactgcactccagctgaaaacagagcaagactccatctc

SEQ ID NO: 719693 - DNA, 159 bp, Homo sapiens
atgtatttcgttgttcgccccttcagtaccccgcaaaagctattttatagtggtcaatatccagtttatctccatagttcaattcggcgggttcatgcgtataacccattgcccccatttccgttttggtcgtttctttcattatcttccgcatttgtt

SEQ ID NO: 719694 - DNA, 466 bp, Homo sapiens
tactgtcagatctcatgtatatctctcccagaatatactggggggacatagccagaatagcatcttatatcttcaaaataacatactttcttatatgcccttacagatagaccttttaatgtccggttgttagattactgagtgaaatagatgttaaaccatatgttatatttccgtaatacctagtttactaattttttattttctaagtatgtggttacgattatggctttattttcctgttgtctcagttagcataccaccttagtttacattcaaatattattcaaatattattttttatcaaaaacttttaacccctttaagtgaaaatatacaaaaagctgtgagtaataattagcttatttttaagcactcccaggaagaacagcgtactgtaaaccaaaaattatcggaaaagacatttgacggaaagtgactctaatgcagtgaacagtttgcagta

SEQ ID NO: 719695 - DNA, 891 bp, Homo sapiens
aacacaggcatgctcataaggaaaggttataaaaagtaaaaggaagtcggcaaatcttaccccgcctgtttaccaaataacatcacctctagcagtcaccagtattagaggcagccgcctgcccagtgagcacatgtttaacggtccgcggtaccctaaccgtgcaaaggtagcataatcacttgttccttaattagggacctgtactgaatggctccacgagggttcagctagtctcgttacttttacaccagtgaaattgacctgcccgtgaagaggcgggcatgacactagcaagactgagaaagaccctaatggagctttaatttgatcaatgcaaacagtacctaatcaaacccactaggtcctaagtctaccaaatcctggcatgatcaatttcgggtaggggcgacgctcggagcagaatccaagctccgagcagtacatgctaagacttcaccagtcaaagcgaactactatactcaattgagccaataagtggagcaacggaacaagttaccctagggataacagcgcaatcctattctagagtccatatcaacaatagggtgtacgacctcgatgtcggatcaggacatcccgatggtgcagccgttattaacaggtctcgttgttcaagcgattaaagtcctacgtgatctgagttcagaccgaagtaatccaggtcggtttctatctacttcaaattcctccctgtacgaaagggaccaggagaaataaggctaagttcacaaaggcgcttcccccgttaatgatatcatctcgaagtaacattataaccagaaccacccaagaacagggttgtcgaagcagaaaacgaaaaaaaaaattttggtgaggcctggccccggaaagtttaacacacaattg

SEQ ID NO: 719696 - DNA, 170 bp, Homo sapiens
aagcgaggtgggctatttgtctcaagagcattgatacagaagacaagttgaataaatgttagttttcagtgaaaaggaagttaaaagtaaaaggtgaggagtaagaagaagggtagtaagagaaaaaaaatggttattaaggctatttatatactacctctcgcggcctt

SEQ ID NO: 719697 - DNA, 153 bp, Homo sapiens
  misc_feature (49)..(49): n is a, c, g, or t
gctagcggatccccagacagcggaccccacgtgtggctgcgatccaggngttggtggtactggctatgtgcttgtgattgcgatggactatatttatgtctgtggaaagctaacccagcagttgctttgtggcccttgtagttgtgtactggg

SEQ ID NO: 719698 - DNA, 124 bp, Homo sapiens
cagtttttcccccccattggggagtaatgccatgaatggggccaaatttttcttggggcccaaatgctggggggccttggggtccaaaaaggcatcatcaataaaccagttggcatgcatccca

SEQ ID NO: 719699 - DNA, 249 bp, Homo sapiens
tgcccggcgtcggttggtggagatctttatttctcacatgaaataaattgcgcgagagttgttactgtggtgtgtctcgagtcactctagaaaaactgttgccgggtatctgaccctcgttatgtagttctcttccccctcctcaccatttctaccttgaccgagtccgtctttcttcacactaacacacatactacactactgctgcaagacacaaaaatccaaacgattgcccagccccagctgcgg

SEQ ID NO: 719700 - DNA, 329 bp, Homo sapiens
cgcgtgtcgtagttcaggagaggcgtgcaggccaggtccaggcgggaggtgggcatgtgcccggcccaatacacgtgccaggcaggtttgtaggttgccggcagcagttgcaaaatctcctctggcgatgatccagatctgcctgtttcctggtgcctccatgaaggtgaccgagcgagcgcgagttgttggccggatcactggctccccataaaaccatgagcttcacaaaagacgctcaggacaatcacaccatttaccaggcataagagaagagtagggttcatccagtctaaccaggccccataagctgactcgaatgaggggac

SEQ ID NO: 719701 - DNA, 274 bp, Homo sapiens
agggcccgtaagtggtttttatgtgttttggggggaaaattttatttccccttttttttgatatttaaaaaattcatcgatctttccagatgaaccaaggttttttaaaagaaaaatagggaccccttccttctttataaaactttctataatgccctatttgaatgttaattttatgggctttttaaaaaatgggtgaaaaccccaacttatggattatccctaggttatccagcatatattagtctttatcagaataaaatgaaatttccta

SEQ ID NO: 719702 - DNA, 141 bp, Homo sapiens
aaggcacttgagtcccattaagcccaggtcaccgtaaccacaaatggtgaaagtggtaaaatgtcaagtgatgggcctgaaggggcaggtctgggtaaccaggtacagggcgagcatttggttctggcagcaccgggtaat

SEQ ID NO: 719703 - DNA, 382 bp, Homo sapiens
cgatctagaggaccttctctctccacactgggactgctggaaacatgtagttaaggaatcatgggtgttgagagaaaaaaaaaaaatcttttaaaagcggccattggaggtgatggcttctcggtacttacgccataccccagaaatacaataaataagcaattagaaaacagatcaattggttacaatcactattgggtagagcaaactttacccccaaaaggaaaaattaaattaaaaaaaaaaaccctttaaaaaattggaagacttattttttgggtcatagggaatacataacacctacggtataagttaatcaattacaaggctagggtatagaatatcaccactagcatccaggggggagagaggggaaacggag

SEQ ID NO: 719704 - DNA, 218 bp, Homo sapiens
ggaccgatgacagggcgactcctatatgttagggacggatcgacattgtgtaggcgaactaggaaatatcattcgggcttgatgtggggaggggtgtttaacagggttggctagggtataatatgtcttgggtcgcctaaggacgtcttgctgagcaatagttgttaatcgtcattcaccggagagaacggaacgagacagtcaacgccgcagcggcg

SEQ ID NO: 719705 - DNA, 883 bp, Homo sapiens
tccagctggggggttccctctttttggatgtgcctcctaccttccccccaaaatttcagtcccttccaattacccccaaaaaaaagggtagtgaagggaagggatggcgggggttcggagcccctggggcgtcaaaaggggaacagaaaccaaaaacaactcagcggggtgtggtgacacagaagctgacaattcaagaagtcatacagcaggagggggacaggggcgggcagagacagggggacagaacggagaagggagagttacaagagtgccaactccacaattacccctcctaagagaggcgtggagagaaaagccacaaacttaggaaggtgccggtccgtgaataagggaggggtggtggttgagaccttgaaggaggaggagggcaagcaaggggggggccacctctactcttggtagaatggagacccccctccagactcagggggcagcagtcacacagaccgtaacaccccttcccgcacacggtcagcacaaggtcagagaaaagaagtctcctccacgggttgtcccgggtacacagctggacccatgggggcgctggtcggggttgacctggaccttgggttggacaaagcaacaacacaggggcactcctcgagtcgagaaaggaacaccgctgcgggatccaaagaagtcacacggaccaatgggtgaagaccaaaaggaccagcgtatcactatacgccagggacccctatccagagtgtgggaaccttgctatatcacgcgggcccgggcgcgggtatacatacagaatcatctcgcccaagagcgcggtctcgaagggacggctcttggacagaaattatccttggcaacagcccctggtccagaccggtgcggtggcccaacc

SEQ ID NO: 719706 - DNA, 261 bp, Homo sapiens
gaggttatggctctcttgatgtcttcatgacatagatggcaggagccatgctggcaccagatcttctctaccgatctgctgatccttggacgaggctagtgatcatcttcaccatcttcatcggtcagtatcccctacagcaaccttgttggtccttcttggccacgtggtatggctcaggatgaccagtggcaaaagcccagggcaagcccattggccagtgttgcacgggagcccatccatcagtatgttagtgcatat

SEQ ID NO: 719707 - DNA, 125 bp, Homo sapiens
tcgctattcatcggcaccaggattcggctacgcccgcaagcgcggcgagaagtccatggctctgcgtctggctggtgagctgctggatgctgctgaaggcaaaggcgctgctgtcaagaagcgtg

SEQ ID NO: 719708 - DNA, 1812 bp, Homo sapiens
  misc_feature (105)..(105): n is a, c, g, or t
gcgctgtcccatcaagcccaggtgaggggccagggcaagggcggctgacacaggagaaggaaaggcaggagctcctgcccttcgggtggggccgagcggccacangctgtttctctcgcccccaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcacggcccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttgtaaaaaaaaaaaaaaaaaaaaaaaaaaaaacaaaaaaaaacaaaagaaacaacaaacagaaacaacaaaagacaaacaagaaaaaaaaaacaaacagcgcgaggcgcgcgcgcgctctaagaaacgggctctccgatgggggcgacacacaagatagacgcacgccccccacgaggtatttattgcacacaaaagcgtgccccaaaaagagagagagcgacgaaaatatataaaaaggcgacgaaggcggagggcagagcggatatataccacaacacgctgacagaacgcgggagaaacacacagcggcaagacaggaggagaacactctgagtgcagcgaaaagcacaccaccaatacgcggcgggcgagcgccacacacaccaggcggagcgccacaccacgccagccacgagcggagcgagcagaaagaaacgcccccacccagaggcagcaacagacagacaacgaccaaggcgcggaagaagcaggagggaccacaagacagcagcgaacaggcgcgccgcaggacaagcgcaaagttgggagcgcacggaacaagactaacgcgcgcacgacct

SEQ ID NO: 719709 - DNA, 393 bp, Homo sapiens
  misc_feature (291)..(291): n is a, c, g, or t
tagaggaccccgtccagtaaggtgtgcccagagcacttttacttgagaactacacagagcctcacggcctccagcaggctagaagagccaggaaatgaatgcctcaagagctggcctcaactaatgactcctccagggattgggacaccaacagccttcggctctctcacccgtggggtcaggataattcttctctttcctgtgcgtcacttcccgtacctccgctacggggtgtttcctggcatctcgccaaatgagctgctgtgtactcaatttcctgtgttctctaangaattcaggtctatgacactaagtgatgttagaaatgctaacgtgagaaattaaactggtaagtgatcattttacaggggggaatgggcacacatttatggg

SEQ ID NO: 719710 - DNA, 3007 bp, Homo sapiens
agcggagtctggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgctgccgctgccgctgctgctgctgctggcgctggggacccgcgggggctgcgccgcgccggaacccgcgcggcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcaccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcacggcccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttgtaaaaaaaaaaaaaaaaaaaaaaaaaaaaacaaaaaaaaacaaaagaaacaacaaacagaaacaacaaaagacaaacaagaaaaaaaaaacaaacagcgcgaggcgcgcgcgcgctctaagaaacgggctctccgatgggggcgacacacaagatagacgcacgccccccacgaggtatttattgcacacaaaagcgtgccccaaaaagagagagagcgacgaaaatatataaaaaggcgacgaaggcggagggcagagcggatatataccacaacacgctgacagaacgcgggagaaacacacagcggcaagacaggaggagaacactctgagtgcagcgaaaagcacaccaccaatacgcggcgggcgagcgccacacacaccaggcggagcgccacaccacgccagccacgagcggagcgagcagaaagaaacgcccccacccagaggcagcaacagacagacaacgaccaaggcgcggaagaagcaggagggaccacaagacagcagcgaacaggcgcgccgcaggacaagcgcaaagttgggagcgcacggaacaagactaacgcgcgcacgacct

SEQ ID NO: 719711 - DNA, 2871 bp, Homo sapiens
aagagacaagaggtgccttgtgggcagatagggggctgggagggggcctgcccggaagcagtggtggcccgtggcaggcttctcactgggtaggaccgggccctctgttgcaccccctcaccctgctctctgccctcaggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcaccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgccccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaaggagacaggtactgggtgttcaaggacaataacgtagaggaaggatacccgcgccccgtctccgacttcagcctcccgcctggcggcatcgacgctgccttctcctgggcccacaatgacaggacttatttctttaaggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcacggcccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttgtaaaaaaaaaaaaaaaaaaaaaaaaaaaaacaaaaaaaaacaaaagaaacaacaaacagaaacaacaaaagacaaacaagaaaaaaaaaacaaacagcgcgaggcgcgcgcgcgctctaagaaacgggctctccgatgggggcgacacacaagatagacgcacgccccccacgaggtatttattgcacacaaaagcgtgccccaaaaagagagagagcgacgaaaatatataaaaaggcgacgaaggcggagggcagagcggatatataccacaacacgctgacagaacgcgggagaaacacacagcggcaagacaggaggagaacactctgagtgcagcgaaaagcacaccaccaatacgcggcgggcgagcgccacacacaccaggcggagcgccacaccacgccagccacgagcggagcgagcagaaagaaacgcccccacccagaggcagcaacagacagacaacgaccaaggcgcggaagaagcaggagggaccacaagacagcagcgaacaggcgcgccgcaggacaagcgcaaagttgggagcgcacggaacaagactaacgcgcgcacgacct

SEQ ID NO: 719712 - DNA, 793 bp, Homo sapiens
tttttttttttggaaactcgctttgtcacccaggctggagtgcaagggcacaatctcaactcaccgaacctccgcctcccgggttcaagcgattctcctgcctcagcctcccgagtagtggggattacaggcgcctgcctccatgcctggctaatttggtattttatagtagagacagggtttctctcatgtgggtcaggcgggtctcaaactcctaacctcgtgatccgcctgcctcgacctcccaaagtgctgggattacaggcatgagccaccatgcccagccaaagatcattttttaatatagacttcagcccttggtaaatatggtaccgggggcagtatagagtaggaaacacaagtatacgttaacacactttggttctacaaattaacctttaaaacatataataacggctaaacaatagagtgctgtacacttagggaaacatttagtgccatttgggaaatgagatctggtgccataaatacagtctgaacggaatatacattggttcacaaattatggctgtccacggactatgagttacagccagaacaacttttaaacccagcaaccatttcaacagctccgtagtgtgatcaaaaatgatcatccagaattctcattataatccttgtgtacagaggtacacataatcctgggtggtccttaataaagggcacattttcaatccccccaaattggcattccattttccaggacacaacattcggcccagaactctcgaatttccttaatattcttacctcgccaacacggaacggttgg

SEQ ID NO: 719713 - DNA, 2969 bp, Homo sapiens
agcggagtctggcgggggcgccgcggagagcggagggcgccgggctgcggaacgcgaagcggagggcgcgggaccctgcacgccgcccgcgggcccatgtgagcgccatgcggcgccgcgcagcccggggacccggcccgccgcccccagggcccggactctcgcggctgccgctgctgccgctgccgctgctgctgctgctggcgctggggacccgcgggggctgcgccgcgccggaacccgcgcggcgcgccgaggacctcagcctgggagtggagtggctaagcaggttcggttacctgcccccggctgaccccacaacagggcagctgcagacgcaagaggagctgtctaaggccatcacagccatgcagcagtttggtggcctggaggccaccggcatcctggacgaggccaccctggccctgatgaaaaccccacgctgctccctgccagacctccctgtcctgacccaggctcgcaggagacgccaggctccagcccccaccaagtggaacaagaggaacctgtcgtggagggtccggacgttcccacgggactcaccactggggcacgacacggtgcgtgcactcatgtactacgccctcaaggtctggagcgacattgcgcccctgaacttccacgaggtggcgggcagcaccgccgacatccagatcgacttctccaaggccgaccataacgacggctaccccttcgacggccccggcggcaccgtggcccacgccttcttccccggccaccaccacaccgccggggacacccactttgacgatgacgaggcctggaccttccgctcctcggatgcccacgggatggacctgtttgcagtggctgtccacgagtttggccacgccattgggttaagccatgtggccgctgcacactccatcatgcggccgtactaccagggcccggtgggtgacccgctgcgctacgggctcccctacgaggacaaggtgcgcgtctggcagctgtacggtgtgcgggagtctgtgtctcccacggcgcagcccgaggagcctcccctgctgccggagcccccagacaaccggtccagcgcccccaactggattcccagtgaagttgtcttgagagctggtattgccagaggccggtagaagctgtgaccttgtgccacccagccccagatgtcacaggaccgcccaggaaggacgtgccccacagatgcagcactcactttgacgcggtggcccagatccggggtgaagctttcttcttcaaaggcaagtacttctggcggctgacgcgggaccggcacctggtgtccctgcagccggcacagatgcaccgcttctggcggggcctgccgctgcacctggacagcgtggacgccgtgtacgagcgcaccagcgaccacaagatcgtcttctttaaagggaccagctgtactggcgctacgatgaccacacgaggcacatggaccccggctaccccgcccagagccccctgtggaggggtgtccccagcacgctggacgacgccatgcgctggtccgacggtgcctcctacttcttccgtggccaggagtactggaaagtgctggatggcgagctggaggtggcacccgggtacccacagtccacggcccgggactggctggtgtgtggagactcacaggccgatggatctgtggctgcgggcgtggacgcggcagaggggccccgcgcccctccaggacaacatgaccagagccgctcggaggacggttacgaggtctgctcatgcacctctggggcatcctctcccccgggggccccaggcccactggtggctgccaccatgctgctgctgctgccgccactgtcaccaggcgccctgtggacagcggcccaggccctgacgctatgacacacagcgcgagcccatgagaggacagaggcggtgggacagcctggccacagagggcaaggactgtgccggagtccctgggggaggtgctggcgcgggatgaggacgggccaccctggcaccggaaggccagcagagggcacggcccgccagggctgggcaggctcaggtggcaaggacggagctgtcccctagtgagggactgtgttgactgacgagccgaggggtggccgctccagaagggtgcccagtcaggccgcaccgccgccagcctcctccggccctggagggagcatctcgggctgggggcccacccctctctgtgccggcgccaccaaccccacccacactgctgcctggtgctcccgccggcccacagggcctccgtccccaggtccccagtggggcagccctccccacagacgagccccccacatggtgccgcggcacgtcccccctgtgacgcgttccagaccaacatgacctctccctgctttgtaaaaaaaaaaaaaaaaaaaaaaaaaaaaacaaaaaaaaacaaaagaaacaacaaacagaaacaacaaaagacaaacaagaaaaaaaaaacaaacagcgcgaggcgcgcgcgcgctctaagaaacgggctctccgatgggggcgacacacaagatagacgcacgccccccacgaggtatttattgcacacaaaagcgtgccccaaaaagagagagagcgacgaaaatatataaaaaggcgacgaaggcggagggcagagcggatatataccacaacacgctgacagaacgcgggagaaacacacagcggcaagacaggaggagaacactctgagtgcagcgaaaagcacaccaccaatacgcggcgggcgagcgccacacacaccaggcggagcgccacaccacgccagccacgagcggagcgagcagaaagaaacgcccccacccagaggcagcaacagacagacaacgaccaaggcgcggaagaagcaggagggaccacaagacagcagcgaacaggcgcgccgcaggacaagcgcaaagttgggagcgcacggaacaagactaacgcgcgcacgacct

SEQ ID NO: 719714 - DNA, 191 bp, Homo sapiens
tccactcacagtgttaggggccttagagtgctctccatttatgctcactgatttacacatggaagaagtggtaggcagctatggatttagaacacagacctgtactcagccccatccactttacatcagtggagggtacatgtagcagcgcctgaggcagaaggaaggccgagactggggcaagtataaat

SEQ ID NO: 719715 - DNA, 123 bp, Homo sapiens
ggcatgcagagctcctggcagtcaggctagggctgcccgccctgcatctggcgaggcaggcagctgctgtgcgcagtgatggagctaggacgaggaaacatgcgcagacaccccgtgttccca

SEQ ID NO: 719716 - DNA, 220 bp, Homo sapiens
tgctgagattacaggcatgagccactgcgcctggcctatattcagatttttatacaacatatctttagattttttttttttccttaagagatgggatctcactgtattccccaggctgttcttgaactcctgggttcaagcaatcctcccgtcttggcctcccaaagtgctgggactacgggtgtaagccaccctacttggcctctttagaaatttttta

SEQ ID NO: 719717 - DNA, 893 bp, Homo sapiens
agcctctgggtgcgcattccaaccttccagcctgcgacctgcgtgagaaaaaaaattactatatttatctatgacccagccccaaaaaaagggttaaaaacccaaaaaaataaaccctatggtcatcgctgtggagcagaccgcccacatgccatttgccccagatcaaacgagcgacaaggacaactttacgtaaaaagaaagacaaagttaaatacattttacacaacaaaaccacccacaaatttttgggacatcgctgggcttggcacacaacaaagttacaccactggtggagcatttggtgagagtcgcgacaaagcgcaagaacacaaattatcagcaccctcaataattgtggatcatacgaggagctcacacagtttatatggatgcgcaaagtaggtttacccgcaaaaaagtgtgagactatatatgggcaggttatgaggttgggcacacgacaagaaaggccaagaccccgaaaaaggggcgcaaaaaagatattccccatgtggggcgcaacatgtggtcggcgacacaacctacagcgagaagaatgataatttgtcgtcgggggggcagaatgacaagtgacacaccaccaccaaggaacacgaccccaccccccgcgaccagcagactagtaacacaaacaaaacatacacacagaaacaaccaaccacaacacaaacagaagcgaaagcagtaggagcaagagacatgagagcatacgaaaccaacgacagaggcatctacgtatattaatcgagcataagaatcaatcaccgccaagcgatttctatgggtgggtgcacggaacatggacaaaaacgagtcagggcgatatatgggtgcacaaacagcttcccaaacagggacgtcgaaacgta

SEQ ID NO: 719718 - DNA, 309 bp, Homo sapiens
ttaaagatgttcttatttgggggccaggcgtggtggctcatgctgtaatcccagcactttgggaggccgaggcaggcggatcacctgagatcaggagttcgagaccagactggccaacatgacagggtgagaccccatctttacaacaaatacaaaaattacccaggcatggtggcacacgcctgtaatcccagctactagggaggatgaagcaggagaattgcttgaacccgggagtgggagattgttagttgagttgagatcgcacaactggcattccaacctggggggacagagagaaattccttt

SEQ ID NO: 719719 - DNA, 276 bp, Homo sapiens
aaatgacccagacacagcaatagcacagaagccccatcatatacatcccaaaactggtaactgagtagtgtatacgtgttatagtgtgacccttgtcagaacatagatacaaagggctacccaaaatgccgggcacaaatgtgtctgcaaacagatggaagtaaacagatgcactggaccaaatgcttcatgagtcagttagatttttgcaatgcaacttttgcatccattgaaactagccatgtcatggagtgtgtggactggggtaactgtgag

SEQ ID NO: 719720 - DNA, 992 bp, Homo sapiens
gctgctatccttcgagggcgtgccagcgcctagagaggaagtcgttcaagaggagcaaaaatgagcctgcggctctgggaccgtgcaatggagcgtggggtgttagagcaggatcacagacaggatgagtccccgggcagcacctcctgtgcaggcggacattcctagtgacctgtcattggtctcctcacaacggaaacacagcttgtgagttgcatgtcgagctgttacactaagtgtgtttgaacgtcccattactgtggacttagctggtaatctcatctaagtgcctgtctgtgcgttatggtcgttgtcttgccgcgtgtctgtccccgatttctccgttctgtcctgtgtttctcactgcttccgtatgatgttgccctagctgagacaccatggggttcctcggagggagcaggaggtggccggcgtgggggggcgttagggctgcggtgctgcgtcatttttcctttgctttctctttactttagacacttggtccaactccagtgcgttctcctttgcattccctcagtgcttgctcttctgacctgcatgttgagttctgtattgctggggcttccaacaaaaaccatgagtcactgacagagggaacagcagagaccttgtgtggtattcagctgtgatggatactagagaatcagaggcaccttgttttcacaactaggctcaaaatatctgcagggtcctttccattcctatttagagcggagtcctgggctccatgagccccttccgaagtggcctgtccaaaggcagataggcgtcacaccgagaaaccagtgaggctcgcacggacggggctattgggaacgagccgctaaggggagtccccggcaccaagcatgccgtgcatgcctgcatgcattcgacacgtgcatcttcgcacccgctcatcactcctttcagcctcctgatgcacgctgcctctctggctggtgcatattgccacgcggtctccccgcggc

SEQ ID NO: 719721 - DNA, 472 bp, Homo sapiens
tttagatcgaaaaaagggaatcttgatcttcaaacacaagggcgcatttctgaaggtgcaactaccacttatacacacaaattcaaggccttcatttgcagggggagcctcagtccaggaggaaacggagctgtatgaaccccaaagtgtgatgtgccaggtccaaattgttcatcctgaggctgctcgcatatcaggtagctcttgttgtacatatggatctcggggttgaagtttcacactgagcatcacactgtgcctcccaaggggcagcagaccaagccttggaactgggttccacagggcgacttgttcacccattagttgaccgtactggaccagatcaacacacatataaccctcctaacgtgatctactatcagcgaggcacagtggcctcctgagagaaatccctctacttagggaggcaggctgataactagacgtcaggcgtacgtgaccaagctggacc

SEQ ID NO: 719722 - DNA, 121 bp, Homo sapiens
cctggtgattacggagcttatagtgttagatcaaaatatctgtgatgtaggattcaaggagagaaaacagccagtattcttttttaccttctttgtgttactgtctcttctgtgctcactt

SEQ ID NO: 719723 - DNA, 214 bp, Homo sapiens
ccgttagagcggctgttgctggtttgatccctggtctgccagtgggttaggatccggtgttgctgtagctgtggtgtaggctggcagctgtagctccaaatggacccctagcctgggaacctccataagccgtgggtgtggccgtaaaaattaaaaaaaaaaaagtggataaattaaacataggagaccgctcttaccgagaccgctcttaccg

SEQ ID NO: 719724 - DNA, 592 bp, Homo sapiens
agcagagatcacaaatgcttggtttgagccagcaaccagatggtgaaatgggacccttgccatggtaaaaacaagccttgcggcctgttaccccgtggggaggtggttcccaaagatgtcaatggtgcctttgccaccatcaaaaccaaggggaccatccagtttgtggattggtgcccccctgggttaaaggttggcattaattaccagcctccccctggggggcctgggggaaacctggccaaggtacaaaaagctgggggcatgttgagcaataccccagctgtttccaaggcctggggttgcctggcccccaagtttgccctaatgtatgccaagggggcctttgttccctggaacgtgggggaggggatggaggaaggcgagttttcaaaggcccgtgaggaaatggctgccccttaaaagggtttatgggggggttggggcaaaaagtgctgccggaaaggatgagggtgaaaggtattaacctgggggggggacttttacactcctttgtttggggacggttttatttttgtttgggaaaggtttattgccggaaattgttaataaaattgaggtttccctttta

SEQ ID NO: 719725 - DNA, 625 bp, Homo sapiens
  misc_feature (611)..(611): n is a, c, g, or t
  misc_feature (625)..(625): n is a, c, g, or t
ctcccgccctgctcgatcgctctccagcttgtgatggacggctacctgcgggtcgtgcgctcgctctgcagagcctcaggctcgcggccggcctgggcgccggcggtcctgacagaccccacctcgcaagagcagccgcggcgccactatgccgaccgtattatcacggcagttcatcaaggagaagctcattctgtcccacgtggacatccagctaaagtatttagacctcgggctcccaaaccgtgaccagactgatgaccaggacaccattgactctgcactggtcacccagaatgacagcgtggctgacaagtgtgccaccatcagccctgatgaggtccgagagtgacagttcaagctgctgaatatgtggataggtcccaatggaactatccggaacatcctgagggagactgtcttccgggagcccatcatctgccaatacattacacgcctagtccctggatggaccaagcccatcaccattggtaggcacgcccatggcgaccagtgcaaagacacagacttcgtggcagaccgggccggaactctcagaaggtcttcactccgatgcagaggtgacaagaatgggtgtccacttgcccgangcggtgtggctggn

SEQ ID NO: 719726 - DNA, 245 bp, Homo sapiens
ccacctcagcctccccaatagctggggccacaggcacgcatcaccacattggcgactttttggatttttgtagagatggggtttcaccgtgttgctcaggctagtctcgacctcctgggctcaactggtctgcctgccttggcttcccaaagttctgggattacaggtgtgatgcccccacatctggctctgggtcttcttattcagtggtgtttggtgggacctgagctgtatttagtctcgtg

SEQ ID NO: 719727 - DNA, 255 bp, Homo sapiens
tcttctggagcaattgcttaacttccgggagcagatttccaaggagggacagagaggcttttcaaggaccattcagtgccccaagcttacccaccagagagctctctctagaggaggggatgcgctatacacaccccagtttttcgtacacctatacacagggctctaacaaaggctctttttagcagcagtttaacagggccctgcggctcccctggggcgcgcctcccctctgttgctgttggtttgcgttgg

SEQ ID NO: 719728 - DNA, 668 bp, Homo sapiens
ggtttttgaatactctgaacacggggagcatcacacttgaacttttccctgatcggcgcactgcgagcaacaggccacagaatgttaaatgaaggcaccctacccacaattctactatccacattactaaatgggggctcattgaacatctagacccttatcacaacacgagagcacaacagacgacgcctgccagtatgacacgtgctcatcataagacttatctacacactagcagtgagcaacccgaccgccagtgaccatgccgaatgggagttcgaacatagtcataactataagagcgtgtacatcgcactgcacactggaataggacacaattcgaaacacagaccatagcatagtgaagatgctcaccaattcgaagtatgtaggaacaacatatgacgcactctcccctgagcagtacacagccatttcgacaccaagaccctacttataaccatcctgatattatgaagtggaacagaagactcctctgtacgaatcgaccgacttatacagctcctatggaaaaacggtcgtacagtcaccctaagagtacttatatgatgtgtggccgacccattacaagatctagggtgcccccttaaacctaagaagagaactcgagtggttatagatttatttaaggacggctcctttttgcc

SEQ ID NO: 719729 - DNA, 279 bp, Homo sapiens
gaggctgactagaggatcccactgtgagctccttgtcttgtcttatggtcactgtacttgctccaaatcccagaattcttttcccccaaatattcacgtctttgtttaaaagattatcttcgtgccagggacggtgactcaagcctgtaatcccagcactttgggaagccaaggggggtggatcatctgaggtcaggagttcgagaccagcctggccaactaaaaataaaaaaaaaattagctgggtgttgtggcaggcacctaaaatcccagctactc

SEQ ID NO: 719730 - DNA, 462 bp, Homo sapiens
gttgattgagctcaaggggacaagagggctgaggaccggctccacatggggacaaggccaggctttctggcctctggttccagccagcatcagattggtgggggcaaattctcagtccaatcaccctggccgcaggcctggcgtgggaggatgtggcaggctctgtctccttctggggttcctggtctggaggagtctccccaacagcgccaaagctggctgttttccgcccaaagccccagaactttgaggtgagaggcaaatctaccctgaatgcacctccctcctaggctgggtgaggtcacgcagacacagaagggcaggacagaactccccatcttctgggggccaattcgtctgggcactgtgcggtcagcttcctttttaaagtgccagtatcggtggggcaggaagggactctcagggctgagcagagccttctccagcgcggctcagtcgaac

SEQ ID NO: 719731 - DNA, 1651 bp, Homo sapiens
  misc_feature (1)..(1): n is a, c, g, or t
  misc_feature (329)..(329): n is a, c, g, or t
  misc_feature (517)..(517): n is a, c, g, or t
  misc_feature (601)..(601): n is a, c, g, or t
  misc_feature (1341)..(1341): n is a, c, g, or t
ngtctctcattaattaaacgtattttatgttattagttattctcttttcgtctttcttctgcatattctttttctttcctctttctcttcattttatactttcttgtatttatttctctttgatttttcctattatctctcaccttattatcttctatcaacaaatttttctttatattatagctttcttgttttccctacctatttttctttcatttttttctctaccagtcgttcttatttcacaatatgttctttttatatattggtcacatattccccacccgctttttttatcgtttttttcctctaatttttgtattcctaanccctccttgacccacttgggggcctccaacgagcgatacacttttatctttcctttaaaattttctctgtcgcctggggttaaaaccccccctttttgttgacaaggggcccacacatgagaaacttgtgacaccctgagagtgccaaccctgggatttgtttagagaagatgtcagtatgtcccctngtgtgttggaaaccccatgggagtggaaaagaaatctttcccagggggatgcttgttctcccatctggtaaaatttctccacgngggtaacccacatgttaggaaagagttggaacccacttgtacctggtagtgcccacccaccacaaagctctttgtttgacttcccagcgtggctttgccccaggggaaattttagttctccgtagaaaagcccacctttgggaatattttccccttgggagacccaaaatatttttgggcacacatatttgaagccccccctctcggggatttcccggtttgtacacacacgccccacgatatgtatacgccaactgtgtgcccccgcataccctttaaccccataggacgcctcataataattaaattttctctttgtgtgcccacacaatgggagtggagacgccccccacattgtgtcacaaggccacaatccctgtgttctacatatattggagaaagagatggaaagctttggagattgagatatattttttgtcgtttatattggagatgaaaaacttcacccacacggtctcgccacagttttatatatacctttgggggcaaaagagtgtattcccataggatatgctcccagattttgtcccagagagctcatagatatgcgcccctggttacccatatacaccacacattttttgatatatatgtataggaaagattccacgcctgtgggatacccccagagagacgtcttcgtctccgaatagtctcacctgagatgagaagagaagacagtatccacagtttgagatctcccccgagaaaattatatnttggagatggaagaatctcgggagaaaagtaatcttggagggagtctcctgcctttttgagatatcccattatcctcttactgagcgcccttgtttggcacataactcacgagtcactcactgagaaaccaaatattgtgaatctggaggtgtagccacaaaccttgtaactacccacaaacgagaggtcactcactcacataatttatgataaacttagtttggaggaagaagagagtgaaagttaaccacattactatgaaccccagcttattatagatctttcccattgggaagaaccaagccaaga

SEQ ID NO: 719732 - DNA, 141 bp, Homo sapiens
ttgtttcttttaaaccactcacagcagtgcaacatccaggttcttccacgaacagcatatgaatcattgcagcagttctttaacaggcaacagagggggcaagcaaaaacacagcccacagtgacataaacacattgcaca

SEQ ID NO: 719733 - DNA, 374 bp, Homo sapiens
gcggccgcctactactactaaattcgcggccgcgtcgactgatgtgtgtaaagtgcaatatcatagcctgagctgataagaaattaatggaggccgggacgtggtggcttatgcatgtaatcccagcactttgagaggctgaggtgagtggatcacttgagaccaggagttcaggaccagcctggccaacatggtaaaacctcatctccactaaaaatacagaaattagccaggcatggtggtgcacgcctgtaatcccagctacttgggaggcagaggcataagaatcacttgaacctgggaggcagaagttgtggtgagccaaggtcacaacactgcactccagcctgggcaacacagtgagactctgtctg

SEQ ID NO: 719734 - DNA, 212 bp, Homo sapiens
  misc_feature (155)..(155): n is a, c, g, or t
gtaacaaggacgttacccattcacgtattccgtcgctatatcaaggaccctacggcattgtacctgctgggattctatctctcgaatacaagaaaggagaaagccagactgacattgagattacacgagaggaggactttaccccaattctccanaatggaggaagagtacatccagcagctctttcaggacatatccactgaagcccgatg

SEQ ID NO: 719735 - DNA, 169 bp, Homo sapiens
agatcccaaaggaccgtaggtagggcaataaaaataggttggctgtaacaatgactatgcttttaacatgaccattcagttagtactgtgaagaacttgtcttacctccatgagaagcgctgctcggcagttggtggacaccgcagccttggcgtcactatcagatcca

SEQ ID NO: 719736 - DNA, 121 bp, Homo sapiens
ttctacacggatcccccattcgaaccctagtcactatatactttgtgattggcagtggcgacgcatttgaatggccttaactgcagagaagtgagagcacttgatatgtggcgcatatgct

SEQ ID NO: 719737 - DNA, 1473 bp, Homo sapiens
ggtgatgtgtatggcagaagagcactggcgatgcccggacgtgcgtgccacgcgagtaagatactgcgtggacacgccgacgacccagcagtccagtcggtggtcaatggctagaagatacctgcgcatagaagggcagtgggccgcaggtgtgaaccctctgtgtacgcaagcttcattattccctcacgcataggctagtgagcgtagcgctgcgtcattgcacgtaccaaacttcgttgccgtggaaacgctacgcatgagagcgcagggcactacgcgacccgttgagattgggagatatcgtaatgtgcacgtgcgagatgcgcatagtaaagtcacatgatgtaaaagcatggcgcagcacacgcgcaaatggaggtggaggcttgtgtgtgtgggcccacttgcgtatgcggcgcgtgcgccaggtatcgtatacaaggcacctttccaataacgggttcctattcgggagagcgcaatgccttgcattcgagttcgttcgctttcttgcctatgcccccctattcaatccgaagatatgaagttgtggccactgacgtggagaaaagcgattggatctcctcaatagaggtgcccagaccaccatggtggggggccatcgagaacaagtcttgagattgacaccctcacacggggccaattctttcactctcaccgaagttcactatgtcaccaaatccagaacaaatgccgaagcaagtgtgtaaggttccagacggacacatcgcggtccacaggcaacgagggcgggagaaccggtgttagttattgcacccacgtggaaacatctcttccagcttctgcggaccgcatcgccccagagcattacagcggattctctcaaggccacccagggcggtcttatttcgcgccggagtggttggagtataaggggaccagctagggttaggcgcacacgacgttacataagcaaattcctctagacccctgttgaattcccatatgttgggagcaccttggaacattttgtccacggccggctcgagcacgttgtcggccatgtccatgtattgcccgaccgtgcctgtggtgaggcggctcataggggcggacctgacgggtgtgtccttcatgtaggggaggatgtgcctccggggaccgactggggtgttgcaccgaacagaaaggtgaacaagccgtaatggggtttatccagggccccaatttgggtaacacgcgtttggtcgttaggagcacacaaaggataggatcgtcggccaattccagagggaatttgaagaagtcgaagttgcggcagaagtaccccccctggggcgcgttcttggcccaccaggagggctcgccaattccgttttgcactaacttacaggcgtgtgcctgataccaggaacatccttgggtgggggaaacttggcgcccccaagtggaccaatttttggtctctcgggcgagttgttccaacta

SEQ ID NO: 719738 - DNA, 299 bp, Homo sapiens
aggtgctggaatacggctataacacataaataactataagaaacaaatcacacaataccatatcagaaactcaacatatctaaataacttaattcacaataagttagtcataaaagtcatgctacaacaactcctgtgtataacaagataataaccaaggtatacatagatataaaaatgtacttcagaatggagtaggttctagaagccaaagatactggaatgatagctcgtaatcatagactagccaacctaggtcgacagttctaaagccgaaatatctagcagataataccata

SEQ ID NO: 719739 - DNA, 600 bp, Homo sapiens
ctcctcagattgacagacccagatcctcatacctataagagatcgtacctcctaagtcactggaagacacatctcctcattcctgtaccagatggtaagctcctcagactttgacagacgcagatcctcatagcctgtaccagaattcctaccctcctctagatattgagcagacaccagaatcctcgattcctcgtaccagagtggtaactctctcagcacatggactagtcctagaatcctcactaccaggtgccagtatcttacctcctttagacatggacagacccagatcctcataccaggacccgatcccacctcctcagatactgatggacacagatcctcatacttgtacccagcctcacttccccagacactagaagactcagggcttcatagctgtgccagatgctatctcctcaggcactggaagcccaagggcctcaaacctgagtccaaactcacctcctcaaacactggaagacgcagatcctcatatctgtgccaggtgctacctcctcagacatggaagacccatatcctcatacctgtgccaggtgctacctactcagacacgggaagaaccagatcctcata

SEQ ID NO: 719740 - DNA, 173 bp, Homo sapiens
tcacaggacttaactttggtcaggagtcagagcacagcttgtgctgagatggtgaaaccccgtgcctactaaaaatacaaaaattcgccgggtgtggtggtgcatgcctgtaatcccagctatcttgtggagcctgaggcaggagaaatcattgtggaccccggaaggtggag

SEQ ID NO: 719741 - DNA, 246 bp, Homo sapiens
gactaggctaacactgtacctgctgcataatgattgaactagaaataactttgcaaggagagccaaagctaagacccccgtaaccagacgagctacctaagaacagctaaagagcacaccctctatatagcagaatagtgggaggatttataggtagaggcgacatacctaccggcctgtgatagctagttgtccatgatagaatcttagttcactttatatttgccacagaaccttaaatgccct

SEQ ID NO: 719742 - DNA, 340 bp, Homo sapiens
gaggcgatctcagaggatttccccaggcgcttgttaggggacgtgatccagcgctttgagaggcggggcttcacgctggtggggatgaagatagctgcaggaaccagagagcgtccttgctgagcaactaccaggacctgcgaggaagcccttctaccctgccctcatccgctacatgactctgggctagtgtggcatggtctgggaagggtacaatgtcgtccgcgcctcgaggccatgataggcacaccgactcggatgaggtgcccaggaaccataaggggtgacttcagcgtccacatcagcaggaatgtcatccacgccaacaagcgcctggggg

SEQ ID NO: 719743 - DNA, 352 bp, Homo sapiens
tgattcatggatttgcattttatggatatagtggttcagtagaatactcattgtctcagtaacagccgtacactgcagtagttctcagaccattagtttatagagcaactacacagctgtagtacatgtatgcaccaaactcaccaggtaggacattactttaactgcagtggtatcaatacttcctagttgagcagataaaggatccttacgttttttcctataaggcctaaattgaaattgttaaccaaggaaacagggtcagccttgaaaaatcaaggaattcattgtacctaataactgaagtaaaaataactagttgttcaacttttcctaaactcaaatctatttt

SEQ ID NO: 719744 - DNA, 953 bp, Homo sapiens
  misc_feature (12)..(12): n is a, c, g, or t
  misc_feature (875)..(875): n is a, c, g, or t
gagctctgaatntaattcgagctttccatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagaaggaagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatttcagattatttgcacatttatggtactacgagtttataaagtccaagatggtgtgaaaaaataaaaattaagattaatatgattatatgatagaggaaatntggtatatgtgagtgagttgggagaaaaaaaaaatattgcccttttggcctagcggggagtcttgggcctttccttat

SEQ ID NO: 719745 - DNA, 1180 bp, Homo sapiens
  misc_feature (12)..(12): n is a, c, g, or t
gagctctgaatntaattcgagctttccatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagaaggaagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatttcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaatgaatcctgctccaagtggaaaaccagtatcagtttgccataaataaaaggtaaccacaaaataaaa

SEQ ID NO: 719746 - DNA, 90 bp, Homo sapiens
cgttgaatggccattcaccaccttacagaggctctgtcctgagttcctgtctcttatccctctggggaactggactagttaaactagatg

SEQ ID NO: 719747 - DNA, 1076 bp, Homo sapiens
  misc_feature (24)..(25): n is a, c, g, or t
cgcctgggcgactctacggatccnntcgggtgacacggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagaaggaagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatttcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttcctttctaatccacatttattgtttcttttgaaatcacgtctaaaaaatatgactcagactatagccgttgtttcccaaacttcagtctctttagtactacttgtattattttcttaatatttatcttttaaattttaaagtttttttaaaaaaatgaatcctgctccaagtggaaaaccagtatcagtttgccataaataaaaggtaaccacaaaataaaa

SEQ ID NO: 719748 - DNA, 959 bp, Homo sapiens
  misc_feature (12)..(12): n is a, c, g, or t
gagctctgaatntaattcgagctttccatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagaaggaagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatttcagattatttgcacatttatggtactacgagtttataaagtccaagatggtgtgaaattggttctttttacttttatatttttgcttgaatcttaactctggaaatcacctgatgtagaagaagactgtgatgagctcgtctgtggaacatcacaagtatcgaaaatacagtaatggatgtttc

SEQ ID NO: 719749 - DNA, 832 bp, Homo sapiens
  misc_feature (12)..(12): n is a, c, g, or t
gagctctgaatntaattcgagctttccatgctatagaaagtctcctgcagagtgatggtgatgattttaattacatcattgcatttttccttggaacagcagcctgcctttaccagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctgctttctttctctccaactttccttttttaaaatcagcatgatgtgcctgtgagcatggaagaaggaagtcctctcagaagaatgttggccatgagactatcattcagaggaggaggggatttctctcttcaaggccataacagtggaagaacagtcatatgccattggaagtcttggccagcagtcctgaatccttcctgaagagttcagaaaatagatgtggtattgctctgaggaccaggcaggaggaactctacaacctgagtttgcctttgtgaggcattagtatagaccaaataaaaagctgcagaaattggaaagtttatgttttaaataaatgactgtgataaatttctagcgtgtctcaatggtcacctgccatctcgcaccaggtcgtctcgttcacaggga

SEQ ID NO: 719750 - DNA, 325 bp, Homo sapiens
cccccccccccccccccccttttttttgggggggggggaaagggccccctctttttcccccggggtgggggggggggagggggggcctaaacccccccccttttttttttttgcgcaaaaagggggggggtaaaaaaaccttggggccccccttttttcggggccccccccccccccttgggcccggggggggggtttttgggggggcagggccccccctctccccccgtgtttttttttcccccccaaggggcccttttttttttttaaagggccccccgaagggggggtgttttcccttgtttttttttttttttggggggga

SEQ ID NO: 719751 - DNA, 202 bp, Homo sapiens
gggatcatgccactacactccagcctgggtaacagagtgagattccatctacgaaaaacacaaaaacaaaaacaaaaaaaagcaaggaaggaaggacgacaaggaaaaggaaggaaagagaaatgctacacatagccaggtgcagtgagattacaggcatcatgcctataatcctagcactatgggaggccaaggcggtgga

SEQ ID NO: 719752 - DNA, 130 bp, Homo sapiens
tttaggtgatactctgcaagttctgggcaagagatgcagactccgtctcaaaaaacgcttgtccttaagtgggtggcttcccccagatctataaagtagtccagaattggaggtcttagtgtcagtcaac

SEQ ID NO: 719753 - DNA, 171 bp, Homo sapiens
  misc_feature (17)..(17): n is a, c, g, or t
  misc_feature (84)..(84): n is a, c, g, or t
  misc_feature (105)..(105): n is a, c, g, or t
gccctatactccctttncaaatttcccccaacacaagggggggccctccccccccccatttacaacataaaaccctcattcacnggagaaaacaccctcagggtnaaacacctatcccccattttcctcctatcccccaaccccggcatcattaccggggtttcctcctca

SEQ ID NO: 719754 - DNA, 902 bp, Homo sapiens
gagtaagaaatttaagcacccatagtaggcctggaaaaggagccagcaattacgaaagcgttcaagctcaacacccactacctaaaaaatcccaacacatataatcggaactcctcacacccgattggaccaagtctatcaccctatagaagacactaatgttagtataagtaacatgaagacattctcctccgcgaataagcctgcgtcgagattaaagacactgaactgagtaggatgaagcagcccaatatctacaatcactccaacagaggtcagttattaccctcactgtcgaacccaacgacaggcatgcgtcgataaggaaaggttagaagaaaagtaaacaggaactcggcaaatcttagcccgcctgtttaccaggaaaggatcacctctagcatcggaccagtattagaggcagccgtcgtgcccagtgagacatgtttaacggccggggtaccctaaccgtgcaaaggtagcataatcacttgtcccttaattagggacctgtatgaaatggctccacgagggttgcagctgtctcttactttggaaccagtgaaattgactgcccgtgaagaggcgggcatgacacagcaagacgagaagaaccctatggagctttaatcttattaactgcgaaacgagatacctaacagaacccaaaggtcctaaagtaaccaaaactgggattacagaatatagagggggcgactcggagcagaaacccaactcggagcagtacatgctaagacgttcaccagtcaacgggaactactatactcactgatgcaataatttgaccaaggaggaagtaccctaggatacagcgcatctattctagagtctatcaacatgggtccgactcgcagtgcatccgcatgcaggggccgaaaaag

SEQ ID NO: 719755 - DNA, 521 bp, Homo sapiens
  misc_feature (255)..(255): n is a, c, g, or t
  misc_feature (301)..(301): n is a, c, g, or t
cgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgcggatccggaacacacagaatctgcanagaccaatcacacgagacttaccgcagagaaccttgcggatcgcgnctcccgctactacaacctagacgcgcaggccgggtctcgacaccgctccagaggatgtacgcgctgcgaccgtggggccggacgggcgcctcctccgcgggccataaacccagttcgcctacgacggcaaggattacatcgccctgaacgaggaccctgacgctccatggaccgcggcggacaccgcggctcagatcacccagcgcaagtgggaggcggc

SEQ ID NO: 719756 - DNA, 250 bp, Homo sapiens
ttgtaagatccggttttagcaaagaacactgctaagtcagtttggcaacactgctaagtcagtcagtcagtgtcctcagtgtctgatcaccctccatatctgatcaggttcctcattctctactgtcccccaggtgatgtctgattaccttggcctatgtgaacccaaaatatctgagacaggtctcaatcaatttagaaagtttattttgctaagattaagaacatgcccatgacacagcgggtaccga

SEQ ID NO: 719757 - DNA, 386 bp, Homo sapiens
cttgagtaccctggttatctagctaccccagacacagacgtcttagaagtgcgctatgactgtacgtgattaagcagacagacagttgccgtgggtgtcatcaaagcagctggacaagaaggctgctggcagctggcgaggtcaccaatgtctgcccagataagctcagacaggctaagatgaatattatcccataaatacctgccacccctactcttaatcagtcggtggaagaacggtctcagaactgtatgtatcaataggccattaaagtttagtactaaaagactggttaactgatgacaatgcatcgtaaaaacttcataaggaaaggagaatgtatcgtggaccacttatggtttactttttggcgtgtagaagttgaa

SEQ ID NO: 719758 - DNA, 269 bp, Homo sapiens
  misc_feature (21)..(21): n is a, c, g, or t
  misc_feature (29)..(29): n is a, c, g, or t
  misc_feature (100)..(100): n is a, c, g, or t
  misc_feature (147)..(147): n is a, c, g, or t
  misc_feature (173)..(173): n is a, c, g, or t
  misc_feature (184)..(184): n is a, c, g, or t
gatccaagtacaatcccttcngcccccanaagtctgttcctggtgtaaatggatccaaaggtttcccaaccatccttatgatccagtgatattccagagngctacattgagcctgtacaaagcttatcctgtaacactgtgccctantatacaacttctactttcgtcagtcntaacatctacntctctgattttctgatttctatttcacagggtattgttttatatacactggcagcagcatacaataaaacttagtatgaaacttt

SEQ ID NO: 719759 - DNA, 226 bp, Homo sapiens
aggcgtctaggtggccaagaggcatggagcagctctctccattccctggccgaggggcatacataggtttccagacatcgaagggggtgggtacatgaaaactataggagtgcgaaaggagtaatacgcatactgcaggtggtgtttacctgccactctgtatcttccaggccctaacatatggcgctgagcaaaactccataaatatgacctctatgtcacatga

SEQ ID NO: 719760 - DNA, 107 bp, Homo sapiens
gcggccgactactactactactgctcgaattcaagcttctaacgatgtacggggacatgtgctttgggatgagtgtaaataaaacggggctgtggcttgggaaaaaa

SEQ ID NO: 719761 - DNA, 110 bp, Homo sapiens
gcggccgcctactactactactactgctcgaattcaagcttctaacgatgtacggggacatgataattctttgtatataaaataaacatttgaaaaaacccttcaaaaaa

SEQ ID NO: 719762 - DNA, 293 bp, Homo sapiens
ttcaattgggcacagaatgttcagctacctgtcttagactgcgacggtttggctgagctgagggatcataggacgtgcttttcatggtgttgaatttcgttagaacatttcttcagaaactctggagcccacgtgccaggtctggagtctttgtttctcccactttctagttagctgtccttcacccaatgttaccttcatttctgggcctccatttcctctctctgcaagtttctgtgcccttttcccgggttccgagcttcaacttcgatatctcatcggtcatgctcttt

SEQ ID NO: 719763 - DNA, 305 bp, Homo sapiens
  misc_feature (281)..(281): n is a, c, g, or t
  misc_feature (287)..(287): n is a, c, g, or t
attcggcacagaaagaatagaaagaataaaagcaaatatgtcaatctctgttcacagaaatgtatgagagatgagacatattcacttataaatgtaacacaaagtagaaagtgtcaactgaaatcaaagggacagagctaaagtactctttcctttgagttaaagagaagctatattctgggtgcagcctcattttggcttcagtttggataattagtctgtctagcctgtcactggcagaatctgaaataattggaacccataaggagtaagattttctngaggangcactgcaaagtaagatg

SEQ ID NO: 719764 - DNA, 739 bp, Homo sapiens
tagtagaaacggggtttctccatgttggtcaggctggtctcgaactcccaacctcaggtaatccgcccgcctcagcctcccaaagtgctaggattacaggcgtgagccaccacgcgcggccccatcatacgaagttactgaagttatggcgtaaacattctggttttagtcatccttgaggatcgttttaactccttgatctgtaaaactggtcttaagcatcttaacatgttacatcacggggtttaagctcagatttccaaagagccatatttttggatgcatatttccagttgaattccaggtgtgaatttccagtggtacttggcattcggattcttggatattggaactgggccatcgtgggggtgcaactctcgtaagactaaaggggacctacgtaaatacgaacagaggataaccagttctaccaagaaactttaccaaccaaacctccccgggttctttttgtcagacttgcctttggcctttcaacctcttaaacttgtacagggagagattcaaggttccctattattcggcttggactcacattactaaattgaccactgtgggactccatggaactctttacagtgtgttcccgatttacaataaggcgccagtgtttacagttttccgagtagtctcagcaagtgggatctgtagtttcaggacctggttgtaaaagatcaagatccttaatgtgtccaagaagtggcgttttccatttaagggg

SEQ ID NO: 719765 - DNA, 287 bp, Homo sapiens
cgctacaacataaattgtttccatgagctcctttccgttcatctcatccacagccttccccccaaaaaaaagaaaaaaaaaaaatcacaaaactttcaacttacagttcatttcctttaacaggttaagacaaatttggtaaaggtcacaacaagctaaaggacaaacccattcccaaaaatctcaagggtttgggcgacaattatagggtaaccaatttaaatactctcaaaccttaaggcattaaaagtgcaaaataacgtgaaaattataagaaacagtgtcaa

SEQ ID NO: 719766 - DNA, 216 bp, Homo sapiens
gatatccccagatcttctgtggtccacttgaggatcttgcccaacgatagggtcctggccagtctggcccggccaggctgggcttctcgagggggactccagctgcccttctgccccatagaggagacgactcagatcccgttggcctcattcccgttacgaggcaacgtgagggtcatggttctctagacgtcccttcatgtgtaaaacatgtca

SEQ ID NO: 719767 - DNA, 240 bp, Homo sapiens
agatcccttaccgactagcccgacagccactgcttcttgtaagctttgtctctaagcttctgtccagctacaaacccacccaggtgccagtggtctttgtgacaccagtgagccaggtgtacacattccctggcaggagtaggaggttgacatgaagcaggagtgcgatgcacaggccaggtaccagagtatgatcaggaggatgctggtgttccccacttgtcgggctagtcgggtggt

SEQ ID NO: 719768 - DNA, 170 bp, Homo sapiens
  misc_feature (115)..(115): n is a, c, g, or t
tcttacccgagtggtaaatctctggtacgacccttttaaaaagacatgtaaatatatactcagatttatacacttggtgttttcttcatagctatatacagagcccccagtttgnggctggggagggcgtgtgggtggcagtcagcggcgtttgagtccgccattggcaa

SEQ ID NO: 719769 - DNA, 538 bp, Homo sapiens
ttctttgttttctgctaccctgctgtgtgaagctgtgaaatgaagccatagccttctcttctcaggcgtggactgccatgagtttcacaacctcaggccctggtgtaggcttctacatcagaaccctgggcgtcagcaaggcgctgcacaaagaggcctgcaacagaagccaaacacttgggtttaagtcctggaccggcacagccttggtttctcagagtgttgaagataaggggaatgagccccagaagtggttctcaagcaggggtgtatggcaaagtcacccacggaacttaaaaaggatttcccaggactcacatgcaacctagcagatcaggttaccatttcctagggtggggctcaggcatatggtttaaaattctccctagttgattttgatgcctccccaccctcaccctatgatgacaatgtttagactggctgatctgtagctgctttcactccaaggatgaatcctggaagttgcagttagctgcagtttgcataacaaagaaaatgcagtagacagcaaaaaaaa

SEQ ID NO: 719770 - DNA, 177 bp, Homo sapiens
agatataccagacctcgtacaagcctatagtattctactacatacaattacaaaggaacagtagatagcaataaaagtacacaaaactccactatgctgtatagttacctatatatactacctagggtacagcacagctatatattactagcattcattaaacaccctatcttatag

SEQ ID NO: 719771 - DNA, 318 bp, Homo sapiens
ttttttggggggggggtttttaagtttggcccccccgaaaactttgggcgggggacccctttgttttccccccgccccccccccccgcatggggttgtttgttttttttcggcccccccccccccctttggaagcccctttttttaacttttttttggggggggtccccccttaaaggtggggtatcctaaaatcccggggcccccttaccccccccccaaaattttttggggggggccctttttttcctttttaaatgtttgggggacctttcccccgaataatttttgtccatttttttccggggtttttttggta

SEQ ID NO: 719772 - DNA, 238 bp, Homo sapiens
atacagccggaagccacatacatactgccggaagcctcaacagagacaagtaggcgatggctgactccttcttactacacaaggtatataatattagacacccacgctaagagtcccatcacactaatcactccgaggtaggcgagcacaggagcgcaaaccttaacacattcattctgtgatccaaataagtaaatcgtaaccaccacaacctccatagtataggcaaccggaagta

SEQ ID NO: 719773 - DNA, 125 bp, Homo sapiens
gcccaggtagatttggagttatttattggttcagatgtaacttctgtgataactctatttctttaagcaaattagacttgaattattaataagtataatctaggccagatttagaagacacacgt

SEQ ID NO: 719774 - DNA, 148 bp, Homo sapiens
gaggtaataaacttgtattggcacacagtcccattcattcatgtacaactgtctatgtctgccctctcaaagacagatttgggtcatcatgacaaagaccttatggtctgcaaagccagaaatatttactatctggcccattacagaa

SEQ ID NO: 719775 - DNA, 400 bp, Homo sapiens
gaaagttcgagatacatgtgctgaatttaagctgagaaatcagaataagatcattcatgtataacagagggacaggactgcctgtgttatttttatgccattgttgtggtggatagacagagtttggaagacatctcacaggtagtggataggttatatatcattattgcactggtgatggaagcagaacttatagcttaagtctcggaagattgaaggattactatgttgttacacttgtgattgggtgtatccactgtgaggccatatgagataagctgtaaggatgcatggatgtaatcacatgaatcaggagggcggtacttgcttgataacgtataccgttatcgaaggactgggacgtgatggagaatgtgtctcttgtgagcacatagcacgt

SEQ ID NO: 719776 - DNA, 480 bp, Homo sapiens
  misc_feature (426)..(426): n is a, c, g, or t
  misc_feature (469)..(469): n is a, c, g, or t
ccacaggggtcaaacatcagggagtttaaaaagccgttcaatgagcaatctctttcataccggtctgcatctgttttcttggcctccctgatcaggcagccacggttagctgtcagtggctccggagttactttcctagcttttcaacggatattcaagccagttcaaacgtgcgtcatagccctggttttggcagatagggtgtgctacccatccatcttccacctggctgtgtccatggggcaaacatcaggggttcttcccacacggtgcacgccagacttcctcagggttacatcatttattccactcacgccctggtcctggacatctgcgtggattgcaggcctttgccatgacagacagcagtgtggtgaccttaaacggtccgcctgtgtgccaggactcaacaaacgcgtcccaggnaggggcactcgggccatttcagtaggaatcagtaatgtgccgntcaaccgacat

SEQ ID NO: 719777 - DNA, 591 bp, Homo sapiens
  misc_feature (2)..(2): n is a, c, g, or t
  misc_feature (4)..(4): n is a, c, g, or t
  misc_feature (8)..(8): n is a, c, g, or t
  misc_feature (61)..(61): n is a, c, g, or t
  misc_feature (74)..(74): n is a, c, g, or t
  misc_feature (80)..(80): n is a, c, g, or t
  misc_feature (124)..(124): n is a, c, g, or t
  misc_feature (207)..(207): n is a, c, g, or t
  misc_feature (209)..(209): n is a, c, g, or t
  misc_feature (498)..(498): n is a, c, g, or t
  misc_feature (515)..(515): n is a, c, g, or t
  misc_feature (517)..(517): n is a, c, g, or t
  misc_feature (531)..(531): n is a, c, g, or t
cntnggangttgctgcagtgttgtgagttggaagctggggagctcggcatggcggtccccntgcagccatgggncctcgngttgggcagagcggccggctcgatggcccgtggtgctcagtganagcggcccgtcgcgctacgtgcttgggatgcaggagctgttccggggccacagcaagacgcgcgagttcctggcgcacacaangngttgcactcggtggcctggaagttgcgacgggcgtcctaagcctcggggtccttcgacaagacggccagcgtcttcttgctggagaaggaccggttggtcaaaagaaaacaattatcggggacatggggatagtgtggaccagctttgttggcatccaagtaatcctgacctatttgttacggcgtcttggagataaaaccattcgcatctgggatgtgaggactacaaaatgcattgccactgtgaacactaaaggggagaacattaatatctgctggagtcctgatnggcaaccattgctgtangnacaaagatgatgtngtgaccttattgatgcaaacacaccgttccaaagcagaagacagttcaattcaagtcacg

SEQ ID NO: 719778 - DNA, 842 bp, Homo sapiens
tgttctgtgcatgcacacctgcatgcctgatgccctgatgctgggtttgctggctgccatttgctgtgctgcttgggcttgctcacactgtgtgccttgctcctggcctgccctgctgccccgtgccaccatacccacagtacccctgctggctaccccacatgcttcgctgccctgaccccatggtgtgccctgcccgtgaccacactgcctcgttccatctgactgtttttcctgccacaagcaggatcaaggaactgactgcactgtcgaaagcttcctcagttctgacgtgaagttccatgcaagttaccgttttgcctgacttgcggtgcttcctcaggcacttagatggtgactgcttgcctgtgacacgttgttaaaggcagggccattttgacttgcggcgagtctcgacactgaccgaacttctaacgaagagctaggagaacaaccgttgttgttgaccttacctttcgtcgacgccaccccttgagggatgttctatccctgggctctgtgtgccttgtgcttggaatatgcgacactctggcttggaaccctgctgccatattgcttcggcttgtccacttggacttgccatccctaatgctttggacgatactaacgatgtgtgccctccatagatgttggcaccaagtgtctgttgcacactggcttccctgcctgccgcggatgaccggttaatgccagtcctgccgacccttacagacgctcggcttggagaggtggccgtcagtatacacctttgagggcccagctccccatggcttggcggtgacacacttctagagatcgggtggagtggcagcagccgtgct

SEQ ID NO: 719779 - DNA, 1052 bp, Homo sapiens
ctgtctttcttgtctgcagggtgagaatgagcgagaaggggggccatgaagagttggttggccgctgttgttgcgaggtgtttcttgccggtcgagaggttttttttttcctttcgtgttggtgccgaaacacaggggcccactgggttgaccctctctccaaggggtgtcgttcccccccagaggcgtagggtttgacattttggtggtttcctgagtatctcgggggaaccccctctgtcttggggacactccgtggtcttgggcccttggcgcccacagtggggtgtgcggtttattgcgcccaatggggactggctttttatgtcatttggttaatcgtgggcacccctatttgggaaggtgtggggaaagtcacaaaagaaatttggggaagatcaacacacaacccaggctgtccacgaagtgttgggacacccctggaaggggaggaaaatttttgggagcgcccaacaaggttcttggcccctcctaatggccggtgggggagccacgcataaacattttgcccaaaacaccccggaccacccagaggggggctaatagggccgggtgccccaacccaacgagaccagataaggctgatgcgccagcggggccaggaagaagttttaaataagggaacacccaagcgcttgcaccgaggagagggaggagcccccgaagaaaatgacccagcgggaagacttcacacagggttaccaaccagagaagttgtgggaacacctcagccccagccaccacatggtggccgaggcctctaacctgctcaccacaagatacaccatagttttagcacccaaaacatccatgggttatgggcccaaaaaacattgagggcctgtgatttgtgacattaattgtatacaccagggtatattttagtttttgttttgtgggaagaggtaaagaccaatccccccaaggggtttaatagtaggaattttttttttgcccccccacgctgttggttgctaaaagtgcccgtctgatcgtgaccctggataaaagtcttttttttaatgggccca

SEQ ID NO: 719780 - DNA, 237 bp, Homo sapiens
atgtcgttaccatgacacagttgcctaacaaagccattctcagaagatagcccaggcattatgcaacacatgactgtcattggtgacagggaaggagtcacttgtgccattttcaatgttaaaattacatcatgagattgcaagcattcagtaacttgcaagctccaatttgaattctagttgtctagctatttccaccacatctgcaattactttctccactgaaatcttgttttc

SEQ ID NO: 719781 - DNA, 385 bp, Homo sapiens
atacactcatgtgtcaggctctgtatggaaaaaatgcctttgtgtgctgcaaccgagttgcttccctcttttccccacataactgcagtgtgccctgatctcgtcttggcacgtacttacctgtattgaactatgatgaaagattctctctgcttacctatttgaattgtaggagagcaataagacaggtgtgctacctagagctcctctgtgactttcttcaccatctctctcttttacccctcacatctctgcagctgaaatagtttttgtaggaagcataaactttggaatacccttagcatttataggagataattggagcaggatgggagtcttacttggacttgatgagaaattttaaaaagttgttaggtctacctgg

SEQ ID NO: 719782 - DNA, 183 bp, Homo sapiens
gaggaagcttttgatcttaatactagtatctatatcacatggtgttgatgaccaatcatctaacatcaatctattttacaatagggatttcctcctgacaagttcttacttgctacctactacccacaaaggactgatatgtacagtaccgggattgttcaattttagcaaagattccatgca

SEQ ID NO: 719783 - DNA, 119 bp, Homo sapiens
caagcacatggcggccaccgcgggggctccctgctgcaacacgtgggtggggaccaccgggggcactcggaggagggaggcgaggagcagcctgtgacgcccgcccccgccctgtcttg

SEQ ID NO: 719784 - DNA, 899 bp, Homo sapiens
gaggcaaaaggaaggtacgcgagcgtccctgacggtccccgccgcctgtgtcttcacctctcttttgccagccccttcagggagcggacagtctccctcttcctgtccaccctcggtgggtgttgcctcgcagccccttcctactgctccggtcccagtctcttcgcgcccctgggagggaggtgggaggctctaggctccaagacgccgtcgcttgagattgtctttgggctatagacgttttttttctttaaacgattactaaactatagcaggaagttgataagacagtatcatccatcagaagcatcatttcatcacttcaatttgaagaaccaggggtgatatataatagcattaaaggtgctgggtgatgtgttaggagcatattagaaggaatggttagtctaatatggctggcatgagtcatggtggtgagacatcagagtctatatttggggggccaaaaattaaagtggaagtcaccaaaaggaaatcttatatataatagcaatatttgggttgaacccaagggaggtagataagaactggaaaccaattgactcagaaagaaggaaggacaggtgttagcattatgacatgttttcacgcgtggaatcgaggtccataacggtgacttcaggaggaaaaagtttccaagaatttatcaaaacaggtcattgataaataatcgtccagaattgaagtagcctgaaacatattattagaatagacaaggtgactgaataaatttttgggtaaaacttataaatataacttcccaaattattacctgccaaggaaagaagcattagatagccggttagttaggagagacgctatgagacaatttggggtgtacaatagagtaaggcctgaaaaaggggcgggattaatag

SEQ ID NO: 719785 - DNA, 128 bp, Homo sapiens
gtaagatcctgtctttacaagcataaaaattgctgggcatgggtggctacacctctagcccagctgctcaggagtttgaggcaggaggatcactgagcctaggggtttaaggctgcagtaagttaggt

SEQ ID NO: 719786 - DNA, 633 bp, Homo sapiens
gagcggggtggtggtgctgggagtgtcgtggacgccgtgccgttactcgtagtcaggcgtgcggcgcagtgcggtggggcaggcatagcgcacagtgcgccttagcagcagcatgcagcatgcagcagcatcggaggtacccccgaccgtcgcagccccgcgctggatgctagacagcccatcagctccctctgatcttcctcccttcagatcgcaccatggatgatcagctgaacgaagaacagattgctgaagttcaaggaagccttctccctattagactcaccgatggcgatggcaccatcacaagcaaaaggaacttggacactgtcatgaaggtcactgggtcagaaccaacagacgctgcacttgcatggatactgatcaactgaagtggatgctgatggtaatggcaccatagaacttccccgaactttccgacctactgactggctatcaacacaatgaacagcatcacagatcgtgaacgaacgaaactccagtgcaggcctacccgagtcttttgaacacaggactgcgcactgcgttatactcaaggtgccagcagaaactaacgtcacgtcattgacacacacctcacggagaaacaactaacccagactgaacgcaaag

SEQ ID NO: 719787 - DNA, 411 bp, Homo sapiens
  misc_feature (368)..(368): n is a, c, g, or t
  misc_feature (376)..(376): n is a, c, g, or t
tgctcatcaggatttcagacagataagtctgataatcaagtagtagaactctagccacttggtaaagttcaaaggcattccagtcccagggaatggggaattgaaaggagcaggaaagacgttcatttggccgggcgcagttgctcatatctgtaatcctagctttttgggaggctgaggtgggcagatcaccagaggtcaggaattcgagaccagcctggcccacatggcgaaaccttgtctctactaaaaatacacaaattagccgggtgtggtggcacacgcctgttaattatccagcttacttcggggaggcttgaggcagggagaattcctttgaacccggggagacagagtttgcagttagnccaagttnttggccaccacatttccaacctggggccaacagag

SEQ ID NO: 719788 - DNA, 421 bp, Homo sapiens
gctaatgaacagctcaactgtctggcagagccaggctccttctgccatgatacagtttggatgtttgtccctttctaatcttatatggaaatttgatccccagtgttgaaggtggggcctggtgggagatgttcctgttatcgggatggatccttcatgaatagcctggtgccatctttgtggtaacaagtgagttctcacttgattagtttctgtgagaactgtttgttaaaaagagcctggtggcacctccctcccttcttcctccttctcttgctatgtgatgctgctgccctttgccttccgtcatgagtggaagctccctgaagcccccaccagtagcaaatgctggcaccatgctgcttgtacagcctgcagaactgtgagccaaataaacctcttttctttataaattaaaaaa

SEQ ID NO: 719789 - DNA, 161 bp, Homo sapiens
gcgtctgatgcgcagttccctttatagcgcggcaagccgaatcctagagctaacccgcagtaggaggagaagttgcttctcaccaatagctgagcgttcagatgtcaggacgtacctacgtgtctgttccagtctcgtcgctgtctggaagttctagcagt

SEQ ID NO: 719790 - DNA, 100 bp, Homo sapiens
tgcctgcatgcatcagactagccactcctgccaggccgctggatggtccttctccagttagaatgcaccatggagacgtggtgggactccagctacgtga

SEQ ID NO: 719791 - DNA, 1059 bp, Homo sapiens
  misc_feature (193)..(194): n is a, c, g, or t
  misc_feature (220)..(220): n is a, c, g, or t
  misc_feature (405)..(405): n is a, c, g, or t
  misc_feature (489)..(489): n is a, c, g, or t
  misc_feature (720)..(720): n is a, c, g, or t
  misc_feature (738)..(738): n is a, c, g, or t
aatgatccatactatgacccaaagaaggatcaaaacccagacagtagtgtcaagcatgcgatgtgtaagctagtgatcgtatgtaggaccttgagggataacctagcacttgtaagtatgcctaaacacaactcttatttagcttacagccttatgtttttggtaattttcttggtagactaggtaatttttnnttaaaggacaggaaactgatattttnaagaccaattgttctacctagcattttaactagtttttctgccagctatgttgaatgcacaaattctgtcacgcatgttcattcattgctacataatttggttcttctggaatatttttatgtagctcttggagtacagctatgaaaattaacaactgttaaaggaaataccttttttttttttnggtaatttttcccttgaagaaccaaagtatttttccagcgggtggtggaatagggtaaagtccgctgggattagctgtgccttncattacttggttacagaaatgcagtgacttatactaagacaatttatggtttaaaaaaaaattgggcaagacacctattatggttaaaaatttccagtatgaccacacccaataactgttataagagtgtcaatgggataatggtgttaaggtgacatagttaactgtaaagtaccctgactcagtatagtatacgggtaccacagtgaggtgaataacaacggggatttncagaagttagcctgaatnttaactgtattttaaaatttaacctccattaactaagcatctcttcttggtgggaagggtctaccttctgtcttccctggaaaggatgaattacacatcatttgacaagcctattttcacgcttatgtaaatttaacctccattaattaagcattctttctggggggcagggtctaccttctgttccctggcaaggttgcatttcgctcatttggccacgctatttccgttattgtgccgtaggcctgtttggtgtggccgcaattgtttttcactctatttgcgggcctcgaagccggttgggcagttttgcgtgaccat

SEQ ID NO: 719792 - DNA, 1326 bp, Homo sapiens
  misc_feature (911)..(911): n is a, c, g, or t
  misc_feature (956)..(956): n is a, c, g, or t
  misc_feature (1040)..(1040): n is a, c, g, or t
  misc_feature (1094)..(1094): n is a, c, g, or t
  misc_feature (1112)..(1112): n is a, c, g, or t
gccgacagagcaagactctgtctcaaaaaaaaaaaaaaatacaattaagaggtgtatactgatgattcttcccactcatttgtttgtccagaagtaaataaatgtcggaagttttccaagtaactatttgttttttggggggttttttagttagagtcttggtctgtcacccaggctggagtacagtggcaggatctcagcttgctgcagcttccatctcccaggttcaagcgatcatgtgcctaagcctcctgagtagctgggatcacgggtgtgtaccaccacgcccagctgatttttgtatttttagtaaagactttcgccatgttgtccaggctggtctcgaactcctggcctaatgatctgcccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtnatcccagcactttgggaggtggaggcgggtggatcacaaggtcangagatcgagaccatcctggccaacatggtgaaaccctgtctctattaaaaatacaaaaattagctgggcgtggtggcgcatgcntgtagtcccactactaaggaggctgaggcaggagaatcacttgaacccagagtngaggtgcatgaccggatnacactgcattcaactgggaagaatagatcctctcaaaaaaaaaaatcaaaattgcggctggggcacgcgaactcgcatgggacccggaaccacacacgcgaaggggggaatacgcactcacggtagaacattgcaaatacaagtgtggacactagaaacggaccactcatcaactatagtgaacatctctgttttattgtgtaaataacctagg

SEQ ID NO: 719793 - DNA, 1540 bp, Homo sapiens
  misc_feature (1191)..(1191): n is a, c, g, or t
  misc_feature (1195)..(1195): n is a, c, g, or t
gattgttctgtcatggtgggagagaacacgtcgccggtgtgagaagatgttgtgggggggcaacacccttttgtgtgttgtcgccgctccccgacaatggaatgtgttgaacgaccagatgggtctcccggttgttggtttgtgacacaaccccatcggggaaaactagtttggggggagtggcactagtagatagtgtagatgaagcccccgccgcgggtgttttttgtgattgacaagatggtcagttctggggtaaaagtactcaggttgaagtagttaaattggtgggtggcttttagagactggttggccaacgagagacgctttgtgtggggtggttgttgattaacccaaacggtcggtttgtccccttgtgccggcggcccccgttgtgaggccgcctttctcttttatggagaatatgggcgcacgtcctttatgggaagataataaagagatgtgtggtgttttctcttatggggggagggagtttgctaacatgaaagtgtgtccatgctggggaggatgggccaacgtgttgcgccctacatgacgatcggcgacgagagcagcgcgtttaggcggtcgacaacagtggttaagttaaagatgtgttgccaacaatcttggagaggaaatgggccacataggtgtggccaccattttggagaggggagtgtgtcacaacgacctgtgacacacaatagaggagagcttgtgagagagacatcgtttgtggtccaaacaaatatggcgccgctttgttaaagcaacatgcgcgtatgagatggagacaagagcttttcttgtggggagaagtgaatatattgctctctctttcggcggcgcgtcttgtgtatcacatcacacgggtggcgttgtctgtgtgtgggtttcccacgcgcgtgggggcacaccccgtctttcgtcgtaagggtcttttgtgtgtgtgtgtgtgtgtgggcgttataatgtggggtgtaatgtgtgtgccgtcgtataatatatgtgaagagggggggtcacaacagagagacactttcacacgagatttttccacgcgagagatagatggtccgcagacacgcgcgtgtgcacatatagatgtgagagacccgccgcgtcggcgtgtgtgtatatgttgtgtgtgttcttttgtatagatgtatactcagttgtataaaggcncgcncacgtgtgagcgctcttctggagatattctcgagaagtggtgataataacctcccactatgtgttctctcgagaaacacacacgagaataacttcttaacttgtcctcgataattttccactagagctcgcctttcccacggtggagttgaggagaacactaagagaagaatgtgtaacaccactttatgtttaacttctaaatgagttcttttaacccctcgtgtaagctaattctttgtgtgtttcctccaaactttattaattaccacgtgattgcatttttagcatcccagttgtaagatgaataatattaaacagctacccagtgttggtgatacctcca

SEQ ID NO: 719794 - DNA, 632 bp, Homo sapiens
  misc_feature (282)..(282): n is a, c, g, or t
ggtggggcgaggcatgcacggagatgaagcgcggagtacgaccaggtgtcttgcaatcgctggttccgccgtagcaaatgttctcaacggggtggacagctccgtgtgggacccggtggcatccgactctcttgcagagcgctaccatgcagggttgattcactacatacgcgaatgatgaggtagacaagcagattcgcatatgagaagcgactaggatgcttcagtcggtgcgcgatgggtccatggaagagacacgccgtcgtaacaattctgcttttntatagaaactcgtgtgaacccgagatgcgaccgcctttggacagggggagtttttcccgctatacgatgcacgagcagaactatcgatggaagctacctgaggatgtttgttgggtccaacacgtcacccattcgtggatgaacatctagttaggggcacgacttcgagggcaattgttggaatggaaggcgcatagctttgacggggaggacacggaaggggacgctctttgtgagatctattctcgttccccgtctcccgtaagtgagatgtttttgcccttgcgtcccaaggtgtgtgatgacataccattggactcggagagcctacgatctttgtacgaatgtga

SEQ ID NO: 719795 - DNA, 1181 bp, Homo sapiens
  misc_feature (766)..(766): n is a, c, g, or t
  misc_feature (811)..(811): n is a, c, g, or t
  misc_feature (895)..(895): n is a, c, g, or t
  misc_feature (949)..(949): n is a, c, g, or t
  misc_feature (967)..(967): n is a, c, g, or t
cagcctgcctaagactgtcttaccttatgttaaggaagtcaggtatttaaaatgttacatatgccggcgcagtggctcatgtgtgttatcccagcactctgggaggctgagacaggtagatcatttgaggtcaggagttcaaaaccaacctggtctacatggtgaaaccccatctcaactaaaaatacaaaaaatacaaaaaattagccgggcgcggtggctccacctctgcctcccaaagtgctgggatcacaggcatgagccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtnatcccagcactttgggaggtggaggcgggtggatcacaaggtcangagatcgagaccatcctggccaacatggtgaaaccctgtctctattaaaaatacaaaaattagctgggcgtggtggcgcatgcntgtagtcccactactaaggaggctgaggcaggagaatcacttgaacccagagtngaggtgcatgaccggatnacactgcattcaactgggaagaatagatcctctcaaaaaaaaaaatcaaaattgcggctggggcacgcgaactcgcatgggacccggaaccacacacgcgaaggggggaatacgcactcacggtagaacattgcaaatacaagtgtggacactagaaacggaccactcatcaactatagtgaacatctctgttttattgtgtaaataacctagg

SEQ ID NO: 719796 - DNA, 293 bp, Homo sapiens
cacacagtgtatagccagtggaatgtgaatgttataacttaaccgagatttgtatgggagattagtatagagaggtagagttcttttcgtgatagtggttcactggataagtgctcgttggcttgccatgattgtgaggggtaccgagtcaggtactttgtattacgaggggggttgttagcggggtcgcgcacggaaaaggttggggaacagctaaatagcgtcgttgttgatttggttaaccaaatagtagagggatgatgctaattattatgctgtttgtggaggctgca

SEQ ID NO: 719797 - DNA, 254 bp, Homo sapiens
cccaaccatgatgcgcggccatcgagggcaccgacacccagcttcgttgggagaaactgctgcctcatatccgggtgtgggctggcaccaaggaggacctcactgaggattcagggacatggctggccaataaggtgccagctgctgcccgtgcgtgccatgccccatgtgaagtcactgtgccagccagaacactgggttctccgggggtcccccgagacagacctcctttttccaggctttacggtatcacc

SEQ ID NO: 719798 - DNA, 1005 bp, Homo sapiens
  misc_feature (590)..(590): n is a, c, g, or t
  misc_feature (635)..(635): n is a, c, g, or t
  misc_feature (719)..(719): n is a, c, g, or t
  misc_feature (773)..(773): n is a, c, g, or t
  misc_feature (791)..(791): n is a, c, g, or t
tattaagctgttagaaatgcaatcaaatttgttttttctgtgttcctaagaactcaggcaattttaaggataaaaactaacattggccaccgaacccagccttattctgcttaaatttaacgtgttttttgacttcttaattaacttggtcatatactaaatgtgatctcctgtggattaccacatgcattaaaaaatttttcaagctgggcctagtggcgcacacctgcaatcccaacactttgggaggccaagagaggaagattgcttgagcccaggagtttgagaccaatctaggcaatgtagtgagaccctgtctctaatttaaaaaagaaaaagaaaaaaacattcccagtggcagcctgcctaagactgtcttaccttatgttaaggaagtcaggtatttaaaatgttacatatgccggcgcagtggctcatgtgtgtaatcccagcactctgggaggctgagacaggtagatcatttgaggtcaggagttcaaaaccaacctggtctacatggtgaaaccccatctcaactaaaaatacaaaaaatacaaaaaattagccgggcgcggtggctcacacctgtnatcccagcactttgggaggtggaggcgggtggatcacaaggtcangagatcgagaccatcctggccaacatggtgaaaccctgtctctattaaaaatacaaaaattagctgggcgtggtggcgcatgcntgtagtcccactactaaggaggctgaggcaggagaatcacttgaacccagagtngaggtgcatgaccggatnacactgcattcaactgggaagaatagatcctctcaaaaaaaaaaatcaaaattgcggctggggcacgcgaactcgcatgggacccggaaccacacacgcgaaggggggaatacgcactcacggtagaacattgcaaatacaagtgtggacactagaaacggaccactcatcaactatagtgaacatctctgttttattgtgtaaataacctagg

SEQ ID NO: 719799 - DNA, 802 bp, Homo sapiens
  misc_feature (51)..(51): n is a, c, g, or t
  misc_feature (88)..(88): n is a, c, g, or t
  misc_feature (124)..(124): n is a, c, g, or t
  misc_feature (153)..(153): n is a, c, g, or t
  misc_feature (166)..(166): n is a, c, g, or t
  misc_feature (179)..(179): n is a, c, g, or t
  misc_feature (218)..(219): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (282)..(282): n is a, c, g, or t
  misc_feature (287)..(287): n is a, c, g, or t
  misc_feature (290)..(290): n is a, c, g, or t
  misc_feature (296)..(296): n is a, c, g, or t
  misc_feature (303)..(303): n is a, c, g, or t
  misc_feature (327)..(327): n is a, c, g, or t
  misc_feature (516)..(516): n is a, c, g, or t
  misc_feature (591)..(591): n is a, c, g, or t
  misc_feature (599)..(599): n is a, c, g, or t
  misc_feature (602)..(602): n is a, c, g, or t
  misc_feature (609)..(609): n is a, c, g, or t
  misc_feature (647)..(647): n is a, c, g, or t
  misc_feature (655)..(655): n is a, c, g, or t
  misc_feature (675)..(675): n is a, c, g, or t
  misc_feature (681)..(681): n is a, c, g, or t
  misc_feature (696)..(696): n is a, c, g, or t
  misc_feature (699)..(699): n is a, c, g, or t
  misc_feature (713)..(714): n is a, c, g, or t
  misc_feature (722)..(724): n is a, c, g, or t
  misc_feature (733)..(733): n is a, c, g, or t
  misc_feature (740)..(741): n is a, c, g, or t
  misc_feature (799)..(799): n is a, c, g, or t
cggtcaagatgttacatgcagtctgctgtgagactccaagataagggtgcngggaggccttaggcaagtgaccttacttatctaagantgtttccccacctggaagatgccctacaagcctccngtggctgtgtttagaaagcatgcccggcntttcttgaaagcnagccaacccagangatggcagggcaaggaagactgtaaggagtcagagtgcnnccctcaggtggaaggaaactgggccaactctacatttgtaagccaataaggngcnaggnagcncgggnacnctgagnctgtgcntccactgcccccgcgtggccagtnaggtgcagctgctcccagagatggagggtgaggaacagacgtgggagcaccagagggacagagctgatggcctgacgctctcttcaggagggcacacccaaggggcctctgcttcctcagtgccccctgagctttatcagcagaggggtgttttccagccaaaaggagctgtatctaaaactaatagantttaaactacaagactggatccaggagagaggaggacggacactaggttgaggggccaggccacactcactctgnaccacctnttnttcccgngtcaagttcccagggtcacaccagcctgcctctgcagnacaagagnaccaagctgcccttgagtgnacactntgaggctggggctcntgntagctcttcacacnnaccaaacnnnaaaatcagnaaagctnntagtgcctggagcttcactcccagccagggcagcacctctggcctctaagcagaaagncct

SEQ ID NO: 719800 - DNA, 280 bp, Homo sapiens
ctccacctgaccggataaactatatcgagcatactacagctgcaatactacgggaaagtctacatggctctctgtctatatgaagttgcaatagtaatatcgaggtcctctatcttcctatctgccatatttatctaccagacaacatcttcagcatcgtatcggatctagaaactcctactagcaacagcaatacacagacagataggacagcttctatataatactcttatcttgtactagaaaaccctatccaatcaggctatgaaatacaaagcat

SEQ ID NO: 719801 - DNA, 883 bp, Homo sapiens
  misc_feature (546)..(546): n is a, c, g, or t
agcgggccgtcccccggttcggtgcccgcggtcccgggagaggaggtgccgcgccaccggcgctccccccctcccgctgccctcgagtgccgggctgggtcgagctgcgatgccctcggacttcatctcattggctcagcgctggaccttagaccgtggaatcgctccaagttcgctctactctgcgagaatctgtctatgatcttctccccaggaggagttgacacgttgacctccatctagaagaaacatctgtatgcatccatgcagtcagacaagcggaggtgaggcaaggctcgcctcctccagcctgtagtcgcctgcatgaatgcttcattcagaatcccactcctgttctgtccgtccaatgaggcgggatgcgtgtgacaagaagtccgttatagccaagacatcatataccagacaccctatccaatgttaattcgtacactacagtacagctcgagctagtcagaggcgtactggcaatgtggaagatggcctgctccctctagacacagtggcgagaaacaaatcattgccttnggacatttcaatgagtagccagcgatctttctgcccatctaagcagctagtgcccacctttatatgttgccacaaacaatcacgcagggaatggccaaccacaatgtagacccatatcctggcacgacagtctcatccgctgagcctcaattcgtcaagccgagaagcaattcaagcggaacatggttacgtttaaataatgggacactttcagatagaataaacttgggtcacgtgcaagccattattagacccttcatgggaacccaagtgtaaacctttgcgcttgaatcaaccttgaatgtgcccataaagttccagtccacgggcccaagca

SEQ ID NO: 719802 - DNA, 874 bp, Homo sapiens
ggcttagagatcggggaacccggtccttgtgcttcgcagggatcccctcaaagggggaagaaattctttgcggggcacaaaacgtgtggagaataaagacgggacattttaaggtttgaccgcaaaaacggggttttttagcggcaccacgaggttcattccttggctgaagggatcatacgccgccgtgtatgtcccggcgggttggatagtagtggcccctaagccgatatggatctggctgtgagctcttggtatgcgccccccccgggtgtgtgtaccgttttctcctccttccccgcgaaatgtgccttcttgtggaagggcatccatcagacgacccgcggccccgaggcgccgagaagacagcgggtgttccaaaccacggggaaaaatgcgcgcgagccagccagggacaacccccctcttacacggcgggcgagcaaaaccccgcccccacggggggatcgtcggagacgggcacccaagctagacaataataggggggtattctgtccaaaatacccacttcggagccccacggcggcaagggtccccaggcgagggcaacacaatgtccgggagtgcaccacagaggagcccccaggcccgtgggctaaaaacacgtccctcatatggcatggccgtacaaggaaaacccacatggttcgtgacagtcctgaagggccagcgaatgcgcggaggccccaacagaggatccccccctttaaggggcccccggctgcgagagcccacacggggcgactgaggtcaaaaaaagtctttttctctcacagcgcgccacggccggacacaaaacttccccggcggcggcaaacctgggggcaaaaaaatttgggtcacaaacaaaaca

SEQ ID NO: 719803 - DNA, 272 bp, Homo sapiens
tgaggatcccagcactgtgagacctccgtttgagctccgaggaggcctggccaaggtggaaaaaataccctgatgtcgaaaaatgtctaaaaatccacagactggaattttcaaaaatgaggagaaacctccctgcggcaggcaaggcagctgagactcctgaacactggtagcaatgcactcttggacagcactcactgtcatgaaaaatgtacatcattggtttcatggaaacaatgccccaaccatggttgcgcttgccttggatgatg

SEQ ID NO: 719804 - DNA, 340 bp, Homo sapiens
ttgagttaaaagacataggcagctgggcacagtggcgcatgcttgtaatctcagcactttgggaggccagggtgtggagattgctagagcctgggaattctagacgagtctgggaattctagaccagcctgggcaacatggtgaaacactgtctctactgaaaatacagaaattagctgggtgtggtagcatgcacctgtagtcccagctactcaggaggctgaggttgggaggatcacctgagcctgggagttccaggctactgtgaaccgagattgcaccactgtactccagcctgggcgacaaagtgagaccctgtctcaaaaacaaaaacaaaaac

SEQ ID NO: 719805 - DNA, 550 bp, Homo sapiens
  misc_feature (6)..(6): n is a, c, g, or t
  misc_feature (13)..(14): n is a, c, g, or t
  misc_feature (24)..(24): n is a, c, g, or t
  misc_feature (28)..(28): n is a, c, g, or t
  misc_feature (36)..(37): n is a, c, g, or t
  misc_feature (48)..(48): n is a, c, g, or t
  misc_feature (54)..(54): n is a, c, g, or t
  misc_feature (57)..(58): n is a, c, g, or t
  misc_feature (62)..(62): n is a, c, g, or t
  misc_feature (64)..(64): n is a, c, g, or t
  misc_feature (74)..(74): n is a, c, g, or t
  misc_feature (81)..(81): n is a, c, g, or t
  misc_feature (91)..(91): n is a, c, g, or t
  misc_feature (111)..(111): n is a, c, g, or t
  misc_feature (115)..(115): n is a, c, g, or t
  misc_feature (120)..(120): n is a, c, g, or t
  misc_feature (180)..(180): n is a, c, g, or t
  misc_feature (195)..(195): n is a, c, g, or t
  misc_feature (219)..(219): n is a, c, g, or t
  misc_feature (236)..(236): n is a, c, g, or t
  misc_feature (254)..(254): n is a, c, g, or t
  misc_feature (256)..(256): n is a, c, g, or t
  misc_feature (262)..(262): n is a, c, g, or t
  misc_feature (264)..(264): n is a, c, g, or t
  misc_feature (268)..(268): n is a, c, g, or t
  misc_feature (279)..(279): n is a, c, g, or t
  misc_feature (303)..(303): n is a, c, g, or t
  misc_feature (314)..(314): n is a, c, g, or t
  misc_feature (319)..(319): n is a, c, g, or t
  misc_feature (324)..(324): n is a, c, g, or t
  misc_feature (350)..(350): n is a, c, g, or t
  misc_feature (359)..(359): n is a, c, g, or t
  misc_feature (367)..(367): n is a, c, g, or t
  misc_feature (376)..(376): n is a, c, g, or t
  misc_feature (384)..(384): n is a, c, g, or t
  misc_feature (399)..(399): n is a, c, g, or t
  misc_feature (419)..(419): n is a, c, g, or t
  misc_feature (426)..(426): n is a, c, g, or t
  misc_feature (431)..(431): n is a, c, g, or t
  misc_feature (487)..(487): n is a, c, g, or t
  misc_feature (491)..(491): n is a, c, g, or t
  misc_feature (502)..(502): n is a, c, g, or t
  misc_feature (530)..(530): n is a, c, g, or t
  misc_feature (536)..(536): n is a, c, g, or t
  misc_feature (546)..(546): n is a, c, g, or t
tgccanttgctannttttattttnctantagcttannaaaaaaaaaangcaaanaannaaananaaaaaaaaangaattanagtgaaaaanaattctagaaaagtttcacnaggnaagtntgcaaattcttattctaaaaaaacttctttaagtgcatgaagcttcatgtattttgcaanattcttggcctcaanatctaccacctattttttaaccanaaaaatttgaatgtatnaagaaaatttggggcaananagtaananccanatgtatttaanccaagctttgaggaacattaaganttaaggattanaaaanttggnggatttccatgcaaccagtaaaaggntttgcacanaatttganagtagaaanaaaaaaanactaaatttacaaanaaagcattgagtttgatgtntattcgngtatntgtgtgttttcttgtgatgaaaaaggcctgcctttcatcttttctttaaaaaaaanaaangtttacaaaanatttcccccagattttaaaattcatggnagtaanaaacagtaanaaaa

SEQ ID NO: 719806 - DNA, 244 bp, Homo sapiens
  misc_feature (71)..(71): n is a, c, g, or t
tccctggttgtcaagatagaatcttagtcactttaaatttgccacagaacctctaaatccccttgtaaatntaactgttagtccaaagaggaacagctctttggacactaggaaaaaaccttgtagagagagtaaaaaatttaacacccatagtaggcctaaaagcagccaccaattaagaaagcgttcaagctcaaaacccactaactcaaaaatcccaaacattattacccgaacttcctca

SEQ ID NO: 719807 - DNA, 322 bp, Homo sapiens
cgtcgaccaaccggcctttgtcggatgtcgatgaagacgcttctgctagccccggcctgctaactttatgaacggcgtgtctccagcttgctagcgtaataacgacttccctgtttcatctattgctgttcactggaccctatgatcacctgactacatagctgatgcctgctcggctgttcattaataatggtactaaattttgtttgttttgtttacctgtcggccccagcctcgaattcaggccctgtgtctagttaactgaccctctctgcccattcatcgccattttacctgttgttgttgtcttaactgttgacgc

SEQ ID NO: 719808 - DNA, 189 bp, Homo sapiens
atgagccggtaccggcactctagatccaggaaccggttgacaatgcccttggctatctaagaaatctaaatcagggctaggcactaccatgcctgtaatctcagcacttgggagggcaaggtgagaggactgcttgagctcaggaattcaagaccagcctaggcaacatagggagaatctgtctctact

SEQ ID NO: 719809 - DNA, 160 bp, Homo sapiens
gctgaccttacaggacctaaatctctcgcagcctcaaatagctgggattacagacatgacctaccgtcccgggcctcaagttcatatattattcttgagccgcttggtcaggttgattcgcacactccctctgcagtgactccaggagcccttaccacag

SEQ ID NO: 719810 - DNA, 531 bp, Homo sapiens
tgaggcataagagaagagccccagaatgaagaaagaaggagaatatggctttattcacagctgactcactttgggagagtcacggcttctctctggaactcagtttcccacttagaacatggggaaggtagaagtgtgtggagtgtgtagagtggtcaagagcctggatcaggggcttaaatcctggctgccttaccttgggccacttcaccgtgctgtgaatttccttctctgtcaaatagaggccttgtgcaaattgtttgaaagcctttgcagcaatgcttcgagtgtggtgttgtttgagtatcagtgtttgccattattcttataacaaggttctctttggtcccttctggctctgtttttatttatttttttatttctacttcctctgccctcaaattttcaaggacaggctgatttttattttattcttcaacattaaggtaactgcaaacatattgttgaaggaaaataaaaggtacttctcaggctttcgtctgcaataacttaaagaaaaggacccaaaaa

SEQ ID NO: 719811 - DNA, 204 bp, Homo sapiens
tcagtgggcggatcataatgcacagccgtaactcctgggccatggttgcagtgagctgtgattgtaccactgcattccagcctgggtgacagtagcaagattctgtcccaaaaaaaataaatacctggccgggcgtagtggctcacgcctgtaatcccagcactttgggaggccaggtagggtgggggggatcctcgtagagtc

SEQ ID NO: 719812 - DNA, 204 bp, Homo sapiens
  misc_feature (144)..(144): n is a, c, g, or t
agtgccatttaaaatgttaaagactcttaattaactaagtgtgtaaatggggtcaagcattaatcaaaaccctctcaaagtcattgttaatatttgctagacttataaatacgacaataagattcctaaggtgattttaaaagngttaaggaagagctataaatttctaaatctctaaatttaataaattgaatactgattttc

SEQ ID NO: 719813 - DNA, 1344 bp, Homo sapiens
  misc_feature (248)..(248): n is a, c, g, or t
  misc_feature (250)..(251): n is a, c, g, or t
  misc_feature (336)..(336): n is a, c, g, or t
aagaagaaggaggttcctgtcgtgtgccagaagacccgttaaagaacaaagcgaaggaactttcgcagagcatgacaatgatcgaatgcgtccgtgagatagagaacgcttgtggcccaaagacgatgcttcgcatacaggcaacgtgaggacagctgtatcatattgaaagaagcgaacatggacagctactctacaaggaattagtaggcacgatgatacgagagactgtaagattgctgagatgngnncgaggcatggcgagaagacatcagagctgtggcagagcgtatcataatgttagccgtgacgagaagcaccaaatgtatggcgcgnttgggtcattctagtacattcatgaagcggtatacaactggaaatgtgagtccctacaaggtttctgacatagcgtgctgtagcagcctctctatcggcccttcgatcaaaatcttctagatggagaatcctattgctggaaagcgttcgaaacgaaggtctctcgcattctcaaacagtgctcgcagtgattcgtagggatgccgagtatttattgacagtggggcgtgtacgccccaaatcgtagacaggtcacgtgaaatagaaagctagagtcatacaatggcgtgcgttgatgcgcagaaactcaactagagaaagcgacactttgcatttgaccaagataagcgactttgagtctcgctccggatactctttgagtatagataccggcaatcatcatgcatgggagggagtcggatggcagtgagatcatataacctgttgggagaaagcgccttcaagagagggcaaagtaactatcctgtgggccgctgcagaatcggtcttctcgcagaaggctgggaagtgcaaggaactaaggagcacccattcgtagcaagggtgggacgatgctgggctaccgggtaggacccagatccatccaggcttgttgccaaggaatgatagctaacgggtgttacacgatgacattatatgtcctaaggctgggttggttattaaaccagcgaactggggtctcgccactggtgcgcaccactacacaaagggggcgcggacacaaaatattcccgaggggccaacataactcggacgaaatgtggtccaaaagagggcccaggaggagggcgacaagcacaaaagaagccaggttcaaacagcgtgggcaaaaggagacggagacaggggggaaccacacggggggaacaacgaacaaaaacgaagagacagcgacaacatgacatgagcacaacgagcgcacgctaatcacagaaacagagatcagacagcaaagacagacgacagacaacgcgcagatgagcacac

SEQ ID NO: 719814 - DNA, 379 bp, Homo sapiens
tgaactctgaagcagctgcacttcctgtaccaccgatgatgagtgatcagctgcccctgcgaagcttcacagcaaactctgactatggcacagataagcactgaactgctgctggaacgatgggttgttgttgtcccagagtcgccaacgcattgtctgacttatttcctttgtggctagtgtgcaggtgaccaccattgacctctcagcctccctagttctgaacacttgcatcattcactaccggcaccaggaattctctcactggctgcacctgctagcactggaaacccaagggtctagttcacctgttctaaagcaaaggaaaaaaagaaccttcccccaaatcctggctcccatcatctttagcacctccatc

SEQ ID NO: 719815 - DNA, 715 bp, Homo sapiens
gtggggcagaggggtccatacggcgttgttctggattcccgtcgtaactatagagggaacactttcacaatgtccggacgcctttgatgtcctgcaaatgacggacggaggatgtccttaaagttccttggaagcgaggaacccacttaggttggcaccaatcttgaccttccagatggaacagtaccatcttataaacaggaacaagtgatggcactctatattcataaatctcaagaggacctggaagaagcttctgctggcagttcgtgcacattgttgccatttgaaaacccctgctgatgtcagttgtaatatcctccaggaattacttggccagagggctggtgctagaagtttgctgctgccaattggagccaccttccaattggctgggccggttacacttcctgtggacaccgttcactacaccagattccaggcaggccttccgggaagccaacggcttcctgggatagagataaccctgacccccaagggtcttgaaccaccaaaggccttactcaaccggggagagccattcttaagttgttaaaccccttaaccataccaaatttggccgcatggtggtacaccacagagaatttctcgcttcttggggccataattggttcggacctattttgccccattccccatttgcaaaaaaacaagggggaagcttcactccaggtgggcgatcacgatgcgtgac

SEQ ID NO: 719816 - DNA, 198 bp, Homo sapiens
agacagatacgaagtcgagcgtcggacctgtcttaaaactacaaaagatcattatctcacagtctgtgggtcaagaatttgaaagcagtttagttgagtggccctggattgtggtcccttataagcttgcagaccagctgtcagccaaggatggagtcatctggatgctttcctggggctggaggattcacttttgag

SEQ ID NO: 719817 - DNA, 236 bp, Homo sapiens
tgtgggtagacataaggaaggggtcaccaggttggggagagccccatagtgagaagcaataatgaacaattcgtggtactgagcaattgttagatgacagcgtaatcacaaacaacctgcgggcacaatgacctcattccacacgtagcagccttcagcaggaccctataaaactttcgtccagcccttgcctcttggcaggtagccccgttctctgctgagctgcccactgcaac

SEQ ID NO: 719818 - DNA, 317 bp, Homo sapiens
ttatagcacaacctagggtcagttttgcaggtggtaagccatttaccaagatagttgcaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 719819 - DNA, 522 bp, Homo sapiens
  misc_feature (91)..(91): n is a, c, g, or t
atgaaaatattgttatacatacattgtctgtcaaactccaaaaaccatggtagccttcagtgagatttccatcttggctggtcactccctnactgtaactgtaggggaaagggtttttttgggggtgtgtctggttttagtgtcaaaagggaaataaaagggtaaggaggaccctttaaaccccttggggggagttttgtaatttcccagactattttcaagcaacctggtccccccaggattagtgaccaggttttcaggaaaggatttgcttctctctaaaaaatgtttgaaaggattttattttttgatgaaagggggtatgaaaaaaccccccccaaataacttgcttaactacaaatagattcaaggggggcaaaattttattttggatattaaatgctatataatgggggccaatttatattatactgggtatggcattattaaaaagctttttcattattttttatcccaggaattttaaaatgggtaaaaattaaaaccagtgactcccgttta

SEQ ID NO: 719820 - DNA, 587 bp, Homo sapiens
ttgaggaccccattgtgtagcggatgagggcgtgaagattacttctttctcaaagagtacttgtgtggaagtttgcaagcagcgtcacccaatgtcactcttcttaagatgaagatgtagcatgacatcagccgagcatcttctctttgcaaaattttctgagtctgatcatcagagaacttcagtacggtggttataacttttgccatggtcttagtcacacgacccatcatgtactcaaaatgcacttttcgcaaatactcaaattctgtaggttctccacaagagtgagacatccgtatggtacaaattgccacctttgtaaggtgtccccacagttgttgcatatacattcttttcatatttcttcaaacgatcttctaaattgtgaatctgttctctgaactcttgctctttcaatttcgaatcactgattaaagtcgtcttctgtgctagctgtgtctgtagctccataattgttacattatcattgccagggttctcctcctgctctagcttttgctggtatttcttctgcagctcctcaagttgagtctgcaggtcccttcatccgcttatcaatgggg

SEQ ID NO: 719821 - DNA, 543 bp, Homo sapiens
ctggcgctcttcaactgcacttgaagttagaacccttcaggttctcagttacacgagccaataagcagctcttatggtttaagctggtctgaaatggggtttctcctggtcatatgggttcttccactttcaggatcctcagaacccccagcaatgccaacaagaactccaccctttcctcaaatggctcagatttcctgacaacaaacacaatttcctagtgcacagaacagacccctggcttgcttccctcagactgtgaagcaaaaggacaaagtaacaaaggttaactttcgttggtaccttcctctctgagcccatctcttgctcctgactattcctctccttcaggacactcgggccaatttcgagttccaaaagcaggtccgatatcagctctgaaattccactaagtctccagatactactggcactcctgtgcctaagagtgagtgtgtgaatgcaggggtaagcgtgtgaatatctgcgtgagtgtaatggataagtgtaaatgtaggaatgcgtgtgtgagtatgagtatga

SEQ ID NO: 719822 - DNA, 112 bp, Homo sapiens
gcctcagttcaccttttgacaatgagggtccctggctcagcttcttgggctgctaatgctcaagggtgtttgggaccccgtggggataatgttgaaggcttaaagcttccaa

SEQ ID NO: 719823 - DNA, 82 bp, Homo sapiens
  misc_feature (18)..(18): n is a, c, g, or t
gtagattatttgaggtcnggaggatcccttaagcccaggagttggagaccagactgggaaacaaagtgctgcctatctctac

SEQ ID NO: 719824 - DNA, 544 bp, Homo sapiens
tcttctgcatcttgaattgactagaaattactttgtcaaggagagctagcagcataaagactccccgataccagacgagctacctatgaacagctataatagcacacccgtctatgtagcataatattgccgaagatttatatgtagaggcgacaaacctaccgagcctgcttattcctagtctctttctgtaaaatattagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaaatgttagtataagtaacatgaaaacattctcctccgcataagcctgcgtcagaattaaacactgaactgacaattaacagccca

SEQ ID NO: 719825 - DNA, 169 bp, Homo sapiens
tatagtttccttgtgggacacacagagagacaaactgagaaggaaaagggaacctgtcaaaacccccaagtccatggacctcatgatcccccatgagtcacagctatcctctgtctttaagaatgactagttttatagctttttaacaccccaacaattaggtaaccct

SEQ ID NO: 719826 - DNA, 363 bp, Homo sapiens
ggaatccaaattttggccatagctgtttccggggcgaaaaaaaacgccaagcaaaccttaaattttgcttaggggtgttcccgggggggtacagtccacaaacacgcagtacacacgttgcacacgcaagctcccacgctgcacacacacatgcgcacacacacgcacacttgcacaaaattggttgaaaacagataagcatatctaagcaactacgatttctgtgtggatcaggccaaagtcccgctaagattctccaatgttttcatggtctgagcccccctcctgttcccatatacactgcccctcggccctgtctgtgccctgcctttcagaggagggggctcagattgtgcggcctga

SEQ ID NO: 719827 - DNA, 184 bp, Homo sapiens
cagacaacagcatctatcatcacagagcagcacgtagtcatttcacacaccagcatctcatgattacggtgctggtgtgtggatagatacgtgctgttgtgtggattcgataagatgtcttggtgtggtcgtaatatgctgttgtgtggttggatcaggtgctggtgtgtcgtctggataaagg

SEQ ID NO: 719828 - DNA, 505 bp, Homo sapiens
gcttaaggaaatcacacagcgtcatagacggtgactgccttctgtttttaatgacacatgatttttttaaagaaacatgagaaacatgtggatgtagttatttaagaagccttcatttaaccagtatcaaggaaatcagtttaattatgggtgaattccacagcaaaataaaattagctttgtatataaattaacttggtcataatctgttttatacttgctgcttataatgtgtgcagtgtgtatgactaactgtttgtgctacacataaatacaatattttaataatactaataataatttggctgttatttgtaagagatcatagcaaaatgttgcatttacaattactcacccgacagattaaaataacatagcacattgatgctttttttgtttttgttttttactgcatctttgttctggtctaatgtacatagtgattttatacaggacttcattggtgtttatcaataaatctcttatttttcaacaaaaaaaaaaa

SEQ ID NO: 719829 - DNA, 283 bp, Homo sapiens
atataaatgtagtggagtcatgaagtgagacattggagacaaatagagaagattattataattgtctatggtgtagtactcgagagtgtagcgcctaaccggcagcagcagttacagcagggaacttgttggacatatagattcatggacctaccccagatccactgagatacgaaactcgggaggggggtactcacctatcactgtttacataccgtccttttggtgattgtgatgtctgctaaagtgagaaccaaagcctatggaaaagatatgggggagg

SEQ ID NO: 719830 - DNA, 259 bp, Homo sapiens
ccttccaacatctcattgcctctctattaaaaatacaaaaaatgagccgggagtggtggcggatgcttgtaatcccagctactcgggaggctgaggcaggagaatcgcttgaacccgggaggtggagattgcagtgagccaagatcgcaccattgcactccagcctgacaagagcaaaactctgtctcaaacaaaacaaaacaaaacaaaaaccaaggagagagaaactgtttatatagcgccatgagatgttggaagg

SEQ ID NO: 719831 - DNA, 553 bp, Homo sapiens
tggcgtgatatctgagcgaacctgatggcccgggtgtggtcgctgatgagtgttcctcatcatatgggaagtgtggctgggggcgccgtctacctgagtgtacgaacaggagctgctggggtgctagcgaaaagagccaggcagccctacatgaaggctggagaggtggtcccacaccggcatgtaccagttcaggcagtacttgtgtcagcagacaggcctgcgagataccccagctcccagacccctccaacgatttactttcccatccgtgactcctggaatgcatggcatcatgacggtgatgtcagctctgtcggtggtcccctccatggcccgtgagtactccaaggatgggctggtgagtatgtgaaggctcgaccaagtagccagagtcagctgggtgccgttgctgcctccggtcagaacgggcagggaatgtcgactgacctgaagactccggacgtgggaccccactcttgagggcagctcccgttgccttgcatggccaataaaggacttcagaatgtggaacaaacgacttcacctccct

SEQ ID NO: 719832 - DNA, 736 bp, Homo sapiens
cctgaacttgtgtgatgtcaagtacaaaacagatgtcgtaccaataaaaaatgaaagaaactgatacacactaaggaccaaagataagaaagagttgacaaagaaggaacagtactttataaaacaccaagcttggaccaccttacacaagtatctgaagagatgagttcatactatgattcttacaaacagtggtctcaacattccccatgtcgggcaatatgaatatatttctaacataaaaattaagtacagactctggtggcgctctactccctatagatgtatctccttttgaaggcccaaatctgtcaatcgtttaagtgacaccagccttcggatttcacacaatctgcatccgaagatgccttctcactgcttgtcactccttatcagatagaacatggagtcattgtgctgactagattcaatctagccagaacgattggcctactggcctctgaagaacttttatggtcaagttgtcatattaacggtggttccatgaatctttgggccccttttggcattgtcgaatactgatcgtagcaaagactctaagagaagtccattgtccaatcacattaggcattcgtcctagatgtgtccttcggacaaccagacataacacacacaaccaatagaccaatcaacgtaaacccgcacccagaacaaaaactctctgacggcttaaagatctagcccttccaaaaaaaaatcccataacagcacccgc

SEQ ID NO: 719833 - DNA, 139 bp, Homo sapiens
gcaccccgataatctgaccttaacatgtaacagcgtgagccccagcagaactgagacactaaatgaaaattaatccagcttgaggctgggcacttattcgatgcattcatcaccaagaagcatctctttgcctctgtcc

SEQ ID NO: 719834 - DNA, 164 bp, Homo sapiens
gctctagaggatcctgccgccgtacagttgcggctaaggctaggtatgatttaaaggttttactgctaacctacaaagcatctatctttgtaggtctagcatctatcttttccgatttggtccttgccgtacatacctacacgtacgcaactggtacggcggtg

SEQ ID NO: 719835 - DNA, 1328 bp, Homo sapiens
  misc_feature (213)..(213): n is a, c, g, or t
  misc_feature (456)..(456): n is a, c, g, or t
  misc_feature (622)..(622): n is a, c, g, or t
  misc_feature (834)..(834): n is a, c, g, or t
caaccccccctgccgccgcgccggtggtggcgtggggagtagtaaccaaaaggacctcccggtttttaagtgttaaaacgcccgtcgcaggaaatgtcgccccccctggggaagaacctccccaactgtcgccacacagcccgcggtgttgtgtggaacaacctcccccaattaaggaaaggaacctaccccgggggggggccccccggagtncctccacggccgccttcctccgggggaagcctttcgtaagcgccctccttataaggggccgcccgcgccgggcgggggactgcccgcggaatgttacatccgacaacttggtgttcggacaccacccaacggggggagaaaaacaaccggtcttatatggagcccccacctcataatgggccgcccctaatatttataaagggggtgaaacaacacttaaagatataggggaaaccacaacgngtgtggtgggaacgacgacaaacataaaagaagccccacgcgggcctggggggtgtataacaccgggggtctcgccggggagaaaattttcttcgccgcgcggagatatatctcgtcttctcggaagaacaacacacacggcgcggtttcccgcgcctctttgttntttgtggggggggatatatggaacacagggttatatggagacacacacaaaacaaaggcgctctgtgtccggggagaaacgcgccttttttcttcgggcgcgcttttttgggtgcccccctctgggggttcgtacactgtctttcccccccatcattttctctcgtgggccctaaactcttttgccctcgagagtgttctttgtctaaaccnccccgccacagtttgcgcacagaccacacacttgtggggagagtttctcgtgtgttgtgttccaccaattggggttttgagagctctgtgtctctgttgtttcgctggggagagatttctgggagaactcttggacaaacaacgtgcacactaactcggggggagaggtggtgttcctcgcttctaagctcttccaccgcagtagagaggcggccctctctgtgtaacctatatctctctcttcacatacacactgaacttctcttctttgaaagcacctattaatttaaatcttccgcctgttctgcgctgcacgcacgtaactaactgtgcaaacaataagggtaaaatggtgtttcacaaaaggttaaccacagtgtggaacttggtggttaagccacacgctgtttaactcaaacagtacgtgtcctgtttttaaaaaatacaattatttttataaaataaaatataaatctgtacaccttacaatttca

SEQ ID NO: 719836 - DNA, 935 bp, Homo sapiens
tattctcccctcgtgtgtcctgccatgacgattatttttctctggtgccatttgggtcgctctatacaatttctggtcggcaatccggtccctctcgggcgtctccctccctatggcgcctctccatcctagacgtctgcacgcgcgttttggaaccgtgtccccgtcttttaaaggctctggtcccgcgctgttacgcagacttttggtgctctctcccggatccgtgctccgccgccccctggggctgtctaggccgggatccatgttctgcggccgtcgttcttccgaggaagtgcttccttacaatacgcttggtgttctggaacggcattatggtgtcaacggcacgagccccaccccaccggcgggctcaaatcgcgaaaaccacccccggcgggttcatccccatgtgccagacagaacccggggtctcacaatgtgggagcacaaagaatcctgttttggatatgcgaatgtccaccagtgattgtgtggacatctaaacaacgctcctggccacccctcccactgggcgccaaataagtggactcgtattgccccttttcgcgccctcccgtggttttccccgaagtttttctcccctggataacaacgagcgccaaaacgggtcttgccgggattctcctgtatagaaccacaatctcctgcccgcctccggaataccacacgacagtatcgccgctgattgtttgcacccccagaaaggttgtgcgcgggaaatccgaccttttcttcctccggggttacatttcttgaaaaagagtcccccgttgatgtgatcaacgacccccccctgttaaagaaacaataacatgttgtcaagaagcatgggtagagtaagaaacataaaggaggatgtcctgcactaccaataaacacttttttttaaaaaacttaaccaccacaaaaca

SEQ ID NO: 719837 - DNA, 788 bp, Homo sapiens
  misc_feature (12)..(12): n is a, c, g, or t
  misc_feature (157)..(157): n is a, c, g, or t
  misc_feature (199)..(199): n is a, c, g, or t
  misc_feature (217)..(217): n is a, c, g, or t
  misc_feature (220)..(220): n is a, c, g, or t
  misc_feature (291)..(291): n is a, c, g, or t
  misc_feature (451)..(451): n is a, c, g, or t
  misc_feature (513)..(513): n is a, c, g, or t
  misc_feature (653)..(653): n is a, c, g, or t
  misc_feature (680)..(680): n is a, c, g, or t
ctgttttattcnacagtcaaggcgggagccaattcacttcctctaactatcttccccgccttaaccccttttccacctgcatttagtgcagcccaatttccaccttgtaacccccccttggcccgaaaaaaaattctcccaccttaccccctcgggnccaagggggacccaaagttttttatcggggaggggggcgccncaataacccccacccccnccnatatttcgaggcgcgctacaccctttctctccgcggtttggagggttttctcacatttgttccccccggcncttatattttggccccccctctccccaaattttctttgaaagacccgcccccgcgcccaaaatgaaattatttttcgggggctctccccccacatttggggtcgtctcccctaaaaacacgcccttttttcttttatagggtgtttattactcaaaaacnccttctctctttgttttttattataaggggcgcgctccacccccgcgcgcttgtttctttcncttccaaagagagaggcgtatgagagagcgccgccccctctatatttataatagaagcgcggccctctcccacgcgtctttttcttctcttaaaagagacaagctcctccttctcgtgctccctctgtttatattatccncccacataacctctccccccctctctncttattttctctgcgccggcgcggggaggagagctatatttataaaagagagcgtatttggaagagagagaccctgcgcctccctcattatatttttgggggaagtct

SEQ ID NO: 719838 - DNA, 650 bp, Homo sapiens
gatgcggttgcccttgtaacatatagtctgtgcctgtcctccctgtgcaggggtatccgtgtagggtgacctggaattcgaattctgtttcccttgtaaaatattggtctgtctcttttttttagaaaaaaaaaagggcgggaacggtggtcacgcgctgtatacccagcatattagggcgaataccaaggcgggggggaatcacctgagggctagaggagattcgacgaccagaccgtgaccagaaagtggagaaaccctcagttctcgtacataggaaggtaaaaaaattaagccgggggatatagggagtgcgccttgtaaatcccagctactcaaggaggctgaggcaggagaatcgccgtgaacccagagggcgggaggtggaagtgagcggaaaatccacaccatgggcactccagctggggaccacaattagcaaacctccatctcaaattaaaaaagacaatgccctacgccgccgcttcaaaaatgcaagggatcacactaaaattagccaaactgaacggggttgagatgcatcacacctctgggacaaacttgcttggccaacactcatggtagctacggaatacaaagtacgaccaaaatctacaagaacacacaacaacaacgagcaagagaaaaaa

SEQ ID NO: 719839 - DNA, 98 bp, Homo sapiens
gcggccgcctactactactactactgctcgaattcaagcttctaacgatgtacggggacatggttcacattagaataaaaggtagtaattagaaaaaa

SEQ ID NO: 719840 - DNA, 483 bp, Homo sapiens
  misc_feature (34)..(34): n is a, c, g, or t
  misc_feature (75)..(75): n is a, c, g, or t
  misc_feature (79)..(79): n is a, c, g, or t
  misc_feature (81)..(82): n is a, c, g, or t
  misc_feature (107)..(108): n is a, c, g, or t
  misc_feature (113)..(113): n is a, c, g, or t
  misc_feature (122)..(123): n is a, c, g, or t
  misc_feature (125)..(125): n is a, c, g, or t
  misc_feature (127)..(127): n is a, c, g, or t
  misc_feature (254)..(254): n is a, c, g, or t
ttaagctgactgaatacaagatcaacaagagcantgtactcctggcaattaggacagatgggaggaacagggagngggnannggagagaagcgagtgtggagagcannagggnagggggganngnantgcggtgtttatagagagttcaaaataaagatttattttcgaaacaagtgactttggtttatttcatacattacaatttttcttgcagaaaaaaataaaattgtacaactgcataaatataaaaatnttccaccatgaaaatggttaaaacattcataaagacacagcaccagcatgtgatgcctccagaaaggaaaaaaggaaagtaaaagaaaatgtataaagcaaattaattagccctgtcactagccaaagtgatgggcagatccagatctcagacacagctttaaaacataccggaggacaaggcaagagatgtcaagacagcattcaatacaagcataacacaacccatc

SEQ ID NO: 719841 - DNA, 132 bp, Homo sapiens
ctcccaattatgaggaattggtatgagtatataccagaattctgcatggcagcaagttttattaatcagaataacactaggttgtggaagtgactcatgctgaaaaaattgattatttttattagacagttt

SEQ ID NO: 719842 - DNA, 146 bp, Homo sapiens
aaccagggtcatcgcgtgcaggatagtaaatctggggctgcccggtggtcttaggttcgagaagtagctgtattttcagtattttctacataatatggtacacagtagagcacatgcactgcatcaatacaatgggtacattttct

SEQ ID NO: 719843 - DNA, 569 bp, Homo sapiens
ggtcgaaccacgcgtccgaccaccgtagccgggaccctcgggacaacggctccaggtccggggaacctcccctatgatgtggcggctactggaggaggctgtgaggaagaacggggtcgcgaggagaggaggagagctccacaatggacgtgacggacgtcgaccgatggcggcctactatcccagccctgcgccgaccccacgtactcgtgacgaccgaactcgcacgggtcgtcccgaggagctgcatgtgctcaagaatcactcttggggcccgtgaagtccgggagacacgtttaaagttcggctcctcggattcctatgcaccgtttcgtgcaccttaaccgggatacgcccgtgttatgcctactttgtagccccttccagcctatcaactcactgcaccaccgcaaacccaccatgtcatgcacacaccccccgtgaccacaataacgcccgcctccccgcagctcctagacttacacaacagcttataacgtcaccgaaaacacacccctcaaaaccacgacacaagaggggccacgtgcacccgacgcacttcccagtgc

SEQ ID NO: 719844 - DNA, 572 bp, Homo sapiens
ctatcctcactctattatttgcaaaagggttatacacagtaacaccttctaactgaagtattaaacaaagtttccattgctgtcgtattttgcttaattattatccttatagcagggataatagttactaacaaaaaggaagcatgaaagttttactatcactgagcctggtaagactttttattgggtttagtgatgcagttttaaatgaaacatgccgcttttggattaatacctctagtaaaggaaaatttacagatacttaaaaatcaaatcaaaattattgataggctcaggaaaaatgccagcttcagccctgagtggctacaaaccctctttaataaattccagtcttctttatggaattggttaacgcctttattaaaccctctcttgcttatatgacttgcattgatattgggctctgtatatacaatactataacttgaaattgttttttcttgcctagaaaccatccaactcccaatggtggtttaaaccggaccaaaaaaggaccagggcttttttcccaggaccctttaatttatcccaggggggaccctaactgttat

SEQ ID NO: 719845 - DNA, 850 bp, Homo sapiens
tccttgaatgtgtgtctggtcatacaccagtactacaaggacagctttattcctgcaatgatcttgtcacctacagcaataaaaaatggccagagtgatcagtgtcctgatgagtgaaatgatggagctcagagaagctttatgccaaagttgatacttgatggcaagtgtgatacatacagcttcaatgagttgaatgactatgttcaatggctgcttgctatgcctatatgcctaggtgtatatgatgtactgatgaccactctacatgaacaaccttgatgtgctacatggtgatactgtgaccaatgatgtgaatgtgatcatgctttgatagagtaatatcaatgatacttccattgtgcctcaaagaatgcacaggatagtattgccaatgacctattagaacaatgcaatacacataaatgaatgtgaatgtgtgattttgttgcagaatctgtgtgtgtaacttacagatgcacatcacgaatagcataaagagcgatcctctattgtgctctgtaattcttgatgcgcgaaaaattgtgacatcctgtgagtgcttgatgtgaatgtgaagatcgaatatccctagtgaaaattgataccttagatattgtactgtgcaattgtacactcgccgaacgtgagaccccaaaacactggacattgatgctactatctaaattgctatgtttgggaggatagggatattgtacccttcttgtaacacactgactcaacctttgtcatgttgccagaccacgaatggtgaattgacatggaacaattctaaccaacaaatgaagctaaaccccctttccaccacttcctgggaacttctgaatga

SEQ ID NO: 719846 - DNA, 922 bp, Homo sapiens
ggagcaagagaagaaaacacaaagggcggaaggaagcgggagacaggtggggtactcgggaagctgagcgggccggcggtgcagcacgggggagcgaggcctgtgtgcttggcaaccgagggactcgcctcggaggcgaccccagaccaacagacactgggtcaaggagtacgcagagcatcaacacactgacggcagagcacgcacaacagtcatcatggctccagcgtctgctcgtgaaaccaagatacagatgcccattttccaccaccaagcaagcagagccgtgttgttttgtccacacaatcaaacatgcacatccacaggagcagagctctcaaaagattattggccgagaacatgtcacgggacgaaaggtttctggaagaacgaagctcgtgccttttctctctggtacagcattgtttgtcacccaggggacgtaggtctaaccaaggtttattgtggcgcagctaaatccctagattgtcggttcatgggcccaaaagtggacttgggggggtctcctgggggattggggctttggccaaggggtatccatacattcggagtttgcagagtaaatcccattttttttgaaggatcagtccgtggggcgtgtttgtgctccaacagacataacagggctgcctctttacctgttgggaatggcacaatacaggatgttcagtgcgacgggagaccctcagcttcactcctaaatctgtgtcttggctttccgaagttttaaccttgaatttgtcctttaattccagtgcccttacactacaaactctatggccaacaaacaacaaacaaatttgtggcgcgcgcaagattttacacactggggcgccagacagaacgcacgttcaaaccggcggaggtggtcacaaacggggggggcaccagttgggttgga

SEQ ID NO: 719847 - DNA, 133 bp, Homo sapiens
agcacctaaccagtagacctacccaggtagacccagctattggttgaatgagtaggctgatggtttcgataataactagtatggggataaggggtgtaggtctacctgggttaggttacctgggttaggtcta

SEQ ID NO: 719848 - DNA, 255 bp, Homo sapiens
  misc_feature (17)..(17): n is a, c, g, or t
  misc_feature (36)..(36): n is a, c, g, or t
cgtcttgttttcatttnatttatgttaaaaatacantattacaaagtctaaagcaatttttgtttccttaattaacataattttcctagttgttacatccaaaacatacaagtgacctcaaccttaaacttttgttcctactcccaccctcatcgaactagacagcacgaaaagggtttgactacccctgcccatccctgatccaggtaccaccattgtaagtaaacactttcagaaattcagctggttcctcca

SEQ ID NO: 719849 - DNA, 1748 bp, Homo sapiens
tgttatccagccatagaaataatgaaggtgttaatataggcacaaggatgaaaaaactgactagtggaacagcatacagcattcaaaagtcagcacccacgtgtatcccatcacctgcagttttgcagcaacaggtgaccattgcaagtgtcagtgggggcaacagggtgtacttatcccagtcaacatgtcactttgccaatcaaaatttagtcaatttgcatcacaacacagttcatttgcgcaggtggcattgccagcatcttgcacatcattgcaccatgttgcaacagctattcaccacacagacacacatctctcagggcaccagttctgtcacaatcttggcagtcaaccgcaaccagcgtcatcattcgcagacaccaccagacaaaacagcgcatttccaacacccattcacagacattacagccacaccttccaacatcaattcaaaccattctgcagccacacctctactccatatatcaattcacagcaaacagaaacccgcaccgcagattcacaggtcacacaaataggcagacccaaagacaaacactcaccatcggacgcgccaggccagcaaaggccatcatttactcgacaccgaatatgaccattcgttacatttgattagcaaccaaaacaagggcaaacgccagcaagctaaatcacgccaccgacaagctagtcacgcgcacacacaccttataacataccccaaagccaaccgggcccaaccaaggacatcgcgttcgcacaaacgcttctttacacaggacatatacaggtaccaccacacactaggctacacatacctatcacgggcatacattacaggtcggttagaacaacagcacattaccaacaatcaaccgacacacaaattggccaattttcagcaagcgacacaataacacgatagcacacaccgttgagacattcagccaataccacccaagctacaaacaaacaacccgattatgaccacccaaaatccccccatcatgtccgcgccaccgtccaactgagcaaatatacgagagcctcgcacacctccacaatttacgcatcatctccgacagcgaatcagccctagcaccatccacgcacaaacacaagagtaaacacggagcagccacgctgaccacacacatccacacacgaacggaggcgccacacaacattgcggcaacacacggaccacaccacgaaagcaatacacaaaccgaaatcacaacgcaagcgccacagaccggcacagacgagaacagcagccccagaacgagaccacagacgagaaccatgacacgacgacaacgagcgtcagcacaacaccccaaagaaccacgtccacgccacaaatgcccaaccgcaacacagacgcacaactctacaccagcgccaccaacactaccaggcaaacaccgcaacaacaccgaagcacacccgcacacagcacaacagagcaacagcgcagagcaagtaagccaacgaacgcaacaagcaccacaccgacgggggaccgatccacgcgatagcaacagcctagcgaccgaccacacaaccacaagcaggaaagtgaacccccaacgccgacgatgagctcagtgacacggcacacgagcaccataacgacgaggccaaccaagccgcggcgcaacgcgaacacaccacgagcacaagcaaccacagcccgagcaatcacgcgaaaacaacataaaagaccgaacgcactttcgacc

SEQ ID NO: 719850 - DNA, 127 bp, Homo sapiens
tcccaaggataagaaattgtataggacggtatcggaatctaggacacatggtaactggaggaataacatagaggagactgtaataatagctactacataataagtaggcactatactatagcagaca

SEQ ID NO: 719851 - DNA, 213 bp, Homo sapiens
  misc_feature (155)..(155): n is a, c, g, or t
gggttgtgggcgcgccggtcggcgaccatcgtcatgatacgcggctgggggagaagtcacggatcaagtgtgatcagtattggcccaacagagtgcacggagacctacggcttcatccaggtcacgttgctagtataccatcgaggctggccacnattctgcgtccaggacattctgctctgcacaagtaatggctccagctgagaaacgcga

SEQ ID NO: 719852 - DNA, 375 bp, Homo sapiens
ttaagttcctgttagtctagaacggtcgccctctggtgcttttctcatggcaatgatgtttttgcaggtcaggccaggtgttaagtggaatgtgtctcagtctgggttgtctccttgtttccttgaggtccgatcagggctaaacatctttggcaggaatgtggcagggtatgtgtgcctatccttgcttcacgtggtacaagtttatccctgaaccttttaatatatatatataaacttaatttttaatacatctgaagttagtgtggggtaaaatgaggatttcatcagatttttttttttttagaacagcttcaactgcatttaatccacaatcctttcaatgtcttttaaaattcttcatttacaacagag

SEQ ID NO: 719853 - DNA, 259 bp, Homo sapiens
caccctctctgctcacatcacactatccatcatgaccagccacacacccaccccaccgaccaccaacaccgccgacctgaaaaatacttcgggcggtatgtgggttaccctcctacctccccattgggttcagaacataaagcaaatagacacagtcatactgtcactgctctggactgtgtggagcccgctaaagtcatggtcatggcaggaacccaagctggccgcccttctcatccattctaatcactcgtatgtg

SEQ ID NO: 719854 - DNA, 248 bp, Homo sapiens
aggcgcactgatcagataatggggcaggagcatggcttagtggagactggaccgttgactggctcttgcgctttgaatttatcttgacctttaactgaaacttgtcctttaacgggatcttgtcctttgaatggaacacggcctttgactgtgtcttgacctttaactggtactcctgtgtcggctgcctctagaaccagcgtcccagcgtatgaggaactaccaccacgatgggaagagctgctgac

SEQ ID NO: 719855 - DNA, 987 bp, Homo sapiens
ggtgatgtctcacagaaagttctccgctcccagcacatgggtcccgcgaggttcctgtcctcggaaatcgcagcagcagcgcattatgtgaaggtgaatagcttccctaaggatgacccgtccaagccggtccacctcacagaccttcctggagatacaatgggtgccctctgaaatcatatcgtgcgggaagtcgacaggccggagatccaaggctgaacaagcaagcgagcgtggtgcgagtgctgtgtacacattgctggagaagacacaccgcatgcgatggattggtcgcagcgttgtagccgttacgctggaagactccctggatggtctgcgggaagttttgtgactgtctgtgctgaggcggcgtccctgatcactgagggactcttccctatgtgagttggcctgacagtctgacaaagaaaggcacttggaccggggtacccggcgtgagaatgcgcgcggagtagaggaatcggcgagagcgcagggcgccagagaccgatctccccagggggccctaattcaagggagccagtcaaggacgaaaccgatggtgcacatggccaagggatgccgggagtctgcgcgggggctgctcccgacggcacgaagagcactgggaccggactgaagtggaggatccagggtgacaccgggagggctgggggcgagaagcctggactgcgtcgcgcgagaaggcgttgaagcaagcaggtacctcgctgaacacaaggtgtgaggggcagggatgaagagaaccgacgtcaaggggcagaccaaaaggcgaagcgctaaccacgggtcaccagacggggaccacaagacgcagacccgacgaaccagcgagggctggccaagtgggccggcatagggctggcccggccgggtccctcgtgggacccggcgcgggcgaaaggccagaccgcggaggccacacaaaagggaacgagggcgggcacaacgcaggaaaacacaaac

SEQ ID NO: 719856 - DNA, 769 bp, Homo sapiens
  misc_feature (580)..(580): n is a, c, g, or t
tagggggttaatttggcgtattggggtcatggcagggggtttaatattgataattgttgtgatgaaattgatggcccctaaaataaaggaaacacctgctaggttgttaaggaaaagagtggttaggctcctacggaggcctccagggtgtgggagttagttctcccgtgctaagggagggtaaactgtctcacaccgtgtgtcccgtgcctccggccctccacatattatgcagatgtcgatcaggagttaggaaaaagggaggtaaagatgctcaaaacgctatatttagtttgttatattcgcgtgggaaaccgccatatattctggtggtgccaccggactatatatatgtggcgaaacttagctcaagtttcgccaaaaagccctccagaattatagattgcggtattttactatttgaaagaacgatttatttcacacaattggcatcttgtgcgctgttggacctcgatatatcacctgtgtcgtaagacttgttgtgctcggttcaccctcttatagaaatgtgttttcgccctgtgggctttgtgcccccacgctctctgtgctctcgcanatataacagtgggacgcgccgtataatgacgctggctgtggcccttaagagcaaccctcccagacgcctctatttgccgcgctctgatattttaactacgcgctatctgcgctgtgttccccacagtgctcttattggtgcgggtcagctggtagaacagacttttttggacagcgccgtgggatttgg

SEQ ID NO: 719857 - DNA, 165 bp, Homo sapiens
tgctatgacagtgagagcagtgcaaaagccaggagcagggacgtccaggagcctggagccattgccacagtcttcagtgcctgatctgtgtcagtgcactgaatcctcctgttaacagatgcctaatcgcgatgaatctgcccttattaatagtaaagaacgcta

SEQ ID NO: 719858 - DNA, 152 bp, Homo sapiens
tcttccccgttgaagaccacgagtatgattgggaacatgggggtgaatgacatctctgggaactagtggcaaagacagggctagaggtatgtggagctggtactgtctctgcgaatctgaagtcactctaaagtttgtcgcccgttatcgag

SEQ ID NO: 719859 - DNA, 1597 bp, Homo sapiens
  misc_feature (1597)..(1597): n is a, c, g, or t
gtcgttgtgctgcctgggagacaaggtgctaacatagatgttaagtgagatacattaacgagtggctcacataaatgaaagatatgctgagaaccctaatggacgattggacgagttcctctagctgtcaacattacacatatatagggccctctgttccgacaaccgccattaagatcaggtcccgatgtgtggtctcgttgccaagtatagtaagcgtgtgcctcgatggttcgtacagttggcacaatggcgtgcgagcacgggactctagctggtgtggctacttgcgcttataaaaacaaacgagcattctagtcaggacttgtcagatcttatctactcgtctatacttagttactcgaatgtcgagagactcaatacttacacgcaggtcagacgttagtggtatcagttgcatttcgagagggtcttgcgcgttgccacctgatgggcgtgtccccaagtgtcggaccttagtgcaggttggcgccatagagggcaagtaaacaagaacgacgacgaatggtggatccacaggcatgggatattaagcgagcacttagcagagctcaagatagggtaggggaagaagatcctctttgagagaaacacactaatcgaacgcaaagaagcagtaggattaatggcctagaagagtctagtaaagcttgtagagacaaaggaattctgggggcgcattgtacgtttcatagacataactatgaggatatattctgcacttaaaggccccgggtatcaagtcgaccgatctgtacctccattttgaccatttgttcgagtgcaaggtgctcatttgtatcacgagttagggctagtcttggattgcaaaaacttatattgtgcgagacaacgggacctggctcaagattcctcgggggaaggctggggtcacacggcgatggtttcctggccaggggcgtttcattcccggcccctcgtggtcccttattgggaagcaaacccaagggacttctgtcttccagggggcttctaagggaaccggccaaagggtgtggctcacaagagccaaaggcaagggcccaagatttcccgacgtctgacgcatgggtcggcacaccgttgcgaatttccgcaacaaaagcgtgggggacttgggggggcaaaaaccacggaggagatacctctacacccaccattttggggggcgagcatggacaccacacaaaaggggcttggtaaaacccatgtgttgccaccacccagacagttaaacagcgcgtcgcccctgtggaggtgcttctcgagataaacacccacgacagaacagtccaaccacgaccacgggggggggagagaccaacaccacaccgacgaggggcaatacaagggtccacccaccaccaacatctgtgaaacaagccgacttcacaacagacgaagctccaccccaggttgaagggacgaactcagtacagattccaaaagacgacatggtaacaacaacaaaggcgggccgcacactcaaccacacacaacaaactcatactcacagccgtaaaagccacagggaagctagaacgactcgactacacgaacagacgcaatcaccacn

SEQ ID NO: 719860 - DNA, 311 bp, Homo sapiens
aaaccagaggtcaagatagggtaatataaggggaaaatcaaagagcaggaaagctagtgtcaatagggagacatatatctaaagaagagctaatatagatagagtatgagatatatgtgatattatgcaaatataatctcaccatgatagatcatcatctaaaagcgtgtatggaatgttatgatgatagagaagtatcaggtgagattgataagaggtgacatctagaaataaaatcatatgagtctctgaggaaatgatgcataagaaggacgtctcaaagagataacctgagtatgtacataaagagc

SEQ ID NO: 719861 - DNA, 307 bp, Homo sapiens
ccccatgcatcagtttccagaaaatttaaaaattagccaggtatggctgggcatggtggctcacgtctgtaatcccagcacttgggaggccgaagtgggcggatcacaaggtcaggagatcaagaccatcctggctaacacggtgaaacctcatttctactaaaaatacaaaaaattagctgggcgtggtggtgggcgcctgtagtcccagctacttgggaggctgaggtaggagaatggcttgaacctgggaagcggagcttgcaatgagccgagatcgcaccactgcactccaggctgggcgaca

SEQ ID NO: 719862 - DNA, 207 bp, Homo sapiens
gccgagaagacatcatagctggttacggctcttatgacaccaagatcatccaagtcctgacatttcgacaagggatgtcacggccgctgctaatcagatgcgcaacttccgggtgcgatcctcctgatgccttcgctgcgaaccgtgggagataatatttgactcatggggtctggatggggacagctatgaactcgagggacatcc

SEQ ID NO: 719863 - DNA, 313 bp, Homo sapiens
atagtgcacaataggaagggtcccaggctggagagcccaagttgagaacaataatgaacaattattgtatgaacaattgttagaaacagctaatcacaaacaacctgcgggcacaatgacctcattccacacgtagcacccttcagcaggaccctataaaactttcctccagcccctgcctctttgcaggtagccccttctctgctgagctgcccactgcaacatattttcacaatttctctaataaatctgcccttctttacctacaactatcttggtcaatggctttaccacctgcaaaactgaccctagg

SEQ ID NO: 719864 - DNA, 212 bp, Homo sapiens
tgcgtttatagaagattagatagctaaagaataaactaggccgggcacagcggctcacacatgtaaccccagcactttgggaggccgaggcgggtagactgcctgaagtcaggagttcgaaaccagccttgccctcccaaagtgctgggatcacaggagcgagccaccgcacctggccaacaatgtcttttaaaaaataaaattgctctatg

SEQ ID NO: 719865 - DNA, 261 bp, Homo sapiens
tgtcagacgtaactatgtggaccatataaacagatacagcagtgtctctgccattaaaataaattattgtgttatcacaaactctgataaaaacaatgatttgcactgcataaataaagtccacgtcaagcatataaacatgttggtttacctctggggattcttttaattgcattgtttccacagggtgttgtctgagtatttggctaacccatgcttctgtgctgagttacttgacacatagcttcagtcgttctgaca

SEQ ID NO: 719866 - DNA, 810 bp, Homo sapiens
gcttacgtatgagtgctatgaccttttgtccaccatggatatatctgactgctttattgatggtaatgacaaactggaagacctgcttagggatatttatgactgaaaaccttgcaagctttaatgccacaagcaaccaccttgatctcagagcaggagcttggggaaagatctacaagagccttgaatttagtgctacacgaacagaggggaaggtccttcttaataatactctgagtttcatagtgacttgaggcataactatcaatcacaaacgtatatccaacaaattcactatcctgaacaactcgaatcactcatttatttccatattaaaatcacaaactcatccattaatgtagatacacagcactgtatgggactctgagatgtagccaattccaatacattataggacttccatcatggacatcatatgggatactgctggtcttatcctgtccctcctccaggtagagagaccacaagcaggctcaccatacacataagctagaaccactcagatgactgcactttctatggcatattggatccttaaaattcattccatttgctgcttgtctgaactttctagaatactaattaacataccttctatggatccttataagtgacgaatgcaccatatccaagtacattggaaaacaataggccgtgagataactgaatattgtcccgtcatgtataagaaccacattaaacctaggacaccgtcaccccaatgtggtccacacactctaatagctattacactggtaaaattaagccctttagaaattacaaattatt

SEQ ID NO: 719867 - DNA, 256 bp, Homo sapiens
  misc_feature (40)..(40): n is a, c, g, or t
  misc_feature (42)..(42): n is a, c, g, or t
  misc_feature (98)..(98): n is a, c, g, or t
  misc_feature (152)..(152): n is a, c, g, or t
  misc_feature (194)..(194): n is a, c, g, or t
  misc_feature (199)..(199): n is a, c, g, or t
  misc_feature (220)..(220): n is a, c, g, or t
  misc_feature (228)..(228): n is a, c, g, or t
  misc_feature (250)..(250): n is a, c, g, or t
gggaccatctcatgctaccagtcgagaagcaagctgggcncnggcagctgcctttgacatccagagaaaccgctgtcacaggcacagctctggatcangaatgggctacactgaaggctcttgctccctgttgcaacaagtccacttgctanaatgcatgattcccaatctaccttctactctcactgtgaaantcttncaaaatgctaaaatatcacanaagctttnaaaatcaatgtgtggatatatntgcttt

SEQ ID NO: 719868 - DNA, 107 bp, Homo sapiens
ctggggtgtgggtagcataggggctaatgaggtgttgctctatcttaaggctccctggcagaacctgagctggcttacgggaccctcctcacctggttccagttcgg

SEQ ID NO: 719869 - DNA, 361 bp, Homo sapiens
  misc_feature (46)..(46): n is a, c, g, or t
tgtcccatggggccccgggggccgttttttcagttttaacccccanttttgcgggcagaaaggattaaccccccccccccggggggatttttaaaccgggccccccgaacccccccccccccggggaacccgggacccctgggttctgttttgggggggcgaatttttaaagttttccccaaccttgaacttggggaaagggtttttccaaagaaaggggatccgccccaaaaaccagggggcccccccgggtttttttgtttccccccccccccttcccccttttacccccgtttttccccccctttttcccccttccccgtttactttttttgttttataaagggcaatttttttttta

SEQ ID NO: 719870 - DNA, 1052 bp, Homo sapiens
  misc_feature (16)..(16): n is a, c, g, or t
  misc_feature (38)..(38): n is a, c, g, or t
  misc_feature (45)..(45): n is a, c, g, or t
  misc_feature (51)..(51): n is a, c, g, or t
  misc_feature (62)..(62): n is a, c, g, or t
  misc_feature (88)..(88): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (146)..(146): n is a, c, g, or t
  misc_feature (149)..(149): n is a, c, g, or t
  misc_feature (151)..(151): n is a, c, g, or t
  misc_feature (160)..(160): n is a, c, g, or t
  misc_feature (167)..(167): n is a, c, g, or t
  misc_feature (174)..(174): n is a, c, g, or t
  misc_feature (177)..(177): n is a, c, g, or t
  misc_feature (181)..(181): n is a, c, g, or t
  misc_feature (190)..(190): n is a, c, g, or t
  misc_feature (194)..(195): n is a, c, g, or t
  misc_feature (200)..(200): n is a, c, g, or t
  misc_feature (203)..(203): n is a, c, g, or t
  misc_feature (206)..(206): n is a, c, g, or t
  misc_feature (218)..(218): n is a, c, g, or t
  misc_feature (226)..(226): n is a, c, g, or t
  misc_feature (237)..(237): n is a, c, g, or t
  misc_feature (239)..(239): n is a, c, g, or t
  misc_feature (263)..(263): n is a, c, g, or t
  misc_feature (265)..(265): n is a, c, g, or t
  misc_feature (297)..(297): n is a, c, g, or t
  misc_feature (308)..(308): n is a, c, g, or t
  misc_feature (323)..(323): n is a, c, g, or t
  misc_feature (407)..(407): n is a, c, g, or t
  misc_feature (450)..(450): n is a, c, g, or t
  misc_feature (452)..(452): n is a, c, g, or t
  misc_feature (459)..(459): n is a, c, g, or t
  misc_feature (485)..(485): n is a, c, g, or t
  misc_feature (497)..(497): n is a, c, g, or t
  misc_feature (514)..(514): n is a, c, g, or t
  misc_feature (526)..(526): n is a, c, g, or t
  misc_feature (540)..(540): n is a, c, g, or t
  misc_feature (554)..(554): n is a, c, g, or t
  misc_feature (567)..(567): n is a, c, g, or t
  misc_feature (575)..(575): n is a, c, g, or t
  misc_feature (581)..(581): n is a, c, g, or t
  misc_feature (601)..(601): n is a, c, g, or t
  misc_feature (603)..(603): n is a, c, g, or t
  misc_feature (638)..(638): n is a, c, g, or t
  misc_feature (666)..(666): n is a, c, g, or t
  misc_feature (670)..(670): n is a, c, g, or t
  misc_feature (676)..(676): n is a, c, g, or t
  misc_feature (690)..(690): n is a, c, g, or t
  misc_feature (730)..(730): n is a, c, g, or t
  misc_feature (745)..(745): n is a, c, g, or t
  misc_feature (747)..(747): n is a, c, g, or t
  misc_feature (756)..(756): n is a, c, g, or t
  misc_feature (778)..(778): n is a, c, g, or t
  misc_feature (786)..(786): n is a, c, g, or t
  misc_feature (797)..(797): n is a, c, g, or t
  misc_feature (809)..(809): n is a, c, g, or t
  misc_feature (814)..(814): n is a, c, g, or t
  misc_feature (825)..(825): n is a, c, g, or t
  misc_feature (831)..(831): n is a, c, g, or t
  misc_feature (838)..(838): n is a, c, g, or t
  misc_feature (845)..(845): n is a, c, g, or t
  misc_feature (851)..(851): n is a, c, g, or t
  misc_feature (864)..(864): n is a, c, g, or t
  misc_feature (891)..(891): n is a, c, g, or t
  misc_feature (893)..(893): n is a, c, g, or t
  misc_feature (902)..(902): n is a, c, g, or t
  misc_feature (904)..(904): n is a, c, g, or t
  misc_feature (924)..(924): n is a, c, g, or t
  misc_feature (931)..(931): n is a, c, g, or t
  misc_feature (948)..(949): n is a, c, g, or t
  misc_feature (969)..(969): n is a, c, g, or t
  misc_feature (981)..(981): n is a, c, g, or t
  misc_feature (1042)..(1042): n is a, c, g, or t
gttggtgggaagcgcntcgaaaagcgatgccgattctngtttccnggggcnggcggcccacntgcggtggacccagcgcggaggcggnggcggcgaggcgcgcgagaggaaagtaagaagcgggggtggcggcgggngngnggcgnggngncgcgggggngtggggnggggtgngcngagnggcctgggngagnnggggnggnggngcagggggcggngacggagnggggtgggcgngnggtggggcgaggagggcgcccgananggggaagagacgggctgggcggtgcggggggnggagggggggnggcgccagagggganaaaagagggggcgtgggacgagacagaaaaggaggagacgcgagagaggtcgcgaggagaggagaggtccacgtggcgtgtgcntccagaggagacacgccccgtgtcggggggtgtgggacgcgtncnagtcacntacgggaggcagacgagcgatgcgcnagaaaggtcgcncgtggcaccccccaganaaaggacgggtnacgtgcggcgcacnacacaaggggtccncgcgaaacggccnaaaagganagcgtngagaggcgggggagaggggngngaggcgtaatggggggcaggaaagcgtggggcgcnaaagcgcagggggcgggaggcgtggccncgcngggggnagggtggccgcccnggggccccccagggccccggggcatcgcctccgaaccccntgtcgtggcgcaacnanaggggcccnaaagccccggggggcccccccnaggggacnaccggtgtagnagcggggccccntgtcntaacggaaccntcctgngggcccntcgcagnacaaanccccccgtagggnacaagggcccggtttggggtttgggcncnagggaatgnangtttttttccctggggagcnaggaccnaaggaaagaaaaagggnngtggaaagcgggccccagcnacgcccgtggcnacaaccaaaagcccggtccccgagggcgcccccgcccggtggggaagggtggggcgccctngcccggggag

SEQ ID NO: 719871 - DNA, 187 bp, Homo sapiens
tcttttgaaacataccaacgattgtaaactgtccagtttattattattattatttagatggctacagacaatgctgggctctcacacctagcactagccttttctggctgaaagaggcttgcggcacatgatcagaccgcagggtcttctggtttttcctttttttttttttccttttttccgttat

SEQ ID NO: 719872 - DNA, 1276 bp, Homo sapiens
tggaaccacgctgctatgagagctctggactgcatacctaccaccaactcgatgcaactgacaaggcctcttgtcgccgtgcctctccaggatgtctacaaaatagagtggtatttggtactgttcctgttaggccgtagttggagactggtgttctcgaatactcgcggtatggtgggtcacgctttgctccagtcatagctgttacgaacaggaagttacaatctgtcgtagaatgcaccatagaagcgtttgagtgaatgcgtcttcctgggggacaatagtgtggacttcagagtgtcacagaactgtgtctgtacacaccggatgattcagtcagtgtgctagacagattgcttggtgacaagcaagaatagattgacgcctacctaattgtgagaagctatgcgtagcgtcattgcactttgcctccagggtgactttatcctttgataccgaatcctaggcgcaaaatcaggcgccggggcgtaactgctcccctggtacttcgcgatttggccacgagcgggctgtcacatgttgcatctgacaaaggttctgcgtgagctatgcaacggacacaacgattgactcagcccggtgtcatgggtaatgagcagtcctgagaaacgaaatgggccctgtaacacacttctttgcaaagtctctgggactggacatgctgtgccagttggttatcgagttacttggtgtaccctgtgtcaaagggccacattggtgatgggtgtagaacgtaaggcctctcctcagggaacttaattccaagccgtttgggaggtttcggccttctttgcatgttatacggtgaactacttgaagaccgaggaaccacggtttgcccgggatgccgcggttgttccagtcaaataggcaaggttgggaaccacacgtacacggcttgtgctgggaaggcattggggccacaggggtcaaccccgaaaggttccttgtcgccacggaaaagtggctttcaatggaacactggggcgtttgatcgcagtcggcacactgtcagtattattcccccccgtataagtaagccctttgcgaccaagaccccccaaccgatcgttttaaactccaacggttcgggttggcgcaccagaacatcggggttccgcacacgggacaaccgttgggtttagtagcgtttatcacaaagactctggggcggcccaattttatcacacgtcttataaagagtcaaggttaacacacacacgaacatttgggcgtctacagttggcacttaacc

SEQ ID NO: 719873 - DNA, 152 bp, Homo sapiens
tgagtgatcagaggatccgccatgtggggctcactggtctcaacatcctgactcgagcaatccatctgcctcagcctccctagtagctgggatcacaagcatgtgccaccacaccgggctaatttggtatttttaatagagacggagttggt

SEQ ID NO: 719874 - DNA, 242 bp, Homo sapiens
gaccacgcttggccccagtttcatcctcagtgaagtggagataacaacaggatctgaagcacgcatggtggctcatccctgtaatcccagcactttaggaagccgaggcaggaagattgcttgagcccaagactttgagatcagcttaggcaacatagcaagaccttgtctctccaaaaaaatagccaggtgtgatggcacacacttgtggtcccagctactcaggaggctaaggtgggaga

SEQ ID NO: 719875 - DNA, 334 bp, Homo sapiens
acacctattattaatttattctcctcttttcttaaaaatgccaacttcctgcttagggattctttccataccaatccaaattcaacacatttccctctaaatttaaacagttcaagctggaactgttttccaagcccttggatgaatgacccaaacttctgttttcaacagaagactgcttttaaaagtaaacattgaattgagactatctctccattagtacaagttttaataaaaatgtaaagtggtttgatttcagatattttgcatctgctttggaggcaaagatttgaatttcatgataaaataaaaaagattttgacatttcatgata

SEQ ID NO: 719876 - DNA, 184 bp, Homo sapiens
acgatatatggcggtcagcacggtagctcacgtgtcagacggaacttgtacagagaaggcatgcaccgcagtggtgaatacacgtcgaccaggctccatcttaacgatattgtggtggtcagcacggtgctcacgtgtcgacggaacttgtccagggaggcatgcaccgcagtggtgaatacac

SEQ ID NO: 719877 - DNA, 427 bp, Homo sapiens
agctttatgtactgtgtaggaaagcgaagatagacttgacctacaagagatgtagacagggtcaagtgtaaccaagaaataggatacttcccctggtggccaaccaaggaacggaggagccaagcatacaagagatatagcctggccacctagttctatcctgtcactcataaacgagaagtgactaccaaaaaaaaaaaagattgggggagaagaggaacttatcaaaaacattaacttggctttaaaagaaccacaaaggcgagtttaagacaattaattttaccagattacggtcaacaattcaaattttagaaggccaattaaggaggctcattaattccccagagggtccaagagctcacctaggacctctatgtatttccatttcaaagtgcagttaagtcactaaataacagctggagag

SEQ ID NO: 719878 - DNA, 857 bp, Homo sapiens
  misc_feature (5)..(5): n is a, c, g, or t
  misc_feature (67)..(67): n is a, c, g, or t
  misc_feature (75)..(75): n is a, c, g, or t
  misc_feature (79)..(79): n is a, c, g, or t
  misc_feature (110)..(110): n is a, c, g, or t
  misc_feature (112)..(112): n is a, c, g, or t
  misc_feature (114)..(115): n is a, c, g, or t
  misc_feature (157)..(157): n is a, c, g, or t
  misc_feature (173)..(173): n is a, c, g, or t
  misc_feature (178)..(178): n is a, c, g, or t
  misc_feature (261)..(261): n is a, c, g, or t
  misc_feature (266)..(266): n is a, c, g, or t
  misc_feature (454)..(454): n is a, c, g, or t
  misc_feature (548)..(548): n is a, c, g, or t
  misc_feature (689)..(689): n is a, c, g, or t
  misc_feature (694)..(694): n is a, c, g, or t
  misc_feature (696)..(696): n is a, c, g, or t
  misc_feature (702)..(704): n is a, c, g, or t
  misc_feature (706)..(711): n is a, c, g, or t
  misc_feature (713)..(713): n is a, c, g, or t
  misc_feature (717)..(717): n is a, c, g, or t
  misc_feature (725)..(725): n is a, c, g, or t
  misc_feature (740)..(741): n is a, c, g, or t
  misc_feature (756)..(756): n is a, c, g, or t
  misc_feature (762)..(762): n is a, c, g, or t
  misc_feature (857)..(857): n is a, c, g, or t
gggtnttctttcaattttccccaagaaaagatggactgcgtttttgaaacatgatgatatcattganaggggttnaaanagaaagtgcctgggcctccttctaagtgttnanannaaaaaaaggaaaaagaaaagatcttctcagttaaaaattttnggaagggagactatanatggntcttgccctaagtgagaggtcttccctcccgcaccaaaaaatagaaaggctttctatttcactggcccaggtagggggaaggngagtnactttgagtctgtgggcctcatttcccaggtgccttcaatgctcatcaaaaccaggcatggggaaggccctggcaaactgctccacccgttgcctgaggttggccagacgctgacttgtttctgagtccttaagcaggaaggatttgaaatcctggagcttggcagttttgctcttcacctctaagcnaatgttgaccccttcatctataaagtccacaactctccggaagtcatcctcacggaactgtcgagaagttaaggctggggccccaagccgcagngcccggtgtgatggcacttcggtctccaggacaggtgttcttgttggcagtgatggatagaagctctagcacccgctcagcccgagctccatccaggcccttgggcgcaggtccaccagcaccaggtggttgtcagtacanctgananaaaaannnannnnnntntagnaggggatntgccatgggccgggnnttcttcagacctgcnggagtntccggaacatgggggtgaggcctgctttagggcacagctactgcagcaatggcatgattgtgggggccccctgcaggatgggaaacggaaagttn

SEQ ID NO: 719879 - DNA, 128 bp, Homo sapiens
tcgcgctctagaggacccagttctggcccccactgttcaacctgcagactataggtttcctttccctaaaaataaaacaaacaaacaaaatatcttccaagtctactgttctctctcactttcttttt

SEQ ID NO: 719880 - DNA, 378 bp, Homo sapiens
agagattgcagatgcgaggtgcggtgttggtggtgcgcgagcctgggttggccgcaccagcaggaaagtgaggatgcacagcagctaggcagaagagtgacagcgccagtcccaccctggtgatcaggctcgcttccatgtcctccacgtcataatgagccatacggtgcgcaaagctgctcaggtggctgcattggcaggtggtgctgccgttcttgctgcccagcacctggcagccctcggtggcccagtgccctcccctgtcgctgtcactcttccagaaggcacagagcagctcctgccgtggcccaggcatcacgtccttggcaggagggtctcttcccgcctccccatcggaggactcaaggtgggagaagg

SEQ ID NO: 719881 - DNA, 257 bp, Homo sapiens
gggctgcaggattcggcacgagctgaggtcaggagttcgagcccagcctggccaacatggcgaaaccctacctctactaaaaatacaaaaattggcctggcgtggtggcaggcacctgtaatcccaactacgcaggaggctgaggcaggagaattgcttgaacccgggaggcggaggttgcagtgagccgagatcgcgccaatggcactccattcagcttgagtgacagaggtgagactcccatctcaaggtaaaaa

SEQ ID NO: 719882 - DNA, 112 bp, Homo sapiens
atttcatttagttattttcattaatatatgataggtagttaaaaaaacactagatgtgcgtattaatgccagacagacttggtaatggaataagcctgagtagaatttctgt

SEQ ID NO: 719883 - DNA, 142 bp, Homo sapiens
  misc_feature (3)..(3): n is a, c, g, or t
acncttcatagtgtgtatgcaaagcttgttgactctagcgtctcagagaggactttgctgagtttctttctgtgaatatctccgtgctgaccatgctggaacatgcattattctgctattcggcacctactgcaggggtcca

SEQ ID NO: 719884 - DNA, 133 bp, Homo sapiens
tggtcttttggtttttctagagcagcaccggcccccgcggcttttagaattcccgggctaggggtcaaatcagagctgtggttgcgggccatacaccaaagccacagaaacgcaggacccaagcatagggcaa

SEQ ID NO: 719885 - DNA, 220 bp, Homo sapiens
  misc_feature (78)..(78): n is a, c, g, or t
  misc_feature (176)..(176): n is a, c, g, or t
tagaaatcctcttctacttgtttagttctttcaccacttttcaacccccaccccccaagtcttatttctgtaattttnctttttaaaaaaattatggaacaacaattttaaattaggtaaaattttaccacatacaattttttacacaaaattatttccttctaaattcatatttngattaatagacacaaatgtatttagtctttccataaaatttaaa

SEQ ID NO: 719886 - DNA, 390 bp, Homo sapiens
cacctgtccaaaaaggccttcgatacgggataatcctatttattacctcagaaggttttttcttcgcaggatttttcttagccttttaccacttcaggctaggccctaccccccaattaggagggcacttgcccccaacaagcatcaccccgctaaatccctagaagtcccactctctaaacacatccgtattactcgcatcagagagtatcaatcacctgagctcaccatagtctaatagagaacaaccccgacccaataattcaagcgctgcttattacacatttactcggggctctatattacccccctacaagcgtcatgagtagcttcgagtgtcccttcaccatattcgacgggatctacggctcaacatattttgtagcacag

SEQ ID NO: 719887 - DNA, 381 bp, Homo sapiens
  misc_feature (371)..(371): n is a, c, g, or t
gatgcaagtccctgatatggccccccacaaccatggaaaaacccctggaaaaaccatatccaagtgaagaatgccccagacatgaaaggcccacatattatatgatttccatttatatgaaatgtcccagaacaggcgaatatatatagagagaaggcagattagtggttgcttaggctgaagggttggggaggacaaaggggtgactgctaattagtatggggtttcttttttggggtgatgtaaacgttgtaaagttgattgtggtaatggtggcacaactctgaatatactaaaaaccactgaattgtatactttgaatgtttgaactgtgtggtatgtagattttatctcaagttgttataaaatanttaaattaca

SEQ ID NO: 719888 - DNA, 344 bp, Homo sapiens
ccccccttcctgggtgggggggtgggggggatggggccccccccccccctcccccgggggggtgtttttttggggggtggtttccccccctttaaggggggggggcccccaaaagggggttttttttttggggggggggcccccccccccccccggggggccctttttttttttttttttttttacggcccccctttttttccccccccaaaaaggggaaaaaaagaaaataatgggaagggcgtaacagtcgcgcagagattctgggtaacattggatgaggaaaaagggggacaggatgaagaagaaaagaacttgtgagaggaataaagaaaataaaaaaa

SEQ ID NO: 719889 - DNA, 134 bp, Homo sapiens
gtcagtgttatcattcaactacaaaacacttaaaagtacagctcaggtgagaaacagcagccttggtgacagagcaatgacactatctcaaaaaacacaaacaacaaaagttgggtggaatttttgggaaagac

SEQ ID NO: 719890 - DNA, 421 bp, Homo sapiens
  misc_feature (11)..(11): n is a, c, g, or t
  misc_feature (52)..(52): n is a, c, g, or t
  misc_feature (54)..(54): n is a, c, g, or t
  misc_feature (69)..(69): n is a, c, g, or t
attcggcacgnggggagctggggtcactgcgcggtgggaccatggcctcgantnagccgctgcgacgtncacttgtacagcgccggtcaacatcgcggtcatcaagtacttggagatggggtttcaccgtgttggccaggctggtctgaagctcctgacctcgtgatctgcccacctcagcctcccaaagtgctgggattacagactgtcactgcgacacccaggctggagtgcaatggcgtgatctcggctcactgcaacctccgcttcccgggttcaaccgattctcctgcctcagcctctcgagtagctgggactacagggggcaagcgcgatgaagagctggttctgcccatcaactcctccctgagcgtcactctgcaccaggaccagttaagaaaccaccacaacagccgtcatc

SEQ ID NO: 719891 - DNA, 297 bp, Homo sapiens
aagcgatttgatccctcaaatatacatccctggcccaaccagtggcctgagcctccctctggtggagactcctaccacccatgagctaccccagagggtccaagacagagtgcacagagacctggggaaggaagctgaactttgcagagatgtggacaggtgcatgctacggtacaggctggtggtagaggagacccagtcttatttccaggcccacagtctctccccaaaagcccccatgaattccagatggagttctcagtgcccccggacaggcctctccagcttcacactctt

SEQ ID NO: 719892 - DNA, 1171 bp, Homo sapiens
atttagttactttgtttctgttggttctttttttcacttgtctgttgttgtgttaagtaagtgtactccttcggttttgcttatttgttgttttcacgtgcttggccgccggttgttctcgtcccttttttataggagggcctccctctgggggctgaccacctcttggtggagcctccggggttgaatttttttatggagcgcccgtctcgcgtggccccggggttgtcgcctcctcccctcccctcccctgtcctccggtgggaacccaaacatgtcccgccgtggagttaagccgttcccggggtttgaaaacgcaacccccgtgttgcgtgtccccttctctcctgttcacacagcctgtgccgtcccccccgccctgatggccttctgtccctgctggtaaaggaaactggtggacgcccatggatgctggaagaattccggcagcctcatggaagagattcccccggccattttggattaccgggtatgcgttgaggacagttggtacggtgctggtcaacccttgtgagaacgccgtattccgccttcacccggatataaatgtggccactggaaccaccctgtgcccctggtccctactgaagagctgcctccctggagccttttcccaagtgtgagccgccccccccgcctgtgtgctgaatccaaggactggaagaaggtggaagtgaaaagtcttcccgctgctctgggcccctcctggggagagcccccgctccccgggcttcgcttccacggacctcttctgtgacccagatgaacttgcttcgcctgtgtacctcgctgtcccccgtgctcttttctgagaaaactatcccaattatgggtgggaaaaagcttctgtattgagaagggtcataattgctctttctaggaggtttgttgttttgcctcgcttaattttgaggagccacggaagctccactgggggctttctcgtagcccctctcccaaaggagtctttattctgagaatttgaagctgaaacctctttaaatcttcacgaatgattttattgaagagggcccccagcccccaatgggaaactgtttttagaaaatatgatgagtttttgattgcttttgtatttaattctgcaggtgttcaagttttataaaaataaagatttataaccagaacccca

SEQ ID NO: 719893 - DNA, 215 bp, Homo sapiens
  misc_feature (119)..(119): n is a, c, g, or t
  misc_feature (149)..(149): n is a, c, g, or t
  misc_feature (177)..(177): n is a, c, g, or t
acaggcactctgccatgtgtgttgaatgaaagagaaagtgcagaagagatattagaaaaaagtacagtgataccccatgaccagcatacaaatccagaaaacataaacatcagtgtctngtgtcccatgtgtcatagtcaaagattttnggtactgctcaaaacctaccaaatagantttaaataaagtgagataaagaacacaagaaaaaaaaa

SEQ ID NO: 719894 - DNA, 168 bp, Homo sapiens
gaggaattcgatcacgtgcattgtggggaggcgaggatacttactggagaggcagagagacaggatcgagaaggaaacttcagaaggagctactcagagtcaggatgatgagttctggagaccttaaggcttagcagtgagtgttcatcacacaaatggcacgtggat

SEQ ID NO: 719895 - DNA, 317 bp, Homo sapiens
aggccttgaactctggatctacctatttctgcctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctctgtctctctcgtcgacgc

SEQ ID NO: 719896 - DNA, 958 bp, Homo sapiens
  misc_feature (822)..(822): n is a, c, g, or t
gcacacgacctctgccccgttgggcctcccacgtcccatggctctgggcggtccagaaggagcaggccctgggcctccacctcggtgcagggcacagaaggctggggtggggggaggagtggattacctccgcgcaccctggtcgccaggacagctccacatgatccgcatgatctcccgtacctgagtgtctagaaatgtactcaagatggcaatgccgccctccgcctacctttaccgaggtacaggcctgtccatctggccacagcagaggcttgtgcggggtcaaagctggaataggccaggcagcgcttccatgtggtcttactcccaagcactctctgggtgaccaacatagtatttaactggttaacgggcacttgtcgccaaggtctgtacagtcaagagcgtctagacggggccagtcggacctcctcaggcgatcgtttgtgtctactcttaggactggagccacgagggatggtttacctgtcgatccagttgaacgtctaggtatacgtttaaaagatctgtacacgctgtgacaaggtatttttggaaagagcagaagatacaggttcttcattgttgtgtcccacgttacgtatgctagatacacagtgcatagaagagtctcctgaagtcgttctcatcaaccttgcccttgtggtctctcacggagaggagaaagtcagctgcggtaccgtccacattgggtcgtgacaacttgtgttagcccggacattttacctttggtacttgcctgaagctgtgctgggttagtattgcttgacgctctggaaggaacgtataccgggccanaggaaaggggccatttgtagagtcccgttttagaaggggaagaggcacaacttctgtcgaaaattcattggaacgttggaattctagagaggttgctcttatggggcatatgtaacgtgttctgaaattcacgggg

SEQ ID NO: 719897 - DNA, 560 bp, Homo sapiens
agggaggtaaggcatagttattattagtactgaaacatgctcttttacctaacagtaaccaagtatgtctggatatatatctggtaaatatgcttatagtaggtaagaaagggacttgaggtcccaggagatttcatttaattcacccgggtcagatacaataaaggctatgagtataaatccataacttcctaaccaggtgtagggcatgttcatgactatcaaatctttggatgcgggacccaagacaggaaaagtggtagctaaaggtggatttactaataactagacgtctatgtgagaaaatatatgtatacatatatatgatatgcagaagtcacttatttaatcaggctttattctccttacaaagccacagtttaactggtctgcaacagtgggtttatgttaatggatagacaattacccagtgtaggtaactttttccaactaccacggtaatgataatctttctcacgtatatacatgcaacttctgggcttcatttccatgaagctggtatcagtatatccagtatacttggtcctcactacatgcca

SEQ ID NO: 719898 - DNA, 147 bp, Homo sapiens
  misc_feature (97)..(97): n is a, c, g, or t
aacgtgggcgagggcgcggttttttggcggcagcgctttcccccgcccgccaaccccgaggccgccttcccgtctttcgggtttgaattgccccccngcagggagcgctgggaaggggccctcgcgatgggggaggggccacggggc

SEQ ID NO: 719899 - DNA, 342 bp, Homo sapiens
  misc_feature (12)..(12): n is a, c, g, or t
cagctcggcccnggtgaggctgcagtgcattccagcctgtgctacgagagtgagatctgtctccaataaaaacaaaaaacaaaacaaataaaaaaacaggctgggcacagtggctcatgcctgtaaacccagagctttggaaggccaaggcgggtggatcgcttgaggccaggagttcaagatcagcctagccaaaatggtgaaaccccctctctactacaaatacaaaaattagctgggtgtggtggcatgcacctgtggtcccagctacttgggaggctgaggcaggagaattgcttgaatctgggagatggaggttgcagggagccgagattgcgccac

SEQ ID NO: 719900 - DNA, 753 bp, Homo sapiens
gcttcggctccctgcgttaggtctggctggcggtcaatgcgcttcctgcgaccctgcggatcacgagtgtgtggatcgctatatgggggaggggagctcagtgtatcaccatgtcaacagccagccctccggactcgtgactgtcacccttctgatttcgcgcttagatgtgcctctgcaggatgaaagctggggacgtcctcgaatggtgggcgcacctctgcctccttcttgtgcgggtggcggtcccgccctgatcccttggcagggctttgtttcttcttgttctggcctacggggagagtcgggtgccgggccccgcctttgcttgtccaccttccaggctttaacgctctgcaaaacagtgtgtagatcacacctcaggcgatgttgcaagacttccctgccagggggagtcagacattctgagtcctagaccgagataccagctgaagggaacgctgcctgtgtgaacccctgtgttgtacaagtttccagaggaaggggatgagctcctgagatggaagatctgtcctctccagactccacccttctccaagggggacataatctactctcattcagcccgttttcaggacatcgggcgactttccacggcttgtgctgggggactttacccgtgcagatggacaccgctgggccttgcccgggcgactgtcccgggttccactgggcactttcgccgggcctctggacccccgtttaccctgtttcccggggcgggcaccactt

SEQ ID NO: 719901 - DNA, 974 bp, Homo sapiens
agcgtaagtgaccatcgggacccctgcgcaattgaaacataatccacgtcactgggacgaaggggaagtggctccacctgtgccttcacggaatgtatcctccgaagctatggcctgaagacgggattctttagctactccccacctgtgtgcaggttcggtgagcggatcctgcatcaatggggcagcccatcagtacctgagctcttcaccaagtacttactggcgcctctaccaccggctggaggagaccaaggatgtgcagctagtgtactaccatgcccccctaacttaccgcttccttgacactgcataggccttccacgtcttacctaccaagagaaggtaggaccttggcagtaggtaggaggtagggcatatggctgtgtggcttaatagacttgcaccaacatacatacaggaagccctaggttggttgtagccggagtactacctactactttggcatacgaccacaccaggcctaccctggggggataaccgggtggagaagatacagcatggcagaaacgggggcatctattaagcaaggtgtaccctgcctatcactgtgctccaacctgaaggtcccctggcagtgctgagggacctgagcccagcagatctcattgtaccttctatacctagtgttccgatgctgggaggccctcgaggacagggtgggccggcgctgaccctgggcctggcaggggggagcaaccagcgggtccaaacgccgcaagggcctagcagatggaccacaggatggctagacgcgggaggacccgccatggtgctggggagccaaggcatccggcaagggatctgaggcagcatgaccaggagactatgtacagccaaaatcaaatggcggccgggctcgaacacgagaagtcgggcgagacccgtcatgaaacgacgcccacatgacctgagcctcaaacgcacacgccgatcaagttctagaccagacg

SEQ ID NO: 719902 - DNA, 178 bp, Homo sapiens
gctttgagacagtctgcacgtgccaaggctagagtgcagtggtgcgatctcagctcactacaacctctgtctccgggttcaagcaattctccttccctccctcccttccttttttttcttttttttttttttttggggcaccccccattttaaaagttttttaaccaaaagggttacc

SEQ ID NO: 719903 - DNA, 108 bp, Homo sapiens
aattcggcacgatgtttttaattaaattaaaaactgtatatacatacatatatatatggtgcttgcctgggcaacacagcaagacgtcatctctacaaaaagtaaaat

SEQ ID NO: 719904 - DNA, 265 bp, Homo sapiens
  misc_feature (229)..(229): n is a, c, g, or t
ccatgctcagctaattatttgttttttgtagagaaggggccagggtgtcttgaagtcctgggctcaagcgtcttcctgccttggcctccccaaatgctggaattacaggcatgagccattgtgctttgccagataagtaaggtttggataagtaaagagaagggaagggtattccaggctaggagaaagagagtagtagggttgaaggttagtgtgaaacttttatgtntgtgggtagggagattaatttgtcaggagcagaggg

SEQ ID NO: 719905 - DNA, 325 bp, Homo sapiens
  misc_feature (36)..(36): n is a, c, g, or t
  misc_feature (100)..(100): n is a, c, g, or t
  misc_feature (111)..(111): n is a, c, g, or t
  misc_feature (122)..(122): n is a, c, g, or t
  misc_feature (167)..(167): n is a, c, g, or t
  misc_feature (180)..(180): n is a, c, g, or t
  misc_feature (192)..(192): n is a, c, g, or t
  misc_feature (197)..(197): n is a, c, g, or t
  misc_feature (205)..(205): n is a, c, g, or t
  misc_feature (271)..(271): n is a, c, g, or t
gatctagaggatcccaggtcgacggagactctcccnccatttaggttttgtctccgtcacttcaacaaaacttaacagttccctccacgcagctaaatgnagtggtcagtnttgttggtttngttttcgtttggttttttttttttggtttggtttggtttggaganggagtctcactcngtcacccagggnggagngcaggggngcaatctcggctcacggcaacctccacctccgggtaacaggtgattcttcggtctcagcctctcgngcagctcagattacgggagcatagcaggagagtctccgtcgaacggggtaccga

SEQ ID NO: 719906 - DNA, 943 bp, Homo sapiens
ggtgcgatgcgcttgtgtccccgtggtctgacaggagcagcctgtggtcacctgcggcgtgtagttggagtgctgtggagaggtgtccgtagcctgcgccgccctgcccctgccatggtgcctcctgtctggacccgagttctgccgtgcgcgcgctcgccctgcctagtgcttgcgcctcaacgcgccgttgtgcagtgcttgagctactggtggctgtggcatccgcctggttcttggcgctggttttcccgcctgctgacccagctgcaccttacattgtctggaggaacctgccatgggctccatcatggtggaggagcagtttgcgcggcggagacccgtgcccgggcttttgcccgggacttcgccgcccacctgcaagaagtcgggggctctgccagtggcctggcttgaacggacgatgcggtcagatagggctggaggtctacacgcagagtttctcccggaaacttgcccttcccagattgagacccacgagcgctatatggtgtcgggcaccaacgttgtacgggatccttgcgggccccgagttgctgacagcaccgagtcgcttgtgctcacccgtgcccttgtggctctgactctaccaacagacaggctgttggggctgctgcttggcacctggcttgcccacttccgggggcaagatatattgcgccaaagatatcgtctaccttggtaacagaccatgaccttctgggcactgagggcttggcttgaaggcctaccacgatgtcaatgtcacctggcattgcagtcgtcatccccatgcaggtccgagctggtgccattcaggcagaccgtggacctggaagctgagcaattgaatgtgggtcaccaagctcgatgtggacgttgaggggcttacggggaaggtgccaaacttgaacatgccaaatctcttcagaccttcttgcaa

SEQ ID NO: 719907 - DNA, 1231 bp, Homo sapiens
ggcagaaggaacgtgataacagaagtaagcgatgatgaggctgaacgaacacaggaagacaaagcaagaacgaaacaagaacacacacgaacgagaacagagctcgcgatagacaacacctgcaacacttgacacgatgcttggcttcctgactgacggaacgacacgaaccacgaacggactggctgatcacacgcaacgcaaccgaagacacgcaagacttaacggacacaacgctacagtcgcatcaacgaatgtaggctcagacaataacaacagccccagtctggccaccagcaaactcccgcacgactattagctaactgacggagctacgcgagaacttcctataacgcagccttgacccaactgcacatggagaaggaatcaccttgcggcagctgcacacgcactttacgtccgctctgacacgcgacgagctgtgggaagttcacgcaggcgccgttcctactcttggtccacaacgcacgcgtgcctccgcttctctgcacttcttgcgttctgaagcaaccacgcagagacgcaacaacacgcacacaagtattcacacactctgctactggctaccgccacggaagctcttctccacttcacttggcaactaaccatgctgcacgcgacggcctaatctctccgtgcacactaactcgtggaagcctgtcaaccttcacgcaagcgcgggtgaggataagaaccctctcgggcagcggatcttccccctcctaagagcaatactccgcgctgcacgcattgcttgccaaaccacacacgcacacaacactctctctgcacacacgccttctatcaagtgtacacgcaaactatagggctccaacacaacactggctattacgcaaaccgtcctgttttaccttgacacctgcgcccgcggcaacagcactcacccggaggcaaaccttaccgacgacacacttcctactgacggcccaggtctccctcttaaacaaacaccacttaccacggccttgcggaaactaccaagcggaacgtaccctcatcctatcgaacttcgcggaaaaaggaaaggccttttcaaggaaggctggcatagagcggtatacctaaccaccagattctgcccctctggcatgacttgacaactgcggttccactctgccacgagaacctaacctggccgcccagcacatagaagcggacaacccaccaaccacctatctcgtacatatcg

SEQ ID NO: 719908 - DNA, 165 bp, Homo sapiens
ctggcatccctgcaagtcgacctcgtaaagcatccccgtctggagcatgttagctattagttagctactgtcgtgactggtaggaccctgggcgtacaggactaggaagcagataaggaaaatgattatgagggcgtgatcatgaaaggtgataagctcttctat

SEQ ID NO: 719909 - DNA, 391 bp, Homo sapiens
caaaaatagttgttatagccagtctctgttattggtgtttatgaaatagattcatgatggagatacataggtggtggttgtcatctcgagagagtattcagttgaaggagaggccaattccagagtagacatttgctactgctgatgagactggtaacttttttagagattaatggtttccattttaacacatactaaaaagatacacactaaatgggaaataaatggttgacgtttaaaaaaaatttaatttgagtttttaattaatgaaacttttaataacccagagaagtgcagaaaagtatataacagatgtttgtgtgtgtagtcactctcagaattaaacagatgtgaatatttatataagcttccgatttttttcctttctctt

SEQ ID NO: 719910 - DNA, 393 bp, Homo sapiens
gtgttagcattcatcaggatcatctgaagagcttattagaaaacatatctggggccggctgcagtggctcatacctgtaaacccagcactttgggaggccaaggcgggtagatcaggaggtcaggagttcgagaccagcctgaccaacatggagaacccccgtctctactaaaaatacaaaaattagccgggcgtggtggcgcatgcctgtaatcccagcgctttgtaaggccgcggcgggcagatcacgaggtcaggagttccagaccagcctggccaacatggtgaaaccaagtctctactaataataaaaaacaattagccaggcatggtggcaggtgcctggaatcccagctactcagaagactgaggcagaagaatcccttgaaccca

SEQ ID NO: 719911 - DNA, 748 bp, Homo sapiens
  misc_feature (1)..(1): n is a, c, g, or t
  misc_feature (103)..(103): n is a, c, g, or t
  misc_feature (114)..(114): n is a, c, g, or t
  misc_feature (116)..(116): n is a, c, g, or t
  misc_feature (140)..(140): n is a, c, g, or t
  misc_feature (146)..(146): n is a, c, g, or t
  misc_feature (249)..(249): n is a, c, g, or t
  misc_feature (251)..(251): n is a, c, g, or t
  misc_feature (339)..(341): n is a, c, g, or t
  misc_feature (344)..(344): n is a, c, g, or t
  misc_feature (346)..(346): n is a, c, g, or t
  misc_feature (352)..(352): n is a, c, g, or t
  misc_feature (354)..(354): n is a, c, g, or t
  misc_feature (364)..(365): n is a, c, g, or t
  misc_feature (367)..(368): n is a, c, g, or t
  misc_feature (370)..(370): n is a, c, g, or t
  misc_feature (379)..(380): n is a, c, g, or t
  misc_feature (382)..(382): n is a, c, g, or t
  misc_feature (385)..(386): n is a, c, g, or t
  misc_feature (389)..(389): n is a, c, g, or t
  misc_feature (392)..(394): n is a, c, g, or t
  misc_feature (403)..(406): n is a, c, g, or t
  misc_feature (408)..(410): n is a, c, g, or t
  misc_feature (421)..(421): n is a, c, g, or t
  misc_feature (424)..(424): n is a, c, g, or t
  misc_feature (430)..(430): n is a, c, g, or t
  misc_feature (439)..(439): n is a, c, g, or t
  misc_feature (459)..(459): n is a, c, g, or t
  misc_feature (461)..(461): n is a, c, g, or t
  misc_feature (464)..(464): n is a, c, g, or t
  misc_feature (478)..(478): n is a, c, g, or t
  misc_feature (485)..(485): n is a, c, g, or t
  misc_feature (488)..(488): n is a, c, g, or t
  misc_feature (531)..(531): n is a, c, g, or t
  misc_feature (549)..(549): n is a, c, g, or t
  misc_feature (557)..(557): n is a, c, g, or t
  misc_feature (586)..(586): n is a, c, g, or t
  misc_feature (592)..(592): n is a, c, g, or t
  misc_feature (628)..(628): n is a, c, g, or t
  misc_feature (631)..(631): n is a, c, g, or t
  misc_feature (646)..(646): n is a, c, g, or t
  misc_feature (746)..(746): n is a, c, g, or t
naattcccgggattgaaacaagagggcggctgaagccgatcctgagtggggccccagcaattcggaatgagccttttccctccacccgcttctgccgaccggngccctcccgcncngcctcgcaggcctccccacccgcncccgtncctcctcctccgctttcccttctcccccgtcctcggctccgacattaggggcaggcggggcaggcagcccaagcagcctgcagcttccgctgcggaggctgcncnccggaacctgcaccggaactctgcaccggccccgccgccgccgccgcccaagtccggacccatcggggggctcagctcgcggcaccgnnncantnaggggnantttttttttnntnntngcctaggtnnangcnnccnccnnnccgtggctnnnntnnnccaggggggancancagtanccggaggangccgccgctggtcccccaancnccngcgcccgggtgganggggcgnggnggcgggggcggcggcggcggcggcggccccctggcccggcccnccgcggcccggagggtgnaaacaaantggtgtacgatgaccacgggagctaagangaagangacggcgacgtcgaggagacccaggagtctgagganaangaggagcatgagatngaggaggacgaggctgattccgattatctggaggagctggaagacgacgacgacgccagttactgcacagaaagcagcttcaggagccatagtacctacngc

SEQ ID NO: 719912 - DNA, 141 bp, Homo sapiens
catgttggcagtggagcaaatagaaagtcttagtgcaaggatcaggatattgaaggtggttcagtgttgttacaaaataaatgaggtaacatgtgtgctgactgtgactgtgtgtcagatgtgtcatagcgtgtgagtcat

SEQ ID NO: 719913 - DNA, 494 bp, Homo sapiens
  misc_feature (428)..(428): n is a, c, g, or t
aaatgtcctgctgctctgtgatatcttgcattcaagtcatcaattttgttaaggtccaatgttgtcatgaaccgcttttcatggcctttggctgcgaagcccatgttccgtaagacctccgtgttggtgtgcgagttcttccagcgcttcttcgctggaactcgatggtggaaagggtgccatccacctgagtgagctgcttctcaaacctcttctttcttttcaagtgcctgcaaggcagctcgcttgttctgggagccgtgcttcttggctaaggcgagctccctctggattcggttctccaggtactcttgcttcttggccagcatctcctccgtctcccggaggcgagccagggcttccttggccgttgggagccgcccgggcccgggaggagcgggtccctttaaagaacttacccaacttgntcatggctgagcagtggggacgagcgtcccagcgctctggagacaggtaagccacagtcggagccg

SEQ ID NO: 719914 - DNA, 885 bp, Homo sapiens
ggagtgactatatggatgccccccaccctaccacacatttcgaagaacccgtatacataaaatctagacatagaaaggaaggaattcggaaccccccaaagctggtttcaagccaaccccagtggtcctccagtgacttttccgaaatagaatcaagaagaatgaaataagatgtaaacaacaagctttggggggtgactgcgtgagccccgtagaaaaaatgtcttctaatagacaacctctggtggggtggggagagcggcgagggcttcctccaagaatgtgagttaacaggaaagtgtggggctcatggcgtgtatcttcggctaaggagaaactcggggtctatggactctaggggtaggtgggtattcttcccaccatttgttaaaaacatcgccgcgggggagactagccaagactggggttttcgcagaagataacttactcacagacatagagagagtggttccgagggagggtacacacgttaacagcgtgggggatgattactaactagggaggagctgccactcagaggagagatcgcttcgctatactttgacacgaaattttttgcccctccccggcgctcggggacgagtagaaaaatcaccaagagtacctgggaggttcgaccagcgtggaaacattcacaacgaccgcgtgatcaacagttctcccaggccaagtacagggagtggagccccttgaacgcggttggggcgaacgcagaattgcgggcattcagaaagcttcccaaggggaggttgtctggaagcacctatagcccgtggggggcaaaacaaaccgggcttgagcaatttgctcgaacaacccaaacaaaaggaatcacagccgggggcccatttgggtgaactgttg

SEQ ID NO: 719915 - DNA, 451 bp, Homo sapiens
  misc_feature (13)..(13): n is a, c, g, or t
  misc_feature (376)..(376): n is a, c, g, or t
  misc_feature (391)..(391): n is a, c, g, or t
  misc_feature (438)..(438): n is a, c, g, or t
taatttggaaaancatttttaattaagctgagcatgccttaaaaaaatccttttaactcccttactatctgactctagcagtgccaagtggccaatatttatggctttcaaactttattaaaggctcacagaagggaaaatccaaagtggttcgtggaggggaagagaattaacagatagcaaaggtcgcacagatatcaaaccagaaagcactcattccctaagctgggattgaacccagggccgccattgtaaaatggcagcaggctagaacaaaatattgccaggtggttgtaggtcttggtttcaaggacttaaaacaagatgggagggcctgcggaaaagtttgctaggggaccatatagaaagttcaggncaaaacacaccagantgggctatagttttaagggccaacctcacaaatcctttcttacattnaaaactctaccgt

SEQ ID NO: 719916 - DNA, 788 bp, Homo sapiens
cacggggtaggatagagagagcgcgtagaagagagaggatgtctctctcagactggcacctggcggtgaagctggcctcgtagccaggccacttactccatcagtctattcttcggtctgccagagacagaactgggagtagatactcgctagggggctatagtactttcattttcttgaagcaggttatctgctggccacaagctccaggaggtctggttcgcagacacctgcagtctgagtatgactctgatctacgtgtggtcggaagctaaaagatgaccgagacacttgacttcgtatggccattcaacactgggtccactgtccatgttctgcgaaatgtcctggtccttgaagcctgaagtacatgcaaatcgcggaaccgtgtgggatcacaatgtgtgcgtgctcactgtatgagagttcccgggttgttgcgcatctggactcctgcagcaggcagacatcctgcttacatgggatggcggtctttaagatgctacagtcaactaaggagtctctggatcagatcattgtggccaccccgagtgctctcagtcgagtgaccctatcgctcttggggttctccagtgacaagggacctcttctctgtcttcgctgatcccaatatgcttgaatacgttggtgcctgctctacccaagcctcgtcatgccgttgtcctggttctgcactccgtacaggcgtgcccatgcctgggactgatcctcttcccgggatgcctccagctcatccggggttgcccgtggctctgttgaagggccca

SEQ ID NO: 719917 - DNA, 491 bp, Homo sapiens
  misc_feature (2)..(2): n is a, c, g, or t
  misc_feature (208)..(208): n is a, c, g, or t
  misc_feature (218)..(218): n is a, c, g, or t
  misc_feature (291)..(291): n is a, c, g, or t
  misc_feature (298)..(298): n is a, c, g, or t
  misc_feature (353)..(353): n is a, c, g, or t
  misc_feature (358)..(358): n is a, c, g, or t
  misc_feature (376)..(376): n is a, c, g, or t
  misc_feature (421)..(421): n is a, c, g, or t
  misc_feature (472)..(472): n is a, c, g, or t
gnaattcggcacgaggccactccataccactccactccattccactccactccattccatttcactccaatccattccattccactgacgtccattccattccactccagtcaattccactccactcacgtccattccactccatttcactccactccactccactgcattctactcccttccactccataccattccattccactcnactcatctcnactcccctccactccactccattccactccattccattctgcacctttctactccattccactccactccacnccactcnactccactcaactccattccattccattccatttcattccatgacaatccccacnaatcnattccacttccactacantccaatccaagccattccactcccactacactaaattccattaanattccgattctaaatccatttcattccattgctttctttcggaaggatctnactgtggtaacccagtaat

SEQ ID NO: 719918 - DNA, 362 bp, Homo sapiens
ctctggaattacaaaagtcgtattttaaatcttctaacagatgaagaagtaaatattgatttgccaacacagtccattgttccaagaacttttgagcttaaaccaggaatggttctgattttgggtgctataggccgtatagatttcctgcagggtcagtcagcttggtttacagacttggcttccaacatcctcactgtgcatatcacctacttggacagggcagacgctttgtatcagaagcatgcaggttatacgatacttcagattctaatgggtacagatggactgggtgcatctgaagcaagtgccgacatgaaggttgcctgtgcatgttgaggttcagtaacacctaattttgg

SEQ ID NO: 719919 - DNA, 97 bp, Homo sapiens
cttctttcacaggtcttggcctgttgtccaggcaagagtgcagtggcatgatcatggttcattgcagcctcgaacatcctaggctcacacaatcttc

SEQ ID NO: 719920 - DNA, 215 bp, Homo sapiens
gacaaagttggcaaggaaacctggctgcccagaagccacagcctgcttcaaccgtctggatcttccaccctacaagagctacgaagcaggtgagagagaagctgctgtatgccattgaggagaccgagggcttggacacggagtagaccgaggcctgccctcccacgctccccagcgctacattgtagtcctgagtcctcccgtgcctgagaggc

SEQ ID NO: 719921 - DNA, 669 bp, Homo sapiens
caggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaacaacttttttatccttctatatggctttcacgcaagctatgaaccagctttctttcttacttacttgtgacgatcactctttgcttttataacactagcttgttgacctgcttaactatggacctgctagcaacttctggactcacctttcaacttgaagctcagggtacttgtgcataatagaaacgtattggactgacgactactttgcgttaccatgggaggccacatgccttcttctctcactccttattaaactgtgactgtgacttctctcttcctcttgctacacgaacgacgctactgtactctcctttgaatagccctactcccaagtaacgcagcaaatctgtatgataacattttttcctctggacattaagacataacagtaacacgatgtacatttacaagcggccttatgtacatttcccaacaatccttttctaagcgcaacacttgtgaccatatgtgtataattcaacaatcgttctttaactccctt

SEQ ID NO: 719922 - DNA, 300 bp, Homo sapiens
  misc_feature (83)..(83): n is a, c, g, or t
gttaccgcttttcccctttcaaccccatttgtggcctttgtccagggccccagattaaccatgggttcccccctgcatccccnccgtggggtgttggcctcccccttgcagcaactgggcagtgattttaaaaggccccccgtcccccaagctatgtggcaatgaaaagccaacttttttgtgcccgattgttttggcataggcatgataaatggggattgggacgtttttaatcagcctttgccaaaaaattgtcttgaattttaaaataaacccccaaaatttgttccttgggggcca

SEQ ID NO: 719923 - DNA, 285 bp, Homo sapiens
  misc_feature (8)..(10): n is a, c, g, or t
  misc_feature (80)..(80): n is a, c, g, or t
  misc_feature (169)..(169): n is a, c, g, or t
  misc_feature (178)..(178): n is a, c, g, or t
  misc_feature (193)..(193): n is a, c, g, or t
  misc_feature (195)..(195): n is a, c, g, or t
aaagaatnnnacattccagactattcagtatcatcatcccaggaatctagtaacattccatggggacttctacagcactntcttagtatagaacactcttgaatccacatgtacactgatttatcttgtcctttgttgagtagtcagcccattagcattattctggtcnaaatccatnaacacaggaaaactncnagacatattttctagttcttgaatatctcccaatagtttttcttctctgtataggtcatttgtagttgtctgtccacaggattatttata

SEQ ID NO: 719924 - DNA, 372 bp, Homo sapiens
cgttgtcccggatccccttcgacacgtgtgtggccttcattctctcataccgattgctggtcgaaccacaccattgctggatgctgttccccagctgcacgatgatgcagtcgccagttctgaagctctcacatgacacagattcttcgttggcacggaccacacgccgccctttgacttggatgagtgtctgcaccaccacgtacttgggtatctcgttcgtgaatcttgctgacacacgtccgtttttgtaatgcaggccagacttgaagtggctgaggaaggtggccgtctcgaagctatgggcctcatgttggtccacggcccggccgttgagctactctgccacatgcacggtgaagttggcggccg

SEQ ID NO: 719925 - DNA, 147 bp, Homo sapiens
cgctctcaccacccctctgcacagccatggacagtcacacactcggtgcagttgggccgtagcggcccagtcacaacctcacaggcgttccatggaagccctcgtggcagtgcactcccccgttgccaggaacctgtccttggactg

SEQ ID NO: 719926 - DNA, 432 bp, Homo sapiens
tccggcttgggatggacctccctacccatgtgatggatccctggtctttcctatagtttgagcaacagttgaccaaaaggttatggtcttcagcgttttacttagatccacgactagatacttgggtctgtattcttcaaagtgtggggctgcctattctcccaggaaccaaatggcctccgtcttaagaaagtatgcttactaggaaataccctgcctaccttaggaataaatgctacttaaggaaaaaataagagagctgaaaaagctggtgccatttgaaaaaaaagggaaggaatgagatttaactggtgctcaaagcttctccgatacaaaatatttggtcatgtattcataatttgcttgacatttccagcaaagcgaagatggcaataacaaaaggaacttcttacaagagaagagaaagaccca

SEQ ID NO: 719927 - DNA, 149 bp, Homo sapiens
ccttctacgtctcatcactgacagtgtcctgtcaggcctgatgaagacactttgaatttattgcagggaccaaggtaacagtcagaagccttggatttcagccgctcctcttatgctgcctacctcggccagtgatgagacgtagaagg

SEQ ID NO: 719928 - DNA, 284 bp, Homo sapiens
aaggggtgagagaagtaagttactatagtgatgagaagactgcagctaggaatcaacgatacgttcacatagagactctaagagaagcctgcaaactagggaagggaagaaagtctgagcggagagaagagcagccccacggcattgagtgacatgaagaaaggggttgctcatggaactttcaggatctctaagccagggctcctagaagcaaactgaataactaagtactggcacctatgacacaaaccccttctaacgctccttagctctcgcttatttaa

SEQ ID NO: 719929 - DNA, 513 bp, Homo sapiens
cgcatgtgtctacgtttactgtgttcaggagaatacaggcatgggatcatttcggtggctggaagtatatgccaggcaagggagataaggtatacgacaagactgatgtgttcatgtacctctcatgaggtggtcagagaccttcatgtcttcaaagactagtcagcacatgaagtggtttagtgtagagataagatgggttgtgtagggataattgaagctaggcatggagtacatgtggttttggctgtcgcacacatacttgtttcagagtatccatggctcacagtggcatggtagaaatgaagctgtgagccttctcgctttacatctgatgtaagatactcctgttaccaaatagtacgtctggtttagttagcccttggatcaaatcctagcttaacatggtataggatcttgggaaaaacaattggttgggttgcccactttccgtaggatcaagagcagaacctttcccttggcacagaagaacccaggttgcgctgcatacct

SEQ ID NO: 719930 - DNA, 111 bp, Homo sapiens
ttaactggaggtgacttcttccgtggctgagacttctgtctctcctgggccctctgagggatcttcctccggcctctctggtggcgctggacccagccactcaactcgtca

SEQ ID NO: 719931 - DNA, 231 bp, Homo sapiens
gcagtcacatgacccgaatgcccgccttaacctcccaggctttaaaactcttaaagggcagagaggcggtcagcgcaaggtggttaaaggaccctacctattttactggggagaaaaaaaaaagtcttgttgcagcccgtgttccctctcacttcctgtcaggataggaagtgatgggaaatctttccaatggtgtcacagggattctgttatttccctaatcaaaaacca

SEQ ID NO: 719932 - DNA, 619 bp, Homo sapiens
tcaccgctttatactggagatgctaagcgtgaagaaataaactatggaaaagtctaagttcagtggtctattaaattaatatgagagtcaagtatttatgcttgagatgaaaaaatgtcaccagactaaattttgagtcccattgctaaaacagagatggatagtagtaacgtggggctcttttcaactgaaggaaatgtataaaatatttaaaaagaaaactggctgatgcctttaacctttcagctttaataatccttatccttttaggcttgagtgatagcaattataacttaagaggaactggtaccttcaaattacaataagaaatcatcttgcaaaagagagagaaagtcggtgtattggtgatttcttagcgggtaataatggcaatccacttttccaccctcagtttctcttctgaccggcaactctttccccataatatgctgcacaaggcaatggaatgaccacttcattcctgtgaggttttgcctctactagagatcgtgacatccctcagaacagcattgcttcctccagtcctccttggtaccagcagtgcactacagagtatcaattagctacatggtattcatttcctccaagatcaggctct

SEQ ID NO: 719933 - DNA, 665 bp, Homo sapiens
aaatgaagtaccaggctgcagtaataggattttgtccataataagggatatgatattcattccagtgtgggataggacacatgtacaatagtagggcttatatctgaaagctacactttaagtgaagagtaaatgaaaagatagatatgtcaatgaggagggtaatccctagtgagaaccttatgaagtgaatcgagagtgacttattgtggagcaaggaagtagattgacaggaatgagtggaggagggaaggggacagtatgttttcaggtaatgcatgggctgttaatgagttgttctacacgggtagaattagatccaggataccaccagacttttgttgatctctgagaagctaagatattgctcttaactgcagttaccagtgatcaaaattaggaaacttaaccatgtaagtaccgattatgctaattatacagtgccacaagtcaaatggtgtccaatgatcctaataattatttatcatagcttgttcacaaatcgaagatcatacatggcattatgattgtcatgtcatctccagtctccgttctaatctggaacagttagtcaacattgtgacacctcaaacaaatgcagatacgggaagaccgggagtcgcaccggggtacccacagactgggaatggcagagggccgggaca

SEQ ID NO: 719934 - DNA, 104 bp, Homo sapiens
gcctctgcggcattgtggggcgtactggcggacacctgtggggtgtactggaccgaccacctggaggggcatctggacggacccttgacggcctactggacgga

SEQ ID NO: 719935 - DNA, 287 bp, Homo sapiens
caagagaatacaattcctagtgaatacagtatggagggatgtgaaggacctcttcatggagaactataaagcactgctcaaggaaatgaaggaggacacaaacaaatggaccaatgattgcgagtctcatggataggaataatcagtatcacgaaaatggccattactggcgaaggtaataaagagattcactgctctgcccatcagagaactagttgacactttacagtagaagtagaaatagctacttgaaagttaatatgagagtcgaatcttggcagtcgggc

SEQ ID NO: 719936 - DNA, 591 bp, Homo sapiens
  misc_feature (38)..(38): n is a, c, g, or t
  misc_feature (76)..(76): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (109)..(109): n is a, c, g, or t
  misc_feature (156)..(156): n is a, c, g, or t
  misc_feature (158)..(158): n is a, c, g, or t
  misc_feature (165)..(165): n is a, c, g, or t
  misc_feature (167)..(167): n is a, c, g, or t
  misc_feature (169)..(170): n is a, c, g, or t
  misc_feature (182)..(182): n is a, c, g, or t
  misc_feature (184)..(184): n is a, c, g, or t
  misc_feature (198)..(199): n is a, c, g, or t
  misc_feature (231)..(231): n is a, c, g, or t
  misc_feature (252)..(252): n is a, c, g, or t
  misc_feature (256)..(256): n is a, c, g, or t
  misc_feature (263)..(263): n is a, c, g, or t
  misc_feature (268)..(268): n is a, c, g, or t
  misc_feature (277)..(277): n is a, c, g, or t
  misc_feature (288)..(288): n is a, c, g, or t
  misc_feature (290)..(290): n is a, c, g, or t
  misc_feature (297)..(297): n is a, c, g, or t
  misc_feature (324)..(324): n is a, c, g, or t
  misc_feature (339)..(339): n is a, c, g, or t
  misc_feature (343)..(343): n is a, c, g, or t
  misc_feature (345)..(345): n is a, c, g, or t
  misc_feature (372)..(373): n is a, c, g, or t
  misc_feature (388)..(388): n is a, c, g, or t
  misc_feature (401)..(401): n is a, c, g, or t
  misc_feature (403)..(403): n is a, c, g, or t
  misc_feature (417)..(417): n is a, c, g, or t
  misc_feature (420)..(420): n is a, c, g, or t
  misc_feature (428)..(428): n is a, c, g, or t
  misc_feature (434)..(434): n is a, c, g, or t
  misc_feature (457)..(457): n is a, c, g, or t
  misc_feature (525)..(525): n is a, c, g, or t
  misc_feature (533)..(533): n is a, c, g, or t
gaggggagttataagacagagggagtggggtgacgctntgggtcagggtggtgcccacccagacccctgtgctggnagctgcggtgaattttcagagntntnttttttntcaggtgagcagcctctgaccaccacggctgcagaggtctccgggantncccttcntntnntccccagagggntncgcaggggtggatnntgcacaaaagaggccaaagcgctcgatttttnaggaaggaggaaaagcactanttanaaaaaantattnaaaatgcantcgcccagctntnagcttcnttgtcactccttaccagggacagagtntgaggagaaagccgntttnantgagacgccgctccccagcgggcaggnnaagggggcccccttnagacacccccgantntttatttggaaggntgntttttttngggttntgccaccacagcttccacaagtngaggggcggccgagctgttgtgcagcagagtgtgagctggcctgccactcggggcagcagcgcctttncggaaggnttctggcctctgtccatgttctggccggggtagaaatagggacatgatttcaagtgaa

SEQ ID NO: 719937 - DNA, 148 bp, Homo sapiens
gcaagagatagcgtgcaacagccaccctggcgccaaggaggatagctcagccccagcaactacagtcgggatgccaaggccagccagatgtcagggcccagcagggtcaaccttgaacatggctccacaaccaggagtgggccaggta

SEQ ID NO: 719938 - DNA, 433 bp, Homo sapiens
agataaaatttgaaatctggttaggctggtgttagggtaggggctaggctggagtggtaaaaggctcagaaaaatcctgcggaagcaaaacaattctctgaggtaataacataggattatcccgatatcgaaggcctaccaggacaggtgccgcagtgcggcgcacacggcacgtgacacaacggccacgtaacaagagcgcgcgactgacgaccagacacgacagacgggagaacgcgagggagagtaacagaaagcgacaaataaagcaaacggagacgagacggcagaaggaagagcacaggagagacagaggaaaacactagcggaccgggaccaacacgaaagaaaagaaacacgaacagagcaaaaacgcacgaaaagcgacgaagacaaacgacaaagcagccccagccacacgacacaaaaaaca

SEQ ID NO: 719939 - DNA, 373 bp, Homo sapiens
  misc_feature (337)..(338): n is a, c, g, or t
  misc_feature (363)..(363): n is a, c, g, or t
gactggagaaataggaacacttttacactgttggtgggactggaaactagttcaaccattgtggaagtcggtgtggcgattcctcagggatctagaaccaggaattaccatttgacccagccatcccattactggggtatatacccaaagggattataaatccaggcttccaataaagacacctggcacaggtatggtttaatccgggaactaatccccaataggcaagacattgggaccaaccgaaccaattgattggttgtggataaggaaaaagtcgtggcacatattatcaccatgggaatgagtattgcatgcacataaaaaatgggatganngttcatgtccatttgtaagggacantggatggaag

SEQ ID NO: 719940 - DNA, 200 bp, Homo sapiens
aaatttttttttttgtttgtttgttttaaaccagcccgggggggggggcccggagctccccccccctattgggggttttgggaaagccagccctcttgaatttgggaattgggttttttttataaaggggaaacccagtttttttttttcccatgcggcccgggccccatttgttttttaataaaaccgttttccttcca

SEQ ID NO: 719941 - DNA, 273 bp, Homo sapiens
gtttcttccagtacatccaagtttaaaattattagcgaaatggtccatgttttttcaattactgctgacacgattctaagctaagtgaaggggaagatctgagagcatgctgtttggactgttgatgcatattcatgatgtaacaggtcctgggcctcactttaccccattcgtaaaatggggataatgtcacctgcctcttacctacctcagagggatttgcgaagcaaactgttaatcttcgaaaacgaccatttacttttaggatatcaa

SEQ ID NO: 719942 - DNA, 460 bp, Homo sapiens
gtcaatactccttaatcaactcccctttatatatacatctatccgttagttcggtcccattgagaaccctgactaatacagtaactactggtgagtcttccaactgttctctgtcctgtgttctgcatatgtaaactagggaataatgatgcttctgtcgttatgataataaccattgtgaaaatcaaaataaatcatgtccatcaaatgctaatggaaaatctgagcacataataggttctcaggcagcatttcccccttctacttttccctccattcttctcagtctaattatttattaaattgtgactctattcttcatggatcaaagaggataatgtaataggtaaaggcttgtgaaattactgtgtttatcaaacaaaaccaatcgaatatgcatgctaccacacaattcaacatgatatataaaagtgctttggaaagtgaaaaaaaagaaaaa

SEQ ID NO: 719943 - DNA, 804 bp, Homo sapiens
  misc_feature (1)..(1): n is a, c, g, or t
ntcgttcgaccgctctcctcgtcgccgcggggaggttggtggccctcccgcccctccgctcgttctgtctgttggtcggtcaggcagcacccgaccacgttcggtgctccctttttttgggcgccccgccccccacacttacgctccacaccagagggcgccaactttttttgatatcgcgcctctctctcctcgcacacacaggagcagcttgtcgcaccccaccccccactcatacacacgttgtttttgtatctgtttcccccctccgtactagttgctccctctctcgcgtcgtacacactccccttcttttcctccccccctctgcggagtatagaagaggggggctccaccacaccaggtggtgttcgcacaccctctttttctgtgtgaaattggggggaccccccgccgccccatacgattgggacgcaccccgctggttctctccccacactactgtggtttgttcttctgtggatctgctgtgggtaatattatttataaatattgtggtgaatcctctcccccacttctctcccacgcgtgcgtgtgagagagatttttttcgcacagcgcagagtatctctcctccccacaaacccttctttgtgagagaattatgtgcccaagcaatagccccctcccccgcccggtattatgtgtgggttctctctcacccccccaccacgcgcgtggagttgtatgtgtgggggcgtcccttcttttgtttccccccccccccacaaaaaccctctttttttttcccacacaaaaaacccccacaatttttctggggga

SEQ ID NO: 719944 - DNA, 848 bp, Homo sapiens
ttccgtgcgtagagacagacttcccgactctatgcgtgaggagatagggacacctggagaagagaatcacaccacacataccagtcttgacctaatgggctcaatatgcgatttctaggcatgatcgagggcagtggacacataaactttggtgatagcgtcagagacaaagacccaaagcttcccaacactgtgacccctggcactgatctctgcccatcgcccgatgaataaaacaggccctcctgatgctcggatcacatatacgacctcgtctacaccactaggcacatgcagcaactgcataattctggacgccagcccataactgatctcaaacccaatactctagtcgtaatatacctcacagaaatgcctgccattctcttgcacctacatctgggttagacatgctattaccatgttagcaattccaacagaccctgaggaaagaccctgctaccaactgctgtttgcgccaacgaggcccgaagaggcgacgcctgccactgaaattgggggtcttagactacttatgagactggcattctgcctgattacccccccccttatccaccgttctccttggggcctagggcaaggtaagaccttaccaaaccatcagtggcaaattcttcctgaaacatccgggacctttaaaaggaattgaatgcttgagaagcttcccgaaatcactaaatctttctatcccaaccatgcctatattctcaaccacccgcgggtatcgtcgctttttggaggatgtcaacgggtccctcccgccccatcctccgctttagaacctcggcaaagtggggaaataacaagctccgcccccaccctcagag

SEQ ID NO: 719945 - DNA, 219 bp, Homo sapiens
cgcccgaactgcaccatattaccgggcgtgctacttcgcgcgtgtacgatacggccaagggcatgctcactcgaccccaagaacacgctacatcgtggtgagctggatgatcgcgcagaccgtgacggccgtggccggcgtggtgtcctaccccttcgacatggtgcggcggtgcatgatgatgcagtcggggcgcctaaggagctcacatcatgtaca

SEQ ID NO: 719946 - DNA, 368 bp, Homo sapiens
gggctcacagcttctcaagtttccgggattacaggtgtgtgccaccaagcccaggtatttttgtatttttactagagatggggtttcgccatgttggccaggctggtcctaaactcctgacctcaagcgatccgcccacctcggctcccaaagtgctgggattataggcatgagccactgcacccggcctgtgtatcattttttatagtagtctatgatcctttgtatttctgtggtatcagctgtaatgtctccctctttcatttctgattttaagcatttcctctttttttattaatctaactaaaggcttaccaattttccgttgttgttttttttggttttggttttttggagacagagtctct

SEQ ID NO: 719947 - DNA, 358 bp, Homo sapiens
gtgctcttggtggcactcggtcgagagccatctgggggttctggcgcccaagaacgtctagcagaaagacgcccagattgagcgcacctacgtggacgaggtcaacagcgagctggtcaacatctacaccttcaaccatactgtgacccgcaacaggacagagggcgtgcgtgggtttgtgaacgccctgaacaagcagaagggggcgccgcagctgttcgtggcccgcccgaaggaggctgaggtgtccttacaggtgcccctaatccttggagggatgattaacccaatttcctctaccacaaaggggaacaaaccctttttcagacccccaccaagaatgcgttcaagatgcaac

SEQ ID NO: 719948 - DNA, 462 bp, Homo sapiens
atcccagattacttatggtgatgggtgtggcgtgtggatcacgaggtcaggatggattgagatcatgctggctaactcggtgaaagccccgtctctattaggaatacgaaataattagtcagcgtcgtgtatgaggccgtggagtgctctgataatccccatgacatcacggcgggagcactgatggacacggagaatggcatgaaccccccggtggatgggagacgccttgacaagtggtagtccacggatctgtaccaactgctacttccagcctgggtgtagggatcaagactctgtactcagattatagaataacatacatatgataatgggttatgaacttcacgctaggttgttctacttatgtcccttgctacttcctcagactggtacgcaccaaggtgagactaactctatacactcacgactgactctcttccatacacaccataacaaatg

SEQ ID NO: 719949 - DNA, 1088 bp, Homo sapiens
  misc_feature (14)..(14): n is a, c, g, or t
  misc_feature (131)..(131): n is a, c, g, or t
  misc_feature (158)..(158): n is a, c, g, or t
  misc_feature (280)..(280): n is a, c, g, or t
  misc_feature (396)..(396): n is a, c, g, or t
  misc_feature (549)..(549): n is a, c, g, or t
  misc_feature (605)..(605): n is a, c, g, or t
  misc_feature (610)..(610): n is a, c, g, or t
  misc_feature (645)..(645): n is a, c, g, or t
  misc_feature (685)..(685): n is a, c, g, or t
  misc_feature (708)..(708): n is a, c, g, or t
  misc_feature (744)..(744): n is a, c, g, or t
  misc_feature (749)..(749): n is a, c, g, or t
  misc_feature (751)..(751): n is a, c, g, or t
  misc_feature (761)..(761): n is a, c, g, or t
  misc_feature (782)..(782): n is a, c, g, or t
  misc_feature (784)..(784): n is a, c, g, or t
  misc_feature (795)..(795): n is a, c, g, or t
  misc_feature (824)..(824): n is a, c, g, or t
  misc_feature (867)..(867): n is a, c, g, or t
  misc_feature (884)..(884): n is a, c, g, or t
  misc_feature (899)..(899): n is a, c, g, or t
  misc_feature (904)..(904): n is a, c, g, or t
  misc_feature (927)..(927): n is a, c, g, or t
  misc_feature (929)..(929): n is a, c, g, or t
  misc_feature (1017)..(1017): n is a, c, g, or t
  misc_feature (1034)..(1034): n is a, c, g, or t
ggtacacatgagcngtggctgcattccacacagaagccgacacacctcgcaggaatgccccacaaaacagagcgcaaacaaatcacccagcaggcccgcttcacctggctgtcaccgccgaactccctacncctaagagcacagaagagaacatcgcnttgaatctacagacaagcgagggtggggcgagcggcagccagggctgccgggatgggagcggccacagacacaggcccccgggtgtctgtctcgagacacaggtggagaagccgcccaaganattccagccagacgggagcggccgggggatgccccagcacagtagcctgcctacaggactcccctggctccctcagtcctggcagactctggcatgacaccaaggccagccgtccnggctctcggccctgtcactgtgtctgtctcatcccggggccccacagcccccctcccgggcaggagccccgcccctcccctctccatcaccccctcggcccccagccaacccacagcgagacccacacaggtctcgcccagctcttaaatgtnttgccctcaaaggcctggagattgaaggcagtttccagaaacttcttcagttacancaggngagttttcctgtttcctgtggctggtgcagccgcnggggtcccggccaacaaaccaaaagggccgtgcgcgcctnaggatggtcatgaagcgtgggcngatgttgttatagtagcccatgttcttgttctcctnctganancaggacagcnccgcacctgggttcttctctncnttctgcttgancaggtcgaaggggaatggagaaaactgcnccaggcgcgttaaggccactttctcctccaggtcctggctgcnccgctccttcaccaggncaaagtacacctttnccgtncagaagatgagccgctgcacctncncaggggcccgttctgcggccccatcttcaggaattacccgctggaagctggtcccggataccatttggtcaaagctggacttggcctnttggttctttaacaganaattaggtgttaagaaaaatagcggcttgcgggagggcagccggtcctcccggc

SEQ ID NO: 719950 - DNA, 306 bp, Homo sapiens
tggcctgatccatacagaaatcgtagttgcttagatatgcttatgttttcatccaatattgtgggggtgtgcgtgtgtgtgcgcactgtatgtgagcaggtgggtgctaagcgtgtgcaaggtgtgtgctgcgtgttggtgtgctgtgagctgtgttcatgtatttgctgcgcatgagtgtgctgtgctggagtgtgcatgtgtgtgctgtgtgtttgtagttgttgatcaagggccaaggagcacgcggacatgggaacacggacggggctcacaccatgacaacatcggagaatcttagcggga

SEQ ID NO: 719951 - DNA, 1579 bp, Homo sapiens
cccgatatgtgcccgaaggaacccgaagggagaccccgacctcattccatcacgccagagctccagaaacccgaacatccttatcacagagcccgtcatgatacccacattcgggtccaaagctatataaggcatccatcacttgattcctgagacccgcaaggccgcgccaccattcacgatacatcgagcgctcgagaatcccagatgatggaccatggaacctcgacaatcccgatatgccagagcatcgacgactcatcaggatctctgacataccggggaccttacttccacatgccacgacccacgggtggaccacatgaaaacaagtgggcacttctatcccacaggacctgcatcctgccgcaagcacctgtgccggcgagcccgccaccagccaccggcagccaagcgcagagcacagcccgcagcgagcagccgccgcctccgcgcgcccgcgccgcagcagcgccgatcgcggccgcgcaacccagcccgcgcccgcccaccagcccgcgacgcccgcgccccaagcgccacacgcgccacagccccctcaccctgcacccgcgccagcccagccccacccaccaccaccaccccaccggctcgcccccctggccacacccacacgcgccaccccccaccccccaactgcgccccccccccccctccccgtcgctcccccaacacagcccaccacaccggccgcccaactcacacccccccaccaccacgcacacccacccgcccgcccacccccaacgccgccgcccccgccacacccacccacacagcgccgcagacacgccccacgcccccgcctccgccacaccaccccccagccccccccaccccacccccccagccccccgccccgccaccactacgccagcgaccgcccccacccaacccaacacccaacacacgctaccacgcccccatagcccagcccccacacgcagactccgcaacccccgacatccacaccgcatcccaagacggacgcaacacccgacagccgccagccgacgacccccccccaatacacaccaacagaccggacgaccccacaaccccaccacaaagcaccacccacatcgcgccacacacaccgaccacccacaggccacagcacacaggacccccaccggccccacccctccccaccccctcactcccgcccaccccggaccaaccccaccacccagcacggcccgcgccccccacgacccccatcgcacgggccccccccgcctgccccacccacacgccccccaacaccaccaccacaacacacagccacacaccaccccagcacccacaacccacggccaccgcaccgccaaccaccgcacccacacccccaccggacgccgcacccgcctcgcgcaccccagatcgaaaccgcccccaccgacacccctcgccagcgccgggcacgccacacagcgaccacgcaacacacgtgcaccccacagccgacatcccaccccacggagcgcccccacccccgcgcgagcacaccacacgcacagacagccgacccaccacagccacgcgcaccacaacatcc

SEQ ID NO: 719952 - DNA, 508 bp, Homo sapiens
tcgcgaatgtgttcacagatgcaaagatggatccgaacagagggcagatccatgatctggtgatctcttgattgccaggctgtgctcttcgaacataagtggatatgtgagattcacacattcgagtagtattttatgcatcctcatttgatggggctgtaggcatgagttgttagaacaggttaaattgacatgacctttgccttgtgctggtttgttgtctagctctggtttgtaatcatgcttctggttgattactgcgcgagaaactattttttttttttcctgggtattgtctattcagcctatgccaagtccttcacacttagagggaaataaaccacagctacagtgcaccttagccctactttcctacttaaatgttacaatgttcctctttctctgcaacagtaatgagatttgccagtgacttgacgggaaaacacaccggattctgggactttggattttcctgctctttcgaggagaatcggtggataactctaga

SEQ ID NO: 719953 - DNA, 370 bp, Homo sapiens
  misc_feature (1)..(1): n is a, c, g, or t
ntggtgcacaggagggacaataacggagtgagccaggagcaagactgtccacagaagcctggtgcctggctaggggcctcagcgaatgtctggggcagagactctggccagttcctttccattcccctaggaaggttacccttgcatttcagactcccacctttgcaaggatgactccaagcactggagctggtttcgggtgccagagaagagcttcttgcgcagtggcggctgagtggccccgacccgtgctcggaatgggacggatgacgttgccgaggtgaagtcgcgcccgagtcgcgaaatatctatagttctcggtcactattctggccgagactctagcacagggagtcgccctgtcgtcgga

SEQ ID NO: 719954 - DNA, 253 bp, Homo sapiens
gtatatttagtagagacagggttcaccatgttggccaggctgtctcgaactcctgatctcaagtgatctgcctgcctcggcctcccaaagtactgggattacaggcatgagccatcgcgcctggacagtttttgactttttggagagatggggtttcaccatgttgtccatactgctctcaaattcttgggcttaagcagtctgtcgtgcttggcatcccaaagtgctgggataattggcgtgagccatcaca

SEQ ID NO: 719955 - DNA, 722 bp, Homo sapiens
gttgtggctggctgaatggcaatagatgtctaaggtggattcagtgtctggcacactaagacacctccaagaaggagatgatgcatcaggttcagtttaacctggaatatctgactaccccgtgaatccacccagaaagggggcccaacacccttgtccatttatgggtatttttttcgaagttattaagcatattccttttccacgaacctcttctgtactctgatgtaataggtgggctcttacaccccattccaaatgcagtttatctttctagacccgattgcaaatagtgatgtagtctctaaccagtcatggattccagttcagggatgaactgctccctccagccttacgtgcctctgatccacagggtttggtcacgttcgtctccggccttcggttctaagtcgagatataaaaactgaacacgatcaacacttactcttaacatcaagcatcaacactttttctccccgtgttagaacttcttctgcatcctccggtgtctcgtaacagataacgccttaagaccacctatgtgggggactactaggaaacctatgttgtgtcccaccggtacatcccctgtaaactttaactcacttacaaaacggctttttccccgccttttgggcgcttacgggcatctcctgaaaagccacattggtgtcattcacttgggctttgtgcttatcaggcaaaatcggtttctgggctcc

SEQ ID NO: 719956 - DNA, 732 bp, Homo sapiens
  misc_feature (392)..(393): n is a, c, g, or t
cgtttctccctcggtgcgggggtgtgtgggcccacttcgtctttcatagtgttacctcctccctccgcttgcggggggcgggggtggtggggtttcatcaatagcgcttttgtcccctgccttggtgggccgcctcccctttttttttctcctataaacccgggtgcggcctcctcggtgtttttttgcggcgggggggggaacttttttcccggaacactattccctttggcctttttggggctcttaagaccggttgttcaaaaacggggggggcggggcggatttccgggtatttttcccccgcgggcttggtgtttttctaaagggccaacccccttccccgttgggggggggggcttttaccccgccgtgggttcaacccccacccnnattggggggggtgtccccacgggccccccccctaattttggggtttttggggggaaatttttgttgtttttttaagcaaaaagttttttgtcccaaggggggggggaaccccccggggggcctcccggcccccccccccccttttttaaggggaccccttttgggggggttttttccccggggggcccacttttttccaagcccgggggcccttttttttttccccccccggaggccccggttttacccttttttttggggggggttgggggcccccctcccctttccccctctttttttcccccgggggcctttagggggcgggggtttcccggggga

SEQ ID NO: 719957 - DNA, 365 bp, Homo sapiens
  misc_feature (90)..(90): n is a, c, g, or t
  misc_feature (125)..(125): n is a, c, g, or t
  misc_feature (143)..(143): n is a, c, g, or t
  misc_feature (157)..(157): n is a, c, g, or t
  misc_feature (183)..(183): n is a, c, g, or t
agccagttcctgccttaactgatgacattcccacccattgtgatttgttcctgccccaccctaactgatcaattgaccttgtgacaatanaccttccccacccttgagaaggtgctttgtaatantctccccactcaccccangcccgcacccccgnacccttaagaaggtattttgtaatantctctccgccattgagaatgtgctttgtaagatccaccccctgcccacaaaaaattgctcctaactccaccgcctatcccaaacctacaagaactaatgataatcccaccaccctttgctgactctttttggactcagcccacctgcacccaggtgattaaaaagctttattgttcacacaa

SEQ ID NO: 719958 - DNA, 320 bp, Homo sapiens
gctcgcgcgcgaaaatacggctcatgttaatgagttacattatcagccagcccagccttgcccaccatttaaggatatcacagagccactagatctcatatggatctccttccaagccattatttactcaagaaactctagagagaaagtgagagtcatgttgaagaagatgtagaatgtgtcagacatcagagatgatatgagagatctgatatttaaatagtgacatcatccagcgaaatgaatctacattaaatgttgttttactgccctatgattaagccattcatatggagttgtcttcaactactattctgtat

SEQ ID NO: 719959 - DNA, 172 bp, Homo sapiens
tcgccagccatcaggatgctggggaactctttcttcattgccttgttcttgatggggatcagtcgcttctgatgggcacctggagagaggctgatgtgcaaatttggtctggaactcacattacatagctctgcaggtaatcatcagagacaaccaccaccatccggcgaca

SEQ ID NO: 719960 - DNA, 600 bp, Homo sapiens
gtttatgaaataaaaattttatttcagattacggttatttttttataaacctagcactgcaaacatctgtgcatgagaccctcttttatgcactataaaaaggctgccatgaatattacagttgctgtttggcataggagcctatgcctacatacaggctgaaagcttctggagccgttattttggagcaatgccagctgaaagggtgctagcgtaccgttgggtgaaacatgatccattccctcataaaaagctggatcattaaagctctgagaaggaaatgacaacatgttcaagaaaataaacatgcgtgggttaaacggcagcttacttttaatactaatatacatacatgaggtgtcatgaaaggtcaatctttataagtcatcttactagaaggctaaaaactcacttggaactcaatgctccctaactagagacgcaagcattgattagcatatggcactgacgcagcacagagcaacccgaggcaccattctggtcctgggaacccacggagttaaggcacggccgagacaggaaaaacattcaggctgcacaattgtgtgacagctgtgtgccccagggcaccatggcaat

SEQ ID NO: 719961 - DNA, 1114 bp, Homo sapiens
  misc_feature (1114)..(1114): n is a, c, g, or t
atcagcgcgttggcgcgccgctgattcgtccctagccacgcgtttgtatcagccccagaaattctaaatatccgtgcaggtttcacgtgagctctgcgactcgaattcacagctgccctcagctgacactgaatctggcgcgtggtcctggtgccgtggcgaatcagcggcgcgcaagagggagcatgtggcctcggctctgaagcatgctggccagaggaaccctgtaggagtggttggtccagtcggggctgcagtgtcctgccttgcagcatggccagttcccatacgagccgaaggcctcgtgtttagggggctgggtgctaacctggagctgcagacggaggaggagttttagttattgcaccctggcaagccactcactcatccaactatcagtgggtttgacagaggagacagccacagtgcaccggtgcagtccgggactgaagctctgtcagatcatcgggcaggcgggaaacccggaagaaggacgggagagcgtgagtgagattgtgagtgaagcgcctggaagcgcagaaccctgttctgcaggatggacccagccctgtctgctgtccggctcaccgtccaggaagccattcacatcctttcatcctcagaggatgctggccatattctttctacctggggaactctggaacgataactctgggggacccgaggatcccgttcttcctgaggagacagagaggtttggcgcaggtcccttttcagccggctccttgaatgtctggtctccattggaccccggtgtctgtgctgtgcccccggtgccctgtgcccgcttggggagccgtcctgggggccccgtaaaaaacttcctgtggggggatgaacccccttacacacgctgcgtgggtgcaacgcacagtacacaacagcgccaatgtaaggaggcgcgccccataaatgtagggcgaggccgagccatcaaggcggcccctcttacgggtgagagacaactactacgatgcacacccaaccacgcacccagggagagacagattacgccacacgtgcagccgcagcaactaagcggctagtagtgctcggaacactgcgttgccctggatgatgtggtggcgcggcn

SEQ ID NO: 719962 - DNA, 117 bp, Homo sapiens
tgactctacaggattaagttgtcaggcatgtagggggcaggtataggtaaggggcatcagatcagctcgaaacgatgaactctagccggacacaagtcaggagagcgtcagggtgat

SEQ ID NO: 719963 - DNA, 217 bp, Homo sapiens
gccaaggcaacttgttcggtggtgacaatgtaccctgctaagggccaagatcaactcacctgttataaattcgtccctcacgggtcccctacacacagcacctggaaacagacaagagggctcaggatggcacagaacactacttcatcttgagatctgttacccggtaccggggcagtgccggatgcccctatgttaatatagggacatatctcat

SEQ ID NO: 719964 - DNA, 170 bp, Homo sapiens
  misc_feature (63)..(63): n is a, c, g, or t
  misc_feature (67)..(67): n is a, c, g, or t
  misc_feature (73)..(73): n is a, c, g, or t
  misc_feature (82)..(82): n is a, c, g, or t
  misc_feature (88)..(88): n is a, c, g, or t
  misc_feature (95)..(95): n is a, c, g, or t
  misc_feature (99)..(99): n is a, c, g, or t
  misc_feature (136)..(136): n is a, c, g, or t
  misc_feature (149)..(149): n is a, c, g, or t
aggcccgtcccccgccccgccccgcctcacagctgacagggccagtcccaggtccccgggccnccancccgtnaggtccgtnaggttntggccgntttnacaaccccggcctccccgggctccaaaaaaggcccgngtttaaataaagngccagcgcaggatgaaagcga

SEQ ID NO: 719965 - DNA, 362 bp, Homo sapiens
gaataaaaatacttgggattcagttcctgcgcaggccagtcccctgagactgattgtaaggggggtaaacaaagatttcaaagccaggccccatggctcaggcctgtaatcccagcactttgggaggccaaagcgggtggatcacttgagcccaaaagtttgagagcagcctgggcaacctaacgagactgtttttccaaaaaatactccaataagctgagggtggtggtgctggcctgtagtttgagctactcaaaggctgaggtgggaggatcgcattgaccctgtgaggttgaggctccagtgacccatgatcccgctgctttactcaagcttgggcaacagagtgagcccctgtctca

SEQ ID NO: 719966 - DNA, 324 bp, Homo sapiens
  misc_feature (304)..(304): n is a, c, g, or t
cagctacttcctggcgacaaggaacggtcagttgtgctgacgcaggtgctgtctcaccctttactgtgtcctgtggccccaggtgtagaagcgactggaaaagaaaatgaagttgggggtttccgacacgtcacctcctttcacgtttctgcagtagccgaggtgctcacagaagctccttggaggcgctgggcctttgttctcagcagcgcagttcgcgcaatgagtaggaagccctcaacctgcttaattggttcggtctgctgagtagaaaaccaggctgggcacactgcagcccgccttnttgttaaagggtttcctccc

SEQ ID NO: 719967 - DNA, 707 bp, Homo sapiens
taagtgattaatccaattaatctatatattaatttacaaatattatcattatagctcctacatgctatagtatgtattaggtaattctattttgtgcacaatttgcatttggtccaaatcctatatttgcatgtttagctgaaattactagatttttttcctgaatcttcatgtatgtatgtgagcattcacatggttttctcctagaatctcaagtggaatttggaatcataaataatgcatgagatttgaaaactttcaccgagattataaatgtagttagtttgatactccttagccataaaaaaactgaaacagtgaccacttttagtgtatatgaaattttacataagagttagcatctttagctttataatctgaaaggaacccaatttaacaaatgatggattatgctctgtgaaatgaaaagttcaatcattgcctttgaaaagatgaactcaagttaggtgatctcttgtacttggtaaagctacttttgtcctaaagaacagagtggagtggatatattcactttttttttttctaaaacatacaatgtgataaaataatcgtgcctaatgtcaaactttactggtttgagaagaataatcaaaaggacttataccataggacttactattgttttttaaggatctcctctcacagtggtaatgaaacataactgtaatacatcttaggatttatgt

SEQ ID NO: 719968 - DNA, 271 bp, Homo sapiens
gccccatgtctctgggaacatggagccttggtgtatttttcttttctttcagtaatgaatcaataccagtgtccagtcccccaggatagcttcctgcaagcccatacgtgtttttgtaaacaggctcctgcgaccagtgtgtcagtacagagccacgggcagtgtcagtgttctggtgttttcatctgtgcatagcctaagtggatgacaccgggatcatggggcaacccatttggtcttttcaataaaggtctaagatggtttctcaaaa

SEQ ID NO: 719969 - DNA, 388 bp, Homo sapiens
  misc_feature (74)..(75): n is a, c, g, or t
cgcagcccggccaggtcctggagagacaggagttggagagcctcatctgccaggcagtccacacccagatgganntcctgcaggagctgctgcagcgccagatccagaacacattcgccatcttggacctgaagcttcagaagaagactctgaacctcaacgcccccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgacttgcggcacggtgagctcagcacccacagagagacttcttgtgattaaaagaaacaaacccataaaa

SEQ ID NO: 719970 - DNA, 136 bp, Homo sapiens
agcccggggcggcggcagctggggcggcggggggccttcgcggctgtcctcctccgtgctgaagccgttcatctcacccgccccgggccggtacctctgggggagggtccccaggataacgactcgcgcggcccgc

SEQ ID NO: 719971 - DNA, 604 bp, Homo sapiens
  misc_feature (57)..(57): n is a, c, g, or t
ccaatgtgctggtacggccggagtacgggatgggccatggcactcttaacaccccanggagtgaaagaagtcttccaatttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaagtgacaaagagaaaggaatactcttacagggaagaagctgacagctgcctccttagtcaaatgatccaagtggacattgtcagtaaaaggccacacacagaatcccgtgtgcctggtcagacgcagtgagcagccagcattctcctgtgatggttccaacaaagactcatggcccgaatctaatcaagagaaaacagcaaagtaggaccatggctcaaagtagccctcctgccagcttcaaatactcgaaggccataagagcccagcaaagactgataaacctttccaaactgaaagaggcgaagggatgtcttcacacgtgaaaaaa

SEQ ID NO: 719972 - DNA, 141 bp, Homo sapiens
ttctggtgctcttagagtccttcttcatccttgagtccaccaccttgtaaatgacctctgactccagctggccggcgcacttatgcgagccacaccttattataggctacaacgtagtgtacatggcgtttctccttgcga

SEQ ID NO: 719973 - DNA, 182 bp, Homo sapiens
atgcaagtgctcaacactctgctagcgctactactaatcaccattacatgcaagactaccacaactgaactggctacatcaattcgtacattgaagagcagttagcagctatgacctacttattaagcgacctactacgtgcgcttgtaatacacgtaccatgagctctaccaactcctgcc

SEQ ID NO: 719974 - DNA, 968 bp, Homo sapiens
  misc_feature (71)..(71): n is a, c, g, or t
  misc_feature (75)..(75): n is a, c, g, or t
  misc_feature (158)..(158): n is a, c, g, or t
  misc_feature (178)..(178): n is a, c, g, or t
  misc_feature (242)..(242): n is a, c, g, or t
  misc_feature (256)..(256): n is a, c, g, or t
  misc_feature (291)..(291): n is a, c, g, or t
  misc_feature (293)..(293): n is a, c, g, or t
  misc_feature (424)..(424): n is a, c, g, or t
  misc_feature (442)..(442): n is a, c, g, or t
  misc_feature (460)..(462): n is a, c, g, or t
  misc_feature (470)..(470): n is a, c, g, or t
  misc_feature (486)..(486): n is a, c, g, or t
  misc_feature (488)..(488): n is a, c, g, or t
  misc_feature (496)..(496): n is a, c, g, or t
  misc_feature (501)..(501): n is a, c, g, or t
  misc_feature (547)..(547): n is a, c, g, or t
  misc_feature (570)..(570): n is a, c, g, or t
  misc_feature (596)..(596): n is a, c, g, or t
  misc_feature (601)..(601): n is a, c, g, or t
  misc_feature (670)..(670): n is a, c, g, or t
  misc_feature (686)..(686): n is a, c, g, or t
  misc_feature (724)..(724): n is a, c, g, or t
  misc_feature (741)..(741): n is a, c, g, or t
  misc_feature (748)..(748): n is a, c, g, or t
  misc_feature (752)..(752): n is a, c, g, or t
  misc_feature (757)..(757): n is a, c, g, or t
  misc_feature (817)..(817): n is a, c, g, or t
  misc_feature (819)..(819): n is a, c, g, or t
  misc_feature (825)..(825): n is a, c, g, or t
  misc_feature (849)..(849): n is a, c, g, or t
  misc_feature (869)..(869): n is a, c, g, or t
  misc_feature (872)..(872): n is a, c, g, or t
  misc_feature (964)..(964): n is a, c, g, or t
cggctgccctctcgctcagtaccctggccagtcccaaggggggcagtggcacagcgggcaccgaggcccangcgncaatcactcattcccttacggactacagagaacaactactgcccccactatgagaaggtgagtggggactacgggcaccctgntctacatcgttccaagagantgccggccccaagaagcccggcgaaacaatctaactaacacacggtcctgagtgcccggcacgncctcaggcccccgnagggacagtcggcctggaccggacctctcctttcncncccacaccccctccccttgccagctgtgcccacctttgtatttagttttgtagtttcttggcttttataatccccctttttccctgccccctgggcttcggaggggggtgcttgtgccccctaacccccantgcctcattgttgccatnccccccgtggccaggccnnntgtggcancgttgggggcgccccntntttggaanggcangggcgtggacacatgaatggacaagcacggcacgggagacaagtcncccgtggcccctgccccctcccntcgcccccccttgccacccttcccanggacntgcattgttccgctaatcaatcacctgttttttaaatgcgttttgatgttcaatttttttaggcatgtnaacatcaatttttcantctgttttttttgaaagaaaaaaatggaaaaaaatgtnaaaagagcagccccccnccccagnggcntttgntgagcccttggcccaaagccagatacaaagaaggggccctgggggcaccgaatgttggtnangccagngaaagcaataggagtgccaatttncttttaatagaattcctttngtnatttcctgggtgggggtaagggggcagggccaggggcctgttcacgccccactgaggggaaagagggaaaagtgccacctggggcaagggtngtcc

SEQ ID NO: 719975 - DNA, 697 bp, Homo sapiens
  misc_feature (57)..(57): n is a, c, g, or t
  misc_feature (350)..(350): n is a, c, g, or t
  misc_feature (386)..(386): n is a, c, g, or t
ccaatgtgctggtacggccggagtacgggatgggccatggcactcttaacaccccanggagtgaaagaagtcttccaatttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggctgctccattactgaggctgtgacgatcctggggaacaagcttagagattaccggggccatttcaacaccanccacctgctggccctctgtgactacttccaccacancttcatccgccactacaaactctaccagtatgtcctgggccaggaccagcaggtcgacctgaccgttgcccacctggaggtgtgcatgccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgacttgcggcacggtgagctcagcacccacagagagacttcttgtgattaaaagaaacaaacccataaaa

SEQ ID NO: 719976 - DNA, 136 bp, Homo sapiens
gggataatggcgagtctcgaccgcgtgcgcgacaggcatcgaacagcaccaacagcaagcgtacgcggggtcgcacgtgcaggtgcgcgatgcgcggcccgagcacgcgcagcacctcgtagtgccaggtggtggt

SEQ ID NO: 719977 - DNA, 889 bp, Homo sapiens
  misc_feature (57)..(57): n is a, c, g, or t
  misc_feature (542)..(542): n is a, c, g, or t
  misc_feature (578)..(578): n is a, c, g, or t
ccaatgtgctggtacggccggagtacgggatgggccatggcactcttaacaccccanggagtgaaagaagtcttccaatttcagagaccacaaggtcgggagcgcctgcggaggcttctgaactgggaggagtttgacgaacagagagactcccggaggagcatcctgctggacaccctctacgagagcatcatctttgcagtgggcaaaggcttcccatgggtggaggtggcccaggtggtcaagttcacagaagagctgctaagggaaaccaaaggttcagtccaggagcccacacagcccaccagctgtgtaggaatgccagcagaggcctgatgatggcaatgacggtgacaatggcattacttattgagtgtttactgtgtaccaggcactgtggaaagcaccacatatgcatgctgtcgcctaatctcacgaggtagagatttttattgcctctattttacaggctgctccattactgaggctgtgacgatcctggggaacaagcttagagattaccggggccatttcaacaccanccacctgctggccctctgtgactacttccaccacancttcatccgccactacaaactctaccagtatgtcctgggccaggaccagcaggtcgacctgaccgttgcccacctggaggtgtgcatgccacccctatcccgccccccatcaccagccacgcaggccaggaggaagccctgaagccccaaagagcgagcaaaggaaagaaagcgaaggcaaggaagtagaaggtcccgactgccacacgagactgactggggaccagccacccataaccatgacttgcggcacggtgagctcagcacccacagagagacttcttgtgattaaaagaaacaaacccataaaa

SEQ ID NO: 719978 - DNA, 200 bp, Homo sapiens
gttccattggattgtattaaaaaacagaaagacaactacacacgcactgtttcccaactactatcagccagacattatcaacacccaagcacaactggggtgaaaaaatgcaccaatattttaaaacacatttcaggcacttatacacagcaggaaggttatgtgggattcaaccttgcaaatggacccataaacatgta

SEQ ID NO: 719979 - DNA, 465 bp, Homo sapiens
  misc_feature (41)..(41): n is a, c, g, or t
atcagtatgatggaatcatgccagctgtagcctgggtgacnctgtcccagatccacacctgtctgcagctgtaaaggctcatgggcattgcagtcggtggtgaagacgcatacggattaagcatcatcccgtaatgagtagtggaagccatcggtatcaccaaatggctggaatctcgctctgctctccggagctggtctctggccctgaggtcgaggtgcagttctaatcgtgggatcctggggcttctggctccctcgtccataaagcgggacaaccttctctctgctgatcccagcttaccaccctggacactcataccgttctggccgtgtctccagtctctgatgaagacatggtcatcagtacaggtggccactcacactggccccagcttatcgagcagtctccagacatatagtacattcgaaggtcgcgaccgctgcgcaccgctcgccatttggc

SEQ ID NO: 719980 - DNA, 105 bp, Homo sapiens
gacgctctctcggtgggggcatatatctgaacaaaccggtggatgacatcatcagggagaacggcaaggtggtgggcgtgaagtctgagggagaggtggcccgct

SEQ ID NO: 719981 - DNA, 1128 bp, Homo sapiens
  misc_feature (5)..(5): n is a, c, g, or t
  misc_feature (135)..(135): n is a, c, g, or t
  misc_feature (159)..(159): n is a, c, g, or t
  misc_feature (201)..(201): n is a, c, g, or t
  misc_feature (272)..(272): n is a, c, g, or t
  misc_feature (288)..(288): n is a, c, g, or t
  misc_feature (308)..(308): n is a, c, g, or t
  misc_feature (344)..(344): n is a, c, g, or t
  misc_feature (376)..(376): n is a, c, g, or t
  misc_feature (379)..(379): n is a, c, g, or t
  misc_feature (382)..(382): n is a, c, g, or t
  misc_feature (456)..(456): n is a, c, g, or t
  misc_feature (482)..(482): n is a, c, g, or t
  misc_feature (500)..(500): n is a, c, g, or t
  misc_feature (583)..(583): n is a, c, g, or t
  misc_feature (698)..(698): n is a, c, g, or t
  misc_feature (703)..(704): n is a, c, g, or t
  misc_feature (785)..(785): n is a, c, g, or t
  misc_feature (801)..(801): n is a, c, g, or t
  misc_feature (805)..(805): n is a, c, g, or t
  misc_feature (827)..(827): n is a, c, g, or t
  misc_feature (830)..(830): n is a, c, g, or t
  misc_feature (833)..(833): n is a, c, g, or t
  misc_feature (845)..(845): n is a, c, g, or t
  misc_feature (853)..(854): n is a, c, g, or t
  misc_feature (995)..(995): n is a, c, g, or t
  misc_feature (1014)..(1014): n is a, c, g, or t
  misc_feature (1028)..(1028): n is a, c, g, or t
gtgantgaaactgactgagagagagactgtgacacagcacactgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgngtgatgtgtgtgtgtgtagtgtgngtgtgtgagagagagagagagagtgagagagacagagcaganagagagagagagagagagagagagagagagagagagagagagagagcagagagagagaaagagagagcagngcagagacacagacanagacaaaaaaagacacacanagagagtgacagacagagagagagacacacagaganagcagcagctgagagcagcagcagcagcagcngcnganacacagacacagcagcagcacagagagagagagagcagcagcagcagcagcagagaagagcagcagcagcagcngagcagcagcagcagcagcagcagcngcagcgctgcagctgcgnagcgcagagacagagagcagagagagacacagcacagcagcacacacacacagagagcgcagcagagagagagcagcagaggnagcagcaacaacaacagaagaacaacagcagcagcagcagcagcagcagcagcagcagcagcagcagcagctgctgcagcagcggcggagcagcaacactgcagcagcagaacanaacannacagcagcagaacaacacaacaacagcacacagcagcagcagcagcagcagcagaacagcagaacaacaacaaaaaaagancaaaacaacaacaacntcancaacaacaacagaacaacaacnagnagnagcagcagcacnaaaaaaannagcagcagcagcagcagcagatgactctatcacacacacacagcgcgcgagagagagagagagacacactgcacacagagagagagacagagacacacacacacacacacacatacacacacacacagagtgagagatacncgacacacacacacagcgngagagagagcgcgngagacagagacacacacatcacatacacacacacatagagacacacacatacacagagagagagatatagagagagacacagacataaacacacacatat

SEQ ID NO: 719982 - DNA, 1382 bp, Homo sapiens
  misc_feature (1031)..(1031): n is a, c, g, or t
  misc_feature (1062)..(1062): n is a, c, g, or t
tgcctatatatttttagaacactccctcccattttcccctcattttcaacagggcagtcggatattggaggaattgtaatgaagacttacttatacatatttcttgaattctaaagacttatatgtatttcttgaattctaattgtgtgtgtattaaagggattgaagttgtagtcacagagaatacttagataaaagcaaaatatcttgatcttatggtataggtagaaacagtcattcagatttagctgggggagataaaccataatatattatggttagaatggtgcattcccttgaaaaaacattccaaatagcttggcatctgctttttgatgtaattcttttgaaatacttttgagcctgctgtgtaatataatggccaagaccttgaattttagagactaattgatctatcctggaatcctaggttcacttcttaactaactctaagcctcaattttctggtcaattaaaaaatatgaaagaatgataacagaacctatttcagaaaggttaaatgaggtaattatcaagtgtttagtacaatgcctggacccatttcaagccctcaaaagttagttgttaactaccttcttttgttatctttgggagaatctagaatcctattgattgccattgaagattttttacggattcagtgacagccatgccttttccaagtaaaatatagcaatatagagcttatcctgctagagcagatgacagaaccaaaggtggattggattaaaaggaaagcaaacatgggggaataatggtaagaaaacatataaacaatagaataaaattaaagaaaccaaaggtaaaaattagatgaagatgtattttgatttgcttattacaaatgccccttgatatttagtgtcatttaaatatataagtaaattgtaagtacttcattatgtctggtatcattacagaatggaaacactaatgcagatgtgttacttccatatttcctcagtgaagttgtgtaactttaaagggaagaggtattggtatacacaaanttagatggcaattctattgtagtaaatatcnaaggaagattatataagtttacacatgaaatatgaaagctccaacataatgctgttgcatgctaatattaaagctactatccccaacaaatatattgtttgctattactactttgccagattaagtgacttggtgtccgctggaaagcagccagtgctgagagtacaattggtacttgtatctcagctattttctagtttgctcgtgtttgtatgccttcctagagtcatttgtgcttctttctgaacttgttgattccagtcgtacttgttttgttatgaaatttaaatatgtaagttgataaaatgtgacggaaaaag

SEQ ID NO: 719983 - DNA, 128 bp, Homo sapiens
  misc_feature (96)..(96): n is a, c, g, or t
gctgcgggtcactctagagcgatcccttatatgctgtctcagtgaatgagagctggcaagggcaaatgagaaaccgtccgcgtatccagcgcaggngcccgtgcatccatctataatgaggataatgg

SEQ ID NO: 719984 - DNA, 128 bp, Homo sapiens
agacatcttagaggctgaactcaatttctgcagaaagattctcccagtttttcctgtttggttagtttttttacaaagacaggatcttgctgtgttgcccaggctggtcttgaactcctggcctccca

SEQ ID NO: 719985 - DNA, 366 bp, Homo sapiens
  misc_feature (276)..(276): n is a, c, g, or t
  misc_feature (309)..(309): n is a, c, g, or t
  misc_feature (337)..(337): n is a, c, g, or t
agggttaagattgctgtttttctgtccttgctttggcacaacacactgagggtttttttttattgcgggtttgcctacaggtagattagattaattattactatgtaatgcaagtacagttgggggaaagcttaggtagatatattttttttaaaaggtgctgcctttttggatttataagaaaatgccgtcatcgtgatagaacagagttttcctcatatgataagaggaaggacttcacttcaatggaacagccatcactatcagatcagctcnggaaggagtaaagttctcaaagagacaacgaantttgttttttttatgactaagtttggcnctgcagactatacctatttaaggcgtgat

SEQ ID NO: 719986 - DNA, 370 bp, Homo sapiens
  misc_feature (152)..(152): n is a, c, g, or t
aattcggcatgaggtgcagcccgcctgctgggcaggccggcgcgcgacacctggagtcctacgacatcatcgccaaccagcctgtggtcatcgacaacgtgaggcccggcagccagggggagggcgggcgaccgcccagggggcgacggcgncaggcgcagagcgagagacccccgcccgcctcgggcgtcctccgctcactgcgtggccgtcgcccccgccggccgctggtatcgtccgggggcagcgcctacttggtcttgtaaggcggccatggggcgagcccctcgccggcgtcgcagagcctcttccccgacccctccccgagtcgggcggggaagttcaggagagcttgagtgacagccgggcg

SEQ ID NO: 719987 - DNA, 146 bp, Homo sapiens
gtcatttctacacctgactggactacagtggtttatctgatgcactccgtgaaggtctactacagtacgtcctcgccttcctccagccgagatgccagagtctctgaacgaagaagctggggttaactcaggtagttagatcaaga

SEQ ID NO: 719988 - DNA, 1064 bp, Homo sapiens
gggcttccccccccctcactctttttgttggtgcccgcgcgtttcatttctattctgcggggagccttcttgtttgtcatggattaacaccgtgtgttttccgtgtcgccacacttgcttcctcgggggaggaatcccccccgctgtctttttttttggcgtggtgtttgatttgcactccctcccgcgggggtgtgtgggtcacgctcctcacactactttttttttctctctggggcggctctcacctttttttatggtgttgcccctcccctcttcactccacctctattggcgctcgggtttttgtgaccccccccagcgtgttttttcttctctcgtctgccgcgatataatttggtcgtgggacaggttgtgctcccttctcctctctctcgtcgctctccctcaccacatcacggggggtctcttctcctctctcttgcggggcgtgtaattatatgtgtgtgcggagatctatttctggttctcgcggagaaatttttttccgcgccacctgcgcggcgcgcgccctttttctctctctcgggacacactcctcgcgccggcgcgtgagctccttccgcccggtatgttggatcttctttccacacagagagcttctctcataagagagagattgtataaataaagaagacaccgcgccttcctctctctagagaaagacctccttctccccacacacaggggtattttcttcgctggggagtgagaggacttctctccccccctctcgcggtgtttcccgccttttcctccccgcgcggaggtgccccgcactcgcgtgtctcagagagagggcctccaccgcgccctctctctctgtgcctctcttttccccctcttctccctctccataaaccgggcagcgccccccccaccccccccagaaaacttttgtttccccccccccccctccccgccccccagacagggggagggaggcgcccccccccccgtgtgtttataaacttttttctcacaaagagcgttttttcccccccgggcaaaaggggggggggaaaaaacccccccttttttta

SEQ ID NO: 719989 - DNA, 195 bp, Homo sapiens
tgagttgtaaggggatagattagttgtgtctggtttggggagatatataaatggaattatggattgttggtatgtggtttgttttgaggaatattatgtttgtgagatttttgttggatgtatttgtagatggattttgattgtgatggttgtataatatttgattgtgtgaataaaaggagatagtgtttatgt

SEQ ID NO: 719990 - DNA, 349 bp, Homo sapiens
cgcctcccgggtctcaagaaattctcaagaaattctcttgcctcagcctcctgagtagctgggaccacaggcacatgccatcacgcccagctaatctttgcatttatagtagagataggggtttcaccatgttagccaggttggtctcgaactcctgacctcaggtgatccgcccgtctcagcctcccaaagtgctagggttacaggtgtgagccaccatgcccagcctgtggttgtatcttaaatgctatcttaatgtaactttatactctctactagccaacttgttaatgtcttacataaaatcactctctggtgatgattattatgcctaatactttgtaccata

SEQ ID NO: 719991 - DNA, 556 bp, Homo sapiens
tggcgttctagaggtcccgaaaatgacatagaggcaggagaatcacttgaacccaggaggcggaggttgcagtgagccaagattgcaccactgcactccagcctgggtgacaagagcgaaatttcatctcaaaaacaaaaaacaaaacaaaccaactggttaaatgacaaagtatagaagaaaggggatggtgtgctgccatttattcctagcttttatttgtgaagacggcctcgggaaagacaatcaaatggaagagagggtgtggggcggggaggacacttggggctttgagaggagaaaggcagatgagagacgtgttttcaccgaacatcctcttatatcttgcgaaactgaaccataagcatgtatgacccaggcatacacacatacacatgtaaataaaacaatcattgaaaaagaaggccgagcgcagtggcttacacctgtaattccagtacttcgggagatggaggtgggccaactgcctgagcccacgagtctgagaccagcctggacaatgtggagaaacctgcctctatgtcattttcgggta

SEQ ID NO: 719992 - DNA, 244 bp, Homo sapiens
tagaggatccgtctcacctgctgacatctcctttgtcgtcttctcgagaagagacagaagggtcaaatggtaaagaaaaacttttgaggaggaagcagacgttacgcagtgatggtacaagtctacattaaacaagcaaggaatcgcagaaatcattcgtttcggggcatatggaacaggtagacagtgtcaggacttggtccttgggcaccatcaggttgatgacccgggaagtccttcctgc

SEQ ID NO: 719993 - DNA, 936 bp, Homo sapiens
gtaatgggatatgtcgaccaggcgtcgagcggcatcaccgggagtagcagagtgaagggagcaaaagcagtgggtcacccggatgcagccgccgggccccgggccgtgagaaggagcgtcgggcggcgggagctgggggcagtggcagtgaatcggatcacacggcaccgatgtggtggtgtgtggatgcagcttggctgaagatgctgtcctgtgcctgtgccatgctcatgcctgtgtgcatgcatgcccactgacagtcatgtgcctctgtgctacctgctccctggtggcttcccccctgtctcccacaacccattgatccaatgtgcctatacaagttggtgtgtgggtgtgcctacccagtgggtgaaccccacatgtcctgggcagcttgagctgcctgtaccccccgtgacattgactatgtgccagcccctgcacaagtacgcttcccatggaaacgcgctaatggcggaaaccccgtgcaggacgttcacttcgctgcgacatcgatgttgacctcgctgcgcgccatggcccccatgtcccctgccctgcacggctcgcgcggcagcttggcctgtgtccttgcccgctactgcacgacgctcggcgttggtgcgttgcgcttcgctggtgtgtgccacggacggggcaggtgcacggtgtgcggcgggcgcacgcgcctagggaccacccacgcatactgacccctggcacgcctgagcttgtctcacagactcctagacaagcacactagtgtctagacgcagaccgtgattatgcgagcgcgactccatcatcattgcgcacgtcagccgagacgccatcgggaccatccccaagcccttgttgtctggtggggatcccttcctgggattgaaggaagaaccccatcgaggctactcgcgcatagacccccacctcctgcac

SEQ ID NO: 719994 - DNA, 294 bp, Homo sapiens
cccagagtctggtggccttcagacgacacctaatcaagagaaaatatttcccaggtggggaggtccggtctggcatcagtccaccctttgtcgggccggcttcttcctccaagggcctcaacctctacatgctcactctcctccccttccctcagcccatctgggtctaagcagctttcacaatccaaaccaaacatcaccagccaccggctgataagtcaccagcatttacttgccggagttactttttctccatgcatggagactatggatccatcccaattctttctaaat

SEQ ID NO: 719995 - DNA, 168 bp, Homo sapiens
ttagtaaatgaatttgctccagttaataaagaagcccgattgctgtggaatgatgctttggccacatctgactggtttctgcaggtattttctatatcgtcattgtttgcagttaggacactgtattttctcttaactaagtgactagcagctgtgattttaatcccc

SEQ ID NO: 719996 - DNA, 768 bp, Homo sapiens
  misc_feature (4)..(4): n is a, c, g, or t
  misc_feature (96)..(99): n is a, c, g, or t
  misc_feature (105)..(106): n is a, c, g, or t
  misc_feature (162)..(162): n is a, c, g, or t
  misc_feature (175)..(175): n is a, c, g, or t
  misc_feature (233)..(233): n is a, c, g, or t
  misc_feature (336)..(336): n is a, c, g, or t
  misc_feature (438)..(438): n is a, c, g, or t
  misc_feature (442)..(442): n is a, c, g, or t
  misc_feature (449)..(449): n is a, c, g, or t
  misc_feature (527)..(528): n is a, c, g, or t
  misc_feature (624)..(624): n is a, c, g, or t
  misc_feature (626)..(628): n is a, c, g, or t
  misc_feature (672)..(672): n is a, c, g, or t
  misc_feature (720)..(720): n is a, c, g, or t
tgcncccgtgttgtgctgccccccataagatcggtatgcagcggtgtggtttacacggcagggcacaggtaggcgattctgcagcatcaacgcgannnnggggtnnttgagccgtcgtgggagatctggcccaagaccagctcctggctggtgtcgccagcnccggctgcattgntgggtgaggcaggtctggctggagtctgggtctgcaggcctggccggggcaggttgtnggggaccaaggagccctgggtgtgaaccccactgtggaggcagcaggcacctagtggtgccactgggacacccggctccaggactccggatgtcacacatgcntgagttttggcgtctacacccccctcggggccagttggtgatcagtggcccgtggtcccacaggccgtgccctttcccagggggcacactgggcatttctcnatgncctttanttgtctgctaagttgccacatatgcatttggaagctggagttcttgggctggcagggaatggtggcagccttcttagnnaaaaaaaaagggctggcttgctgggctaaggtcacagtgttctgaggtccccacacgcactcagactagaccctccgtacacacccaggctagacncnnnatactcacccaggctagaccctccatacacacccaggctagacnctccatactcacccaggctagaccctccatacacacccaggctagacnctccatactcacccaggctagaccctccatactcacccaggctagatc

SEQ ID NO: 719997 - DNA, 840 bp, Homo sapiens
  misc_feature (623)..(623): n is a, c, g, or t
  misc_feature (652)..(652): n is a, c, g, or t
gtggggtctcaggaggcagcactctcgggacgtctccacttgcctgggggacagagccagactccgtctcaaaaaaaaaaaaaaaaaaaaattcaaattcctcattcgggctttacttatcattgagaaattagcgtggtgggaaaagaaccgtgaacccaggccttattttaatttccccaagaattttaatttcactttcccactgtgaatctccgctcccaataaccattgtctgggacattggggtggcgggagcttacccatttcaagaagtgaggaattggggtgtgggggacacagccaaaccattattcacgagaatttttccacggagaattaatctcggggaacgtggaaattatctccagcgggggaagcccgggaactcgtggaatgtgtgtgccgaagttagtggcagttacgtggggttattccacgagaaattagcagagggaattttccacattccttagtggcgaataccagttgagggatcccgtgaacaggggcggtgaattattctcccccaatttacccctcgggtgaaaaaccgcgctctcagaggcttacttaaacaattggggcgtggtgatattgcggacacatattgcgggcggggnttccaaggatatgttcgggggtctggttnacgccacaactctcggtggacgcatatccccccggcttaaatttttacactctgggccaaaggatatttttcccttcttcggcacactgggttttttttttggccacaccccacggggccccgcggaaacggcgtcgcacccttggtctcaccctttgggggggcccctttggaaaccctattggggc

SEQ ID NO: 719998 - DNA, 425 bp, Homo sapiens
  misc_feature (240)..(240): n is a, c, g, or t
  misc_feature (308)..(308): n is a, c, g, or t
atgttgctatgtaacattttagcattgcttactatgggtatatatatttttcttcttctaataagccatctttccagcataactaaatttcttcttttaatttccttttctctctcaattacattaatttaagtgaatgaaatcttcaaaacctttctatgatctggcccaaacatttaaaaatatctttctttcctttctttcttccttttattctctctccctctttccctttctgtnacattatcacttactgtatgttatttgagtcatttgatattcacttaccctgagaggtaagttctgtntatttatgtggaacctgaggcttagagaacttaggtaacttgcccaaggtcccacagttagtgacagagctagtattcaaatgtggagcagtctgattccgtcgctgcactccggaa

SEQ ID NO: 719999 - DNA, 434 bp, Homo sapiens
ctgtcgcccaggctggactgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccacccgcctcagcctacccgtaatgatgtgtttttaatggtttggttttgttttttgggtttttttttttttgagacagagtctcgctgtgttgcccaggctggagtgcagtggcacaatcttggctcactgcaacctccgccttccaggttcaagcaattctcctgccttagcctcccaagtagctgggattacaggtgcccgccaccatacccggctaattttttgtat

SEQ ID NO: 720000 - DNA, 1290 bp, Homo sapiens
  misc_feature (10)..(10): n is a, c, g, or t
  misc_feature (65)..(65): n is a, c, g, or t
gtagcgcagncatggctcgtggtcccaagaagcatctgaagcgggtggcagctccaaagcatggnatgctggataaattgaccggtgtgtgtgctcctcgtccatccaccggtccccacaagttgagagagtgtctccccctcatcattttcctgaggaacagactgtaagtatgccctgacaggagatgaaagtagaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttagagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggacaaaaaacaaacacaaaaaaaaaaaaacacaaaaaaaaaacaaaaaaaacaaaaaaaacaaaaaaaaaaaaaaacgtgtggcggcgcggccccgcgccgcgccccgcgaagagagacctttcaacccacctccgtggtgggggcggcgggcggcccaacggaatgggaaagagcaaaacaggagggcgaccaaaatggtgtttcactaatgaaaacgccctggcgacaacaacaagaagcggggggagagttcctctcacaaaaagaaaaaaaaagcgcccgcgggggggaagacaaagaaagggtgttgcacagaaaacaactaccagagaggagaggcttcctagggaggaactataagagggggtctactcaaagggggggccccacaaaggaggcgcctgaataataaaaatacgcccccg

SEQ ID NO: 720001 - DNA, 415 bp, Homo sapiens
ctatgcgaacaacacttattttacactgtctaggtttatattattgtttctatcccatttttaatcctttacatgtaaaggaaacaatgtttttgtgggctaacttaagaaatcctaattactacaataatagcaaagagttcaggacctacttaccgtttaagactgatgatctctaatcattgtttcagagagacgcttacttcggcttctactgatcattatattgctgagtggtttagagaagggattctcaccttgtgtgaaagccataagtcacatgacggtgtaatgaaaatagagataaggtaaaaagttgcttttagctctcttggaggtattgttattgggaagtgcagcagactgctctcagagaatatcatagagtttaccatggtctgccagtctgcctgat

SEQ ID NO: 720002 - DNA, 956 bp, Homo sapiens
  misc_feature (17)..(17): n is a, c, g, or t
  misc_feature (71)..(71): n is a, c, g, or t
  misc_feature (83)..(83): n is a, c, g, or t
  misc_feature (94)..(94): n is a, c, g, or t
  misc_feature (101)..(101): n is a, c, g, or t
  misc_feature (115)..(115): n is a, c, g, or t
  misc_feature (133)..(133): n is a, c, g, or t
  misc_feature (166)..(166): n is a, c, g, or t
  misc_feature (199)..(199): n is a, c, g, or t
  misc_feature (202)..(202): n is a, c, g, or t
  misc_feature (211)..(211): n is a, c, g, or t
  misc_feature (230)..(230): n is a, c, g, or t
  misc_feature (251)..(251): n is a, c, g, or t
  misc_feature (254)..(256): n is a, c, g, or t
  misc_feature (409)..(410): n is a, c, g, or t
  misc_feature (663)..(663): n is a, c, g, or t
  misc_feature (687)..(687): n is a, c, g, or t
  misc_feature (707)..(707): n is a, c, g, or t
  misc_feature (750)..(750): n is a, c, g, or t
  misc_feature (774)..(774): n is a, c, g, or t
  misc_feature (776)..(776): n is a, c, g, or t
  misc_feature (780)..(780): n is a, c, g, or t
  misc_feature (784)..(784): n is a, c, g, or t
  misc_feature (797)..(797): n is a, c, g, or t
  misc_feature (857)..(857): n is a, c, g, or t
  misc_feature (946)..(946): n is a, c, g, or t
agtgtttattgctaggnggacacccgcacagcctccggaccccagaggttttgacacaaatgacttaaagncactggcttctnttcagctcctnctctgcncggtaggtgttttntggcggagaccccatcancacgcagcctcgacccgccccctcctccagggntgcagctccgcccagtggctgaagatagcaaantcnttgttgggngaaggttcccaggatgcanttttttggggtggccccaggntgnnngggaggtggagtaagggggctctttccgcggaagggtgagggactatgaaacgctggggggcaggcgggcagccgcggtcttctccaccacgaagccgtagttatactcctcctcaatgtccgccagaaacttgatggtcaggtccccaaaannagaaaaggccagggggctgcagctcttgccctcaaatcgtgggtggagtttgaagggaaccccatccatggctgaaatgccataaaggctggaggcctcgtagatggagtaattcctccgcagaatggatgcccgaaagctcagccttgacgctgttcgctccaggaggccgcccttacttggctggctggctgcatccagaaaaaggccctgcatgtaccggctgaaacctcggggcttgggcactggcctnggggccttggccttcttgcaccanaaggcaaagccgcccatgtnccctattcgaaggtatccaggcactgtcttggtcttcccactnagccggacatcaaacacagccgtntncgtngctnccaggggcaacancttcacacacatgcgtttcttcttggacacagaggccttggaatccatggggtcgcagangggggagaagccagcggcagggggctcttgttcaccacgatctggatatcggccaccacgttctcctgcgggttctctaggctgcccanagaactaagg

SEQ ID NO: 720003 - DNA, 250 bp, Homo sapiens
attcttttttaaactgctttgccccttcctctccctgccttttatagcccatataaatgtctctttgccccccttttgttgtggttttatattggaaccccctttttctttggaactattggatttaaagtaaggtttcctattatgtcagcaagtaattaacttatgttttaaagggggccctatcctggacccaaagttgctgaagttttttttctagctggtaaagtaggagtttgcctgccttcca

SEQ ID NO: 720004 - DNA, 144 bp, Homo sapiens
taaagctgagaggagtggatgggtagatgaatagctgaaacaacattcgaatgcggtgtagacaggtgaaatgtagttttattcagcagctctctcatcagcagttctctcacactagctcttttatactgttggcccttatcg

SEQ ID NO: 720005 - DNA, 377 bp, Homo sapiens
gtcttagtaccaagtcccagtctgtcctatggggagcagtttggccgcgggcattcaggagcctgggaaagaggccctcgccaggtgatggcagggcagtgtggcctggggtaccaggaaatgcgcttagtatttggtcaccagccgtcatcctgtgcttttcctactgtgtcttgttacaaggcctcagcaatccatagaactctctctccttccttctttctgtcagcttctctgcttcagagatacgcaaccatttgtgtacacccaaacacttaaacttcagaaagacatgcattatgtggtgtaatcaaacccgatgctttcagatgacctacttacatcttcaatgtggataagatcaagaacaaaacaca

SEQ ID NO: 720006 - DNA, 536 bp, Homo sapiens
  misc_feature (337)..(337): n is a, c, g, or t
  misc_feature (470)..(470): n is a, c, g, or t
gagacgggggtctcatgaagaaggtatacacatgggcaaataaacatatgtcatcagggaagtgcaaataaaaacaacaattagataccactacacacctattgagaaggctgaaatccaaaacatgaataccaaattcgggtagaggattgggagcaacagggactctcatggtgggggggaatggcaaaaggatatagccacttgggaagacaatggggcagttttctataaagcaaaacatattcttaccataagatctagcaacagaacacctggatatttacccaaataagcggaaaacttacatccacacaaaaacctacacacaaaggtntatagcagcttaatgcataatggccaaaaaccgggaagcaaccaagatgcctttcagtaggtgacagggtaaataacggggggtacatccagacaaagaaatattattcagcactaaaaacgagggaggtgtnaagctatgaaaagactgggagggaccttaaatgcatataactaagctgaagaatcagtctgaaaag

SEQ ID NO: 720007 - DNA, 1642 bp, Homo sapiens
  misc_feature (94)..(94): n is a, c, g, or t
  misc_feature (130)..(130): n is a, c, g, or t
  misc_feature (154)..(154): n is a, c, g, or t
  misc_feature (173)..(174): n is a, c, g, or t
  misc_feature (215)..(215): n is a, c, g, or t
  misc_feature (228)..(228): n is a, c, g, or t
  misc_feature (1494)..(1502): n is a, c, g, or t
gcgcatgcggtcggggttgttcactggctgtccggggctccgcgcgcgtcgccggcccagctgctgtcgctgatcgggaggatctgaagccggncgcaggtcaaagagtaaactgaagtacattctggtnactggtggtgttatatcaggaatnggaaaaggaatcatgccanncagtgtgggcacaatactcaagtcatgtggttacatgtaanttcaatcaaaatngacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcgctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagaaaaaaaaaaaannnnnnnnntaaattatccttgagggccagttttcggtcccgtttttggcaaggggccaaaggggggggttaaaaaaaaggaggcggggttaaacctggtgggaaagccttgggctgggggcccttctggggatggaaccaggatagtg

SEQ ID NO: 720008 - DNA, 907 bp, Homo sapiens
cctggccctggaggtgactgaaggaagtgctgctgggcctggggattaggagaccggagtgctggactctgtgagccagtgtaaccagtgtgtcctgggctagagctggagtctgtgatgcgctgctgcccgcccctgctctgtggagtgacctgctgagatgcccgtgctgaatgcagctgtggcccctgctgcagcccaatgaatgcgtgcctgatctgctgtgcgccctgtccatctcctgctgcctgctctggcgacttcctggcacactgctgcactgtggtggctgctggctggcgacgctcttcggggacacctctgttccttgatgccgccactggcgggctggggcccgggccagtccgagtaggaacccgtgggagtagctcgtcatagtatgattgagtgtagtcctatggaggcgtcgcccacgaacgggacgagtagagcgaacaaaaagcagtgaggtacggagtaagaagacagagtcgagatatagttagtgacgacttagagttggtagatacaattacaaacagtttgcataatagaggaaaggaccagctagcgagtgctgttgtgctcccggggtggtacggtgtgggcgaatgaaatgggccgtgacggaggagagagcccaggtgaggagcgggagttggagggatagataggattatcagttataggtatgatggatgtacatggtgttgattgaggggaaggttagagatgtggattctagatgatgacgttggagatggaatattagaatgaagaagcgggtggatcagttgagaatgttttaaggatggtagggatatagtatattgtatgagggaaggtgaagtggagagagggggggggtatgtggttgggtggagaaatagaggtgtaggaggatggg

SEQ ID NO: 720009 - DNA, 1878 bp, Homo sapiens
  misc_feature (94)..(94): n is a, c, g, or t
  misc_feature (130)..(130): n is a, c, g, or t
  misc_feature (154)..(154): n is a, c, g, or t
  misc_feature (173)..(174): n is a, c, g, or t
  misc_feature (215)..(215): n is a, c, g, or t
  misc_feature (228)..(228): n is a, c, g, or t
  misc_feature (1863)..(1863): n is a, c, g, or t
  misc_feature (1876)..(1876): n is a, c, g, or t
gcgcatgcggtcggggttgttcactggctgtccggggctccgcgcgcgtcgccggcccagctgctgtcgctgatcgggaggatctgaagccggncgcaggtcaaagagtaaactgaagtacattctggtnactggtggtgttatatcaggaatnggaaaaggaatcatgccanncagtgtgggcacaatactcaagtcatgtggttacatgtaanttcaatcaaaatngacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtgggcaaatacacgaagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttatttgggcgtgtgcttagggatgcagttggcagtggttgaattctcaagaaacgtgctgggatggcaagatgccaattctacagagtttgaccctacgaacagtcatcccgtggctcgtagacatgccagaacacacccagggcagatgggcggaaccatgaggctgggcaaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgcngattcattacagnga

SEQ ID NO: 720010 - DNA, 870 bp, Homo sapiens
tccttgcgttttctttcgccttcgtctgccttgctctcgactttcttataatgcgttctttttgcacctgtctgtctccccatgttccatatgggtgatttccccttgcccgtccttagtgtcgccttttctctttctcgtctgtacccgcttttctttacatcctcttgtgccctaattctcgctctatttgtcattcaatcatttagtctcccttcgttcccgtactgtttcctgcctccgaaggattgtaagttgtggcattagcctagtactatctttccttagggaagcgccatactggcgtcttcaatgctcttgggtcattttaataggggtattagagttcaggtctgacgcatcgattgtctgttgatctaaatgatcgggccatctgtgcagggtccagatgtcgaggcttatcagtcgatcagtaacgactctcaacggggtcatatggttttgtggtgaactcatctgttcccgcttctaggttggtgcccagggggtctggagtcaccttagttatatagtattcagtaagaccgccatgtgtccacgctcagcccccagtgtcttagtgtgaacatgcgctgtgtcgcatggcttgctgttggaatactgggtctctgggtccagggctcgttagtggtgagctcaactgtcccgtacaaacacaagatcagggctgagggtaaggcaatagaatagagagctaggaaagcgtgggcccagaactggagactgtttctctttcctggagatgcagccctgggcgcagtggagtcagcagtgtcagcatcagggcaggaagccattaaagcagcagcgggtgtgcacatacacccgagggtacttccttatgggcca

SEQ ID NO: 720011 - DNA, 149 bp, Homo sapiens
tattgcctagcatatcagcaccacatcgttagcgctccttccttcttcctagcttcctgcagcaaatcgcacgggctcctggacatctgttcctatctacaccacgaagctgctgcatgctcgcttgctcctcagatcctagctacatc

SEQ ID NO: 720012 - DNA, 965 bp, Homo sapiens
acgagttctttgcgcgttatgtgtccgggacctcccgtgtgaccgccgtattatcagattgctctccccgcggtgcgcctcgttgctatggggcccccaattctacaacttaagatctccttgctgcccgaaaatccgatgtgccattctcccggggttcattacaaatttttacagacggttctattgcccccgtcgccgccgagtagttggtcaggccggggtgtcacacgcgttccccggggaccaggaccgggttcgaccacccatgtgccagcagcatgcgtggatggtccccgtatatcgcgcctctggttggggacgccccacctgcggccaccgtaaattatcggcgtgccaccggggcaccgcagggaaggcaggccccgtggtccccagcccactatgggacagttctaatgggttgctgccctcccagtgacctcaatagtctctcggataatccatggagcggcctgttccgctgcgaagaagcaatatctccacacgagaaaggggggcgcaaacaaatcacccaccaacattcctcaggtgccctcccgaaatcgagagcaagaagcgcggtgcagactactacccccaacggtggcaccgccccggtaatgtgagccccccgggggtcgcccccgctgtgcgacaaaaacgctgggggtcctcgggcccccagggtaaatctcgggagatctataatagcggggcgcggtaggaagcccacactgcatacacagtttcgccgcccccaacaagttatgatgcgagatatcaacagcggtcgcacactactggtcgtttccacccgccactgtgggtgccccctgaaagtcaagtgttggtttcgaagaacaaatttttatgttcttttgatgagacagaacaagcgttgcaccaacaaccgttgaaagacctttgaaacctcaaaaagacaacccgggcgaacaaaaaca

SEQ ID NO: 720013 - DNA, 816 bp, Homo sapiens
taaactttccgtgccataatacacacgcagccatcagcccacaaagacatgtgactaccaagcgcgtggccccttggcacccatacgtggcctcagccaccataagacgtggacaaccttgggtaccataagtgaccgccccaccgtggcatatattacgtggcgtggcctctttctcgtggtcacagggggctctatagctcggtgaccaacatgtggggtgtgtgctcaggttcgtgtgcgtgcggtgtgtcccatgtgggggagacctggggcgggcaagcgtggtcccgtggtgccgtggtattgtgacacgcgtggtgtgtggggtctcattttcacccgtggtgtgcactcgacgggggcgtggttctcggtctcctcataacatagcgaaagaacccgtggctgggagaaccccaaagggccttctcttttattctctccaacgcctctgtgggacacaaggagtattcgtggcccacaggggggacagaaccaggcgcagaatataacatcttcctgtggggtgtgacccacaccctctatcaccaacgtgttgggtccgatgtgggaaaccccccaatctcaccaagcctttgtgccctgtgtgtgggagaccccaacctacagcccgtgggtggggtcggcggcagattcggcgcattattcatcgcggccccaaggaaattcccgcgtcgcgacgttcaatctccataacacggcttggggggaccatcgtggtgggggcacaaaactctaggggggggagagttgctccaaaagtcacccgggaaaggaagcaccggggaagcg

SEQ ID NO: 720014 - DNA, 185 bp, Homo sapiens
ctgacagaaaaaggtaggcggatggcaggggcagagtatatagacagactaatttggtcacacagtgacacaatttttctttcattagaggctagacatgttttactcgggccagtgctgcttctgaaaaggccagaggtggcaatagagagacaaagaatgctctcttccctagatgccaaggg

SEQ ID NO: 720015 - DNA, 117 bp, Homo sapiens
catttagaatgattgcctttgattttttttttaaattctgggtgtgtgtgtgtaaaatgccaattaagaaccctggtttcattccatgtaagcattaaacagggtatgtaggtttca

SEQ ID NO: 720016 - DNA, 846 bp, Homo sapiens
ctaacaccagtatcttcagatcatctattttctctatggagcggattaaccactgataaggagagtcactaagtgatgcctggcacttactgcatcagtacagatgaaggtggatacgaaatataatcatgcatataccgaaaaagcaaggtgatggcacacagtctttggtgttgccagctgactgaaggagaaagctaatggtgtgcgggctggagtgctgaccaacgagcatttgctctgatccagtcacggagacgtgtcggcacagctaaagtgagggattactaaactagtgtgtcagcttcaaccaaaactcctctgtgatacggactaagctttaccacagtcagttcgatttgcctgttagagagagacatggttcatgccatacgtcatggcagacatagcgctctaccgagagacaccacttgaacttccacagtcgttacactcgacgagtgtaacgtgcttatgctaagcaagcgacgttctaggcagtactgtgaagcgctatcataatactaatggccttatgatcaccattgacatgggaacagggaagtcctgtaaacatcacagagtggcaatcgttgagatataatgtataatgcattgcttgctaggttttgcagcctgtagtgatcattaggatgtgcatgatgagatggggcttagagcaaaccctagtaattggggtgatcctaacaacgatttgcagcaaacttaaaatggtacttctaacagccaaaacagatggaaccacagacgcggcgggctgcgggggacgaataaaaattgtgcccgccgcacaggggcgcccccaccacgttacacctggatccc

SEQ ID NO: 720017 - DNA, 129 bp, Homo sapiens
atcgaagactaccacacacttgtgtccattgtggatgttaaagccaacaagcacccacattacacaggctgtgaccaacctgtatgacattgatgtgacccaaagcgtcaacaccctgaatatcggccc

SEQ ID NO: 720018 - DNA, 139 bp, Homo sapiens
cggaccgtaccagcggcgttgtaggctgggccgagttggcttccacgaacaactggccatcggagccctgcttgatctcgatttcgccttcgatgttcttccacttgccgacgaagccggcgggcggctgcgggttgat

SEQ ID NO: 720019 - DNA, 545 bp, Homo sapiens
gtgagattaccacgtggggaacgcccctttgcggggtgtaacaagaggcctaacgttgtgggggcagcaaggtgtaggacggccaatcccggagtcctctttagccgcccttcttcctggttcagaacgaggacttttgggactgtatctctgtatagtatagaaaaagctattgtcgtgaacgactagtagtgaggcagatcgcttttttggaccttttctcttttcccccgtgtagtttagccacactctggcacagagattagtgcttccgtgggaaacagggtgttatcgagagcgccctctgcgggacaggggttttccacccgcggtgctgtttcttcccacacacaagtattcgttcttgtcagggagggcctcaatcttaatgcccaacctcagacacatgtttgatcctgcttgtagaatacaatcttgcgcaccccttcttggtggtggggacaggagttgtaggtccacgaaagacccctcttgcgcatgtaaagcatggaagccaaaaacaaaagagttaaaagaaaaataac

SEQ ID NO: 720020 - DNA, 420 bp, Homo sapiens
tgattcatggtgcggtggtcctttaatacatggtttgattttgtttttctcttcctgggtttgggtcacatccctcttctcattgccagtgtttttgttgttgctgttgttgttgaacacagtacattttaattaatacattttaataactctagatattgactccctctcctccaacgctcgctctaggttagggaattgttttccttttttaatttagctaagctattttaggaaagcctatttccctatgtcctccagagtaaagccttttgtattgctcaccctgaggtgagagtaattttaccccagctctctgtggtcttccctatctctaggttagcaatagcttcatttggtgctgctccctgctggagaggctccactaaatagcagttggtcgctgtattgtttttggac

SEQ ID NO: 720021 - DNA, 932 bp, Homo sapiens
tgtggctgtcctgccgtggtacctgctactgtcactacctgttcgaaaggcttcatcttaaaggaggtagaagtcttcgtcgtaaatcggctaaagaagtgctatgatgcggcgtatagggcgcaagaatatgacagagtacgtgggcccagattcccaaatctctggaggatctggggcttgtttatagcaagatcaggaagtgcttgaagctcttttggtgggtttggtatatctgacctctcatccatctccagcatcaatcgggtggagagagcgattgcgtgccccaggctgcatccccacaaggtctttaaatctatcggaatagcgttgaactgtgagctttcacattctaggatgagccacgagttgccttctggtctccccgtgttctctctccctaacttctctacttcagtactgacaataagatcacgggagaatagtccctggatgaggttatcaaccagcgtttaaaatgcttccgcagtaattctggggtgaatctcagcaagaaacagttgatagcgtttagtacctgagaacagttctcttcaatgtgtcaattccctggtttgagctggtctgttcctataacaatagcctataaaacgtatcgactgtacttgaaacctaggaagaatttaaccggggtgcactccactggggacgtttgtaaatgacggagatccgtggacgatcgggggcataatcctatccagtactgggttggcgttgaaggaacggcctcaaaaccggtccgcgcatgatgatgcaaggtggcaccacctaaaaattagtacgggcacatatagagggtccggagaataatcattaaggtagggcaaaataaaacggaaccttgaaagaaaggaataaaaacaagaacaagaaatataagaaaggacatattctcctcttctcacaca

SEQ ID NO: 720022 - DNA, 163 bp, Homo sapiens
  misc_feature (28)..(28): n is a, c, g, or t
  misc_feature (109)..(109): n is a, c, g, or t
  misc_feature (129)..(129): n is a, c, g, or t
  misc_feature (155)..(155): n is a, c, g, or t
gaattgcatactggatctgatattcaangtatacacacacagccaggacccatagtgcccatttcccacagaagaagaaaaaagaaggcgtgtaacgtgttcattccanaagctatcatctacttttangctcacatttccatgtgggaaattcnagtttctc

SEQ ID NO: 720023 - DNA, 895 bp, Homo sapiens
ccaaagatgaatggagccctcccttcggatgctgtggtgctacaggcaagaacgtgagtggcttcctgcccagtcgtggtcctgctcctgggagcaagccggtccagttcatggatttcgaggggaagacatcgtttggaatgtcagtgttcaacctcagacaacgcctatcatggttgcagctggcatcctgtgtgggctaggcctatgccatggcccacacaggggtgtcatcttcttccttggccctgcttgcttgtgcatttgcgcttctgtctgtcctactccatccacctccttgcttgaccttgtgctggtattgcatgtgcatccgagcctatgagcagctggttgacagagggcattctgggcctgctggggaaggtatgtggtggccacatgtcatctgtctgcacaatgttgggtgccatgtccagtttacctgttcatcatcaaatctgagctccccctggttatcggcactttcctgtacatttgaccactgatgggggactggttcttgaatgggaaactcctcaatcatcatacgtcagtgtgttaatcatcactgtccctcgcccctcattgaaaacacttgggctacccctgggggttaccacctaggtggatctcgtcctcgtgagcatagcaatgcatgtagtcacatggacaaacgggcagatcttaaagcagaaggtccaaacattgggctggacacatacgggcaaaggagagagaccaagcacggacgacgtgaaagcccccgaggacatttcacaagcgaggagaaaaaaagaaggagaggaggaccaactgtaccaaggtagacacacagatgcgacacaaggggcccgcaacgggagaagagagggagggcaccagatagggtgccagg

SEQ ID NO: 720024 - DNA, 103 bp, Homo sapiens
  misc_feature (27)..(27): n is a, c, g, or t
cagcagcctctacagccggtccaccgntccgagtggacatcgtgcgcgaccgagggaccctggcccgcgtggtcgatgaaggctttgtcgaggatgtttaccg

SEQ ID NO: 720025 - DNA, 441 bp, Homo sapiens
  misc_feature (26)..(26): n is a, c, g, or t
  misc_feature (30)..(30): n is a, c, g, or t
  misc_feature (41)..(41): n is a, c, g, or t
  misc_feature (43)..(43): n is a, c, g, or t
  misc_feature (51)..(51): n is a, c, g, or t
  misc_feature (73)..(73): n is a, c, g, or t
  misc_feature (81)..(81): n is a, c, g, or t
  misc_feature (101)..(101): n is a, c, g, or t
  misc_feature (106)..(106): n is a, c, g, or t
  misc_feature (125)..(125): n is a, c, g, or t
  misc_feature (135)..(135): n is a, c, g, or t
  misc_feature (150)..(150): n is a, c, g, or t
  misc_feature (156)..(156): n is a, c, g, or t
  misc_feature (165)..(165): n is a, c, g, or t
  misc_feature (168)..(168): n is a, c, g, or t
  misc_feature (178)..(178): n is a, c, g, or t
  misc_feature (196)..(196): n is a, c, g, or t
  misc_feature (201)..(201): n is a, c, g, or t
  misc_feature (217)..(217): n is a, c, g, or t
  misc_feature (226)..(226): n is a, c, g, or t
  misc_feature (242)..(242): n is a, c, g, or t
  misc_feature (267)..(267): n is a, c, g, or t
  misc_feature (293)..(293): n is a, c, g, or t
  misc_feature (299)..(299): n is a, c, g, or t
  misc_feature (311)..(311): n is a, c, g, or t
  misc_feature (340)..(340): n is a, c, g, or t
  misc_feature (361)..(361): n is a, c, g, or t
  misc_feature (366)..(366): n is a, c, g, or t
  misc_feature (374)..(374): n is a, c, g, or t
  misc_feature (429)..(429): n is a, c, g, or t
tattattttaaaaattttaatgaaantcancgttgtatatnanaatgtcanaaatttcattaggacaacaatnaaaaaaancgcctatgcacgggaaaaangaaanaggagttttcacagcaggnaattagtgcngaatcagtgactccngaagtngttacagcngcncttgcgagangttgcattttcctctgcnagggnacactgcttggggggnttaatattntttttttctcccttanaatttgatgttatcaaagccaccantaacattttacttaaagtttttaggngaaacncttcacaaagtnaaaagtgcagaacttctagtaattaagancatttcagaagtgcctgaaangagtnccacaagnggatgagtttgctttttccattccattaagttcgggagaaattttaaagagaggnatgccagtaacc

SEQ ID NO: 720026 - DNA, 286 bp, Homo sapiens
ttttggggggggccgggaacaaggggcccttaccctgtgtggtgggcggggcctgcccccagccccccagcctggttttttccctttaggtttggggccctgggtggggtaaccttcccttttgtttggccctgggctggcccttaaggggggggatgggttttttaaaagaattccccttttttttggccaaaaatcccggttatatttttatgtggaattaaccccggttggcccccggtttgtttgctgaaaatgtggaataggtaaaatgaaataactggga

SEQ ID NO: 720027 - DNA, 453 bp, Homo sapiens
  misc_feature (41)..(41): n is a, c, g, or t
  misc_feature (133)..(133): n is a, c, g, or t
agggtaaagctctataaggaacccaaccttgggcgaatttntggggtgatcattaacacacccaagcgaggggggcgtcttggtgtattttgcttctcccaaaaaaacataatttggtccaatctccagtatnaatgcaatcacccagggcctgaggactttgacccattccggaggcagttgctccagggaagggtgtgaggaggaggcccccaaattcaaaattcaaaattttaacccctttggccttggggtccatcctggagaccctgaggtttaagctacagcccctcagccaaccccagacccttttttggctcccaaaaggagttcagtcccaaaggggtggtccccccccccttcaggggatgagaagttttcaaggggtattactcaggccctaaccccaggaaaaatgacagcccattgccataaagttttggttgtttttta

SEQ ID NO: 720028 - DNA, 653 bp, Homo sapiens
cggtgtcggaacttcgttgcttgcttgcctgtgcgcgcgtgcgcggacatggcctcaaagcgattatacccaacaatgtaacccaaagctatggggcctaccccacccatgccgggcagggactattcccatgcagagcagtcagccctacggacagtcgagagttacacgtggttatagccagtccacggacacttcaggctatggccagagcagctattcttcttatggccagagccagaacagctatggaactcagtcaaatccccagggatatggctcgacatggctggcatatggcaggtagccaagatgctcccaagtcgtcgttacgaggcagcgagtcctctctaccctggcctatggccagcagtccagtgctccctgacagtcacctcgggaacgttaccggtagcgagttcgtcagtagcagacagctattggcgcagccccaggatgtcgggagcttacagtcgcaggcagctctaggctacttggtggtacacgccagcgagagcgtatgcgaccacgcatgtcgaagagcgtattcatgcccgccctcacggcgcttattggaccgagtcgaggaactcaagttacgaatcacgcaagccagtgggctgagtgcgacggatgtcaccgtgcgacgtgtg

SEQ ID NO: 720029 - DNA, 145 bp, Homo sapiens
gaatctggacgtgacatggtagatatcacccaggagccaggttttggataccatgttagaagagagcatgcgtgaggatcaagaaccatgtgtcgtgcctcaacacatattgcagtcttcactgggaattaatccacacgtcata

SEQ ID NO: 720030 - DNA, 222 bp, Homo sapiens
ttttttttttttaaagggaaaaaaattttaaaagggggccccatttgggggcccaagggataaattgttttggggggggtaaaaaaaccttttatttgggggtttcccttttttaaaaaacccaccccggaaagcggcttgggcggattaatttgttttttttccccggaaatttttttccccccgcaaaaaaaccgggggggttttttaacccctccaagg

SEQ ID NO: 720031 - DNA, 1786 bp, Homo sapiens
  misc_feature (498)..(498): n is a, c, g, or t
ctgctgtggtggtgtgcttacttctttgctacttgtcgtcttttgttttgcggtgtttctgttttgtttttgtgttttggtcgttcattgtttttcgttttcgtgtgttttttctttccttgtcttcttgttcttcttggctagttcttttattctgtttgtgttgtgtgtgtctggtgtctgtgttgtggtgcgtgtggttgtggttgtctgtgtgtggtgtttgtttcgtcgttgtgctgtgttgcttttttgttgttgttctgtttttgttgttcctctgtcttgccgtctgtctttggcgatttgttatatttgtgtgtttcgcgttgcttctttgtgtgtgtatttgtggtttattgttttcttgttgtgtttttggttgtgggtgtgtgttgtcgtgtggctgtgtcggttctgtgttgtgtgtgtgggtttggtttgctggcgtgtcttgtgtgttcgtcttcacacagtcggtctgaggtgagtagtgcntccggggtcacctttgtttagttatatctacgcctctctgtgtgttgtgggtggttactattccgacccaccctcgcctcgtttgttgtgtggtgcgcgcccacactcttaatttttgggtgtctcctctctgttggtgttgggtcctgcacaccactccaaccgttgggtgtgtgttgttgcagcccatattatatggtactagccgtggctggtgtggtttgtgttgtctgctcgctgtcgtcccccctgcgctgtgttgttttttacctgcgggtgtgctccttttggtggtttgtgttgcgttgcgctctcggcttggggggtgtctgacgattttttttgtcccgcccctcgcgtggcggtgttgtgattagatgctgtgtggtgtgttgttttggtgttttgtgtcgtggcgctccatccgttgggtgggcgattcacttggctcacacatgaggtgtgtggtgtggggagacgccccgccgctgtatatgtagttgtcttctggtcgtcttctattttgtggttgttttctcccccctctttctcgctgcgtgtgtggtgtgcgcccccgtgggggtccgctgcctctgttgtgtgtgtgttcattcctctctcttgttgtaccacggcggcgctcctccctctttattatgagagagagaggtggtgtttacacacctctgtcctcgtgtgtgtgtgtggagagtctctcctccgcgtgttgtgtgtcgccaccacaccaccccttgttctccccagcgtaagagtgagagtggaggttcttgtgtgcccccgctggggtgttgtgttgtttttgtgtgggacacaccccctctctccctgcgtgggtgagcgggcggagcacccttcttccgcacgggatttctctccccttttttttttctctctcgcgcgcctcttctgttttcttctagagtattctctccacccctgctgtgtgtgagagagaggggtgtgtttctgggggggtgcgcgcggtgggtgttgtgtgtggtggtggcgcgccacatgggtgttgtgctctggtttttgtgtgggagaagggatacacacacacatgagtgcgccccatctttgttcttcccggtcttccaaagagagtgttttgtagtacccccgcggcaccctccccccatttttttttttttgtgagagagagagatgggcccaggcgccccaaaaagaatttttgtctttttggggaagagtggtccccgcaccccacaggtaaaaaatagtgtaggtggcccccccacaaata

SEQ ID NO: 720032 - DNA, 399 bp, Homo sapiens
ttctaagtattttacttagaagtaagtggtattgtaaatgggattgttttcttaatttctttttcagaaagttcactgttagtgtatagaaatgtactgacttttgtaagttgattttgtatcctgcaactttcctggatttgtctaattcaaatggtgttttggtacagtctttgagattttcaatatgtaagatcatgttgtcagcaaacagagacaatttcatttcactctttcctatttggatgtcttttatttctttttcttgcctaattgctcgggctaggacttctggtactatgttgaacagaagtggtaagagcgggcatccttgtcttgttctaggtcttataggaaaagccttcaacttcttaccactgacaacggggtaccgagctc

SEQ ID NO: 720033 - DNA, 302 bp, Homo sapiens
  misc_feature (5)..(5): n is a, c, g, or t
  misc_feature (25)..(25): n is a, c, g, or t
  misc_feature (56)..(56): n is a, c, g, or t
  misc_feature (94)..(94): n is a, c, g, or t
  misc_feature (113)..(113): n is a, c, g, or t
  misc_feature (182)..(182): n is a, c, g, or t
  misc_feature (244)..(244): n is a, c, g, or t
  misc_feature (268)..(268): n is a, c, g, or t
  misc_feature (293)..(293): n is a, c, g, or t
agtgntggaggtggggcctaatggnaggtgtttgggtcatggtggaagatccctcntgaataaattaatgccctctctggattgaggggtgagntgactatcgctctgttaanttttgtgagagctggttgttcaaaagaacctggcacctcctccctcaccctcttgtttctctcttgccntgtgatgtctgcatacactggctctcccttcatcatctgccatgagtggaagcagcctgagncccttagcagaagcagatgctgcnccatgcttcttgtacattctgcagnacagtgagc

SEQ ID NO: 720034 - DNA, 104 bp, Homo sapiens
tatctcgatcgttacagcaagcttgcggggtaactgagcccccctctcctccccttcctcaaccactggacgtttatatattattaggcagggatgaaatggtg

SEQ ID NO: 720035 - DNA, 816 bp, Homo sapiens
gtttcacccaaggctcctgtgaccactacatggctatcgcctgtgttccctcaaggccctagccctgtacagtcagcaggtggcaaagccagacaggcttatgtccttctccttaggacggtgagttccccaggcctcaggttggtatacagatgccatccatgagccagggattggagtaaaaatccttagaaatctacctggtgttcctttgcactgcagctgagctggcactcaaactacaagctagagcccttcccactcttccatcccctttccacaggcagagcagcctcactctgtggccaccaccagcacgggcccacagggagtgctgtcagactaccactgaggttccattaagggctaagagctcttcagtcagcttgtggtgaatgttgcctggtctgaggctgactcttcaagactcacccagggcaggtccagcaatgtcatccacgagccaaggcctggaatcagggaccccaagaggcttcttggtgctctatccctctgtggttgagctggcagctgaggtgcaagacaaggtcccctttactttttcctctgttattctcaagcaggtggggtctctgaccgtaaccaccacagctggcaagtgtgctgtgttacatctgaagctggcatgtctcagagtctcacccagtgccatcgcatactacctggggtactgctgctagttattcagggtcccaagggttgtttagtcagaaaggcgatgggtcctcgcattgaatgattcttcgcttcaagccagcaaggtctggttggtccagaatgtgtcttagaaatctc

SEQ ID NO: 720036 - DNA, 901 bp, Homo sapiens
gagtcttgacgtgagctagctggcatggcggcctgcattgcagcggggcactgggctgcaatgggcctaggccggagtttccaagccgccaggactctgtccccccgccggctctatctgcctgcaggggtccaccgcggggcctgtccgggcagcaagagcactgggccttccagagcccgggtgcgtcccaaccctgcgcgccgaaaaaccggtcatccgtggacaagcaccgccccgtggaacccgggaaacgccaggtccttggaggtcctgaaattcatttcctcgaaaggggaaagaaccagaatcctcttgaaattttcacaatacgacaccgcacacaggatatgtttagaacagggagaaaagtactccaacatctccagaagttctatgttgtggaagtttttctgtcgggtgttaactaacaggttggacctattatgcccagtggaaaaaatcaagccagtttttctggggattttgcattcaggagatcaggaaagacggactgtgggcctactttcaatcctttagggaaatgttactcgaagggacacggttgtcgaagaattgtggttggaactttataatcctcgggttcagggagattccgggtggtcaaattaagagaaacgggtgggatgatagctggctatacttaagaggatgccttcctgaatataggcactttgggtgttgatatgaagaccgttgtaaagagcttaacaaaaaggttccgtaagagcgaaagtaacatgaagctagcctgggtaaaaggggacgccacttttatattaagaacacattgccttggtgactgagcatgaagagtccagtgggcccagggtatgatgtggggggatatacaagaagggtgagagaggaagtgttttaa

SEQ ID NO: 720037 - DNA, 405 bp, Homo sapiens
agatgtagcatgagccagtgagatgtacagtacgtgataggaagatgaacgttccttctgggggagtatgtggatcacagaggacttcacgagtgaagctgcagacttacacggtgagtataacatctcttaaggcagcgcgtctggagttactcattcctcccatgggttcatggtcgtcggtggcctcgaggatggaggctgcagagcttcacgaagagtattacagctcataaactcagtgtgtacccaaagaatgagcagcagcaagttatctcaaagatcaaaaaaacaaaactcccatagcgtgagcgtggaagagaacctgagccagttgccactactagcgcaggcagcctgcttttattcccttttctgaccccaaccaaatcctgctgatggtgc

SEQ ID NO: 720038 - DNA, 638 bp, Homo sapiens
  misc_feature (171)..(171): n is a, c, g, or t
  misc_feature (638)..(638): n is a, c, g, or t
cggtaccggttcagtacggatgtggggacagcgtctgtcccacagaggctggctagccccagtgggtatggggtgagctgggcaggtaagagggtggactcccctctccctgtgggaggagtgtgctgggacccatgaggcacctcatccactctcagccaccttcctgtnggagccctaagcctcgcaaggccacacgtatgagtgcaaggcaggccacccacagcgactgctcccgcgttcgacaggtggggaaacctggcccaggtgtcttgatggcagcccagcacgcctgccctcgtgcttccccgcagagccttctaggggaatgagaccttcgttacacgctggcgctccttacagccctacagactttaagctaaggcctccagccccatcgctgtaagaattgtatgctaggcattctgaggacatagatgggggtcccatgtcggaaggagccaaggtgttggaactgggtccagttcctgggctggctctggtgggagatctggaaccctatgctggggctcctggacagccctggaggcatggcatggacagtgtgtcagccgcacaccgaggccctggggtgtccttattcacataggctggcagccatctatccctagcccggn

SEQ ID NO: 720039 - DNA, 187 bp, Homo sapiens
ggttctgtcaaaatgcgcaccaaatcagacaccgtcaattcatccaaaaccgtcacaattggcaagcgaccaattaaattctggaatcaaaccaaacttgattaagtcttctggttgcacatatttgagaacattgtcatcgtccacgctgcggcattttcattagcaatgcgagccaaagccaatc

SEQ ID NO: 720040 - DNA, 278 bp, Homo sapiens
  misc_feature (3)..(3): n is a, c, g, or t
ggncctcccactggttgctggatataaaatcaatgtatacaaaaatcaattttatttctttttttgatggggatggagtcttgctctgctgcccaggttggggtgcagtggcacaatttcagctcactacaacctccgcctcctggtttcaagcgatcctccaacctcagcctcttgagtagctggaacaacaggtgtgcgccattatatcctgctaattttttaattttttgtagagaccgagtctcattctattgcccaggctggtctcaaactcc

SEQ ID NO: 720041 - DNA, 266 bp, Homo sapiens
agaatctgctgcatagcaatacatcgatagtcggaggcttcggcaagagactaggtgcgcctaagtaatcggtgcccccgatatggcgtttcgccgcataaacagacataagcttctgactcgtcagctccctctctcctactccaggtcggcatctgctataggggaggccgggagcaggaacagggtgaacagtctaccgctccgcttagcagggaactactcccagcctgaagatggttggtgggcctgaagatgttggttgg

SEQ ID NO: 720042 - DNA, 138 bp, Homo sapiens
agggtcctagagatcccacactgggtcgagtctctgttccagtaacagatgctggttttgttttgtttttttttaagacaggtctcgctctgtcacccaggctggagtgcagtggtaccatcagagctcactggagcc

SEQ ID NO: 720043 - DNA, 116 bp, Homo sapiens
gcgagggcagaaaggcagaccagtaggacagatagctatagactttagtataccaacattccattttaatgtgggattggcacagtagttttcaagatggattgcttcagacttat

SEQ ID NO: 720044 - DNA, 116 bp, Homo sapiens
gcatctaataagaaaacccagcccaagaccccaacaggggccccctcagcccccccaatgacccccggcccagccaagtgatgtcacttccaccccaaaacgcgcctcatactagg

SEQ ID NO: 720045 - DNA, 131 bp, Homo sapiens
ccgaatctaactacacagggttgactgtacttatcccctttccatatttggagctctcttttatgaccatgagaaacttgactccattatcctcatcataatttatttcctgaatgcgtccgtcgaagttg

SEQ ID NO: 720046 - DNA, 289 bp, Homo sapiens
ggcccctttcagagacctcaccctaaaaagctattgggagattactgatacctccaactcacgtgattcattgaggccatgccattcaatgctatgttctcaggaaatgtctatgagtcctctcaaccattgctgttgataaaataggtgaatgtcaagtgggggttagcatttgataaggtgtatgtttgaaataatattttatcgtctcttgttcacaaatacaacatataattccaagaagaaagagagaagtagaaattcagcatccttaagatgacagcaagaa

SEQ ID NO: 720047 - DNA, 1127 bp, Homo sapiens
  misc_feature (763)..(763): n is a, c, g, or t
  misc_feature (1124)..(1124): n is a, c, g, or t
gctaaatgtcatgtatttttcatggcccctccaggtattgtcagagtcctcttgtatggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcagaatagaaaggccanggccaagcctgtgaccgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggacccacgagagagaatcgttcctcagcctcatggtgaactcgcgcctccagcctgatcccccgctccctcctccctgccttctctgctggtaccagtcctaaaatattgctgcttctcttcctttgancat

SEQ ID NO: 720048 - DNA, 1574 bp, Homo sapiens
  misc_feature (1210)..(1210): n is a, c, g, or t
  misc_feature (1571)..(1571): n is a, c, g, or t
gctaaatgtcatgtatttttcatggcccctccaggtattgtcagagtcctcttgtatggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctcttaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcagaatagaaaggccanggccaagcctgtgaccgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggacccacgagagagaatcgttcctcagcctcatggtgaactcgcgcctccagcctgatcccccgctccctcctccctgccttctctgctggtaccagtcctaaaatattgctgcttctcttcctttgancat

SEQ ID NO: 720049 - DNA, 196 bp, Homo sapiens
tgagttccaagagggcctcaggcctccaaccacaaagtgcagagaagtcagccccagaatgctgacagctgccggcggggaggctgagagtgcttgtgttgtttgacagactgagtgtttgtggtgtggatgtgagtattggagtcacacatgagtgcttccacccatgcaatggccatcatggccatgggagcta

SEQ ID NO: 720050 - DNA, 388 bp, Homo sapiens
agaaaggaatgagcaatgggtttctagaaggcaaggtctttgaaggaggaaaagtgctgctgctttcagaaggcccctagccttgagaaggttccctgccggtattggtttctacctgggaacaggtggggctaaggagggaaggaaccaccctgtactgatgtctcgtgtgtgctgggtattgtcaggcactccatggacacaaacagcccaatgtggtgggcactgtccccttttccagatgaggaaactggcccagagagggtgggtgacttgtctggaggtcacacagccagggaaggggcagaaccacaatcagcacagacaggcttaaatggcagatcttcacagcttttgcccttgagggagcaggaacagcggggcagtg

SEQ ID NO: 720051 - DNA, 1381 bp, Homo sapiens
  misc_feature (593)..(593): n is a, c, g, or t
accaactttgggcacacccattccacatcaacaggtggccatctgcaaatgcacagggtggcatggcacacaagcattcatccaagcaaacagtcttgcacaagcagcacagcaggcaccaggcctctggggctgtctggcaggcacacaacagcccatgcaatggccatgcagagggcacacacaaccagctttgtcagcacagcagcacagcagcacagggcaggtgccagggctaccccaccacacatccaagggcaggcagcagatctcaaagcacagagcatccacactgtcacaccatgccacacacagcacacatcacccaagcacaggcatgcacagggctctacacaacagccgttccattgcatcacagggccacatctcatctctgtgcaacctcctctaaagccaagtgcgcacaatctatatcaagctcagactggcggctctcacaagcaggcgcaacacacgcccagagcatattacagaaaacatcagcacacaccgtggtgcagacctaattgcaagtctcattatcccagacaaatcataggtaggatgcgtggacacagaacagcaggcaaccnagcaacccacacatagcacgctcaaggtcgagccccatgggccacacgttggcattctcacccacaacaggctcaagcaaggggggccacagaccaatgtgttggcgttccccagctagcagggcggcttctcttctgccaacaaaaccaaagccacagaccgcaacgcaacagaattgcacgattggacgggacaacactcggcgtcaccgaccccaacacatggagcgaccaacgagcaacgactataacagctacaacttccgacccttccaaacgcccaccaggaggggcaggaacaaaccacggccaacacagacacacgaggcaacaacacagcgaacatcggggcgggacgcaacggggcgcacaatcgacacgaacagaaccggagggggcaacacacccgccctgggcgtgaatcgggaggcgaccaccacacaaacacaacgtgggttaggtcgcgcagcatgcggagggtgggaaccgtaccatggacacaccagcacccaacggcgggcgccagcggcaccaaccgtataagcgtcgacagcccaccacaattatcacacatagggtacaccatgcatatctgtactaacgaacacacacgacagagtgcgggtggcgacagtcaccaccaggcgaaacatcggcatccgaccacaacccaccacaagccagagctcaccacagaagacggatgcccagccacaacacgacaccacagcgcggtgcccacccaaacacatacggctgcctcatccgaacctactacaccaaaagct

SEQ ID NO: 720052 - DNA, 185 bp, Homo sapiens
caaaaagaaactaatcatctggaaaacgatttcaaaggcgatggcatgacagagctagagctcgggcccagcacaggctgcagcccattcgcaggcacccgaaagaacttccccagtatggtggtcctgaaaggacaattttgaagatcaactatatcttccagtgcattccgatggaatttcag

SEQ ID NO: 720053 - DNA, 573 bp, Homo sapiens
gatctcaccttaaatggctggcggcaaggctgtaaaggactccggaaaggccaagacaaaggcggtttcccgctagcagagagcccccttgcagttcccagggggccgtttttttttcgcgcggaggctaacaccaccagccatggacgtaaaagcgcgactgccgttttatacagtggggcatactggagtacctcaccacagaggtactttaactggccggaaatgcataaaaagactcaaaggtcaatctcatcacccccttctaaatggcaatttgctatatttgaaggttatcaattgtactctttcaacaagggcacaaccaccaagggccaacccccttcataatgccatatagtttttattggaaatatgaaaaatatcatcctttcctatagaactcctcgtttcttgttatccacggccctttaaactagcagacgtgtgaaaatttctaatattataatcacctaacttttccgaccataaatttttttactctctctcccatcccccgcgccgctcttttttctctttttcttgtcctcatttattttatttaacataaaa

SEQ ID NO: 720054 - DNA, 1183 bp, Homo sapiens
ggagtgcaccgatggctgagcttggctgcttctgggtgcctgtgtgtgccctgtgtgtcggaaagatggagcaatgaagcctgagcccgaggggtggctgagacccctctgacctgagatcctgctgctttctgcatgccagtgagcactgtcacctcccctggattacgtgcggtacgagctgcccagtgccctgggcctgtgagagtggaattggtccccgatggcccagtggcagtcgatgcttactgcagctgcacctgtgacaggaaacatggggagtcattgagaggacccccgactccaatgcagcgaaaaccccggatggtgaggagcaatggcaaatgtgcaataccaacatgtctgtacctactgatggtgctgtacaccagcctcacaagattccagcttcggaacaggagacccatgagttaagaaacagaaggaacaatatgctttatgaaggttactttaaatgtactgataaggatgacacaaaagatgaagaggttacttacttatgaacaagaagggtaacatatagtgtatactttggggcgagataattagttactagagctaaagagggaattaaattattgcattgcgggaaaaggcagagaaaagaataaattaggtaatagtatggtacagaagttgaatgcgttcatacgggacgacgtaaggaagtgcagcgagtgaccaaaagaatattcggatattgagaagagagaagcaggcaaatagaggaaacacaataattattacacaaatgaagtataagaaggagaaagatgatgagaaaagataaggaaaaaaagtaaagacaaaggaaaattaagatcgagaaagttcaaagggataaaaataattagatagagattgaaagaaaaagaaggaatgatacgaaacaccatatggacaaaaggcatattggaagaacaggatgaagatccaaaacgaagaagaacaaccaatcagagcacgacacagagcaagagcatatacacaaggaaaaaagaaaacatacaagcgatagcaacacgatacaaacgaatatcaggaacaaagaagaaggacacaaaactaataacagacaatagaaaaagatagaacaaggaaaaaaagacaaaaaaaaggtaggagacaaaaagacaagaaaaaaaactaaacgacaatcaaa

SEQ ID NO: 720055 - DNA, 273 bp, Homo sapiens
tgtcatttgggccccgagctttgaccctcgtgtttgacccggccccctctttttggaggggctgaggacaaatgtgcctgcttgtggaaaccaggctgggcctaaacgaagggtcatcccagccccagcccggagggtggagcccttggggggtggtcgggtgggatgagcgttttccgctcgtggtgatgtcaggagctcctcggagggaacaaagcggctgggtatgcagcctgcaggtttccataccctgaagcttttccccccccttta

SEQ ID NO: 720056 - DNA, 85 bp, Homo sapiens
taaaaaaaaaaccccccccccgttatgctttcctttggggggaaaactcccttggaaaaaaccccctttttttttttgggcccca

SEQ ID NO: 720057 - DNA, 164 bp, Homo sapiens
tgttatcgatgccaccggcagcctacatgcgcaacggtgagttgttgggtatatacactgtggtccatacagtggaatattacaggcaataaaaggtatttttagagggaaaaaaaaacattggaacacgcttatgatataatgttagggggtaccgagctcgg

SEQ ID NO: 720058 - DNA, 272 bp, Homo sapiens
  misc_feature (10)..(10): n is a, c, g, or t
  misc_feature (13)..(13): n is a, c, g, or t
aattcgcggncgngtcgaccatcatctttgtccatttcctgtaaaacagcttcaacagtgctatttactagttgatcaaataacaaactctggttcacactttgaaatctgtttttcctggaacgacaattttttctgacttccatgtcaccatttatacaagaaaggcccccatctcctttctatgaccatcgaaggggatggcttctaagggataagccactatgtccattaggtaatgtattactagtctgagaagttaacctgttctg

SEQ ID NO: 720059 - DNA, 501 bp, Homo sapiens
gtgcatactgttcctgctcctggtgtctactctgaagagcacagagtagacgtatgtctgccatttcaccggcagtaagatcagcagctgctggtgagcaaatgaggtagtagttggtgtcactggactggtgtgtgctgcctggggcctgctgcgctatatggagaggtcatgctgtgctgaacccagctccattgcctagtctacgtcagaccgagcgcggaccctgccggcctccgttctcttccgcttgtctacagatatcatctactatctattttgatacacttgtatccttgatatgttgacatattgttgcaagtagttaaatttgtgtgcctttttgttcctgaagaaagaggtacctgggatctttgaaatgctaagattcttggataccacagtatacactaaaatatcctactaaattgcatattggttgctacgcaataccccttactacttgtctaggcctactggatactagccttgagagttacc

SEQ ID NO: 720060 - DNA, 118 bp, Homo sapiens
atttccaaagcactctgggcatgtctaaacgtggctgactgatggctaattcatagattgcccgtgctttagatgtagactaccgaaatattacactctggctgaaatacgcagaaat

SEQ ID NO: 720061 - DNA, 167 bp, Homo sapiens
  misc_feature (13)..(13): n is a, c, g, or t
  misc_feature (46)..(46): n is a, c, g, or t
  misc_feature (80)..(80): n is a, c, g, or t
  misc_feature (95)..(95): n is a, c, g, or t
gttcgatccctgnccttgctcagtgggttaaggatcctgtattacngtgagctgtggtgtaggtcgaagatgtggctcanagcccatgttgctgnggctctggtgtaggccagcggctacagctccgatgggacccctagcctgggaacctccatatgccgtgggtg

SEQ ID NO: 720062 - DNA, 345 bp, Homo sapiens
accatggcagttttaaaaacaggccggatatggtggctcatgcctaataatcctagcactttgtgaggcagaggtgggaggatcgcttgagccctggagttcgagaccagcctgggcaacatggtgagatcctgtctctacaaaacatccaaaaattagccaggtctcagacatgagtgtacagaagccatcttggagcctccagaccagtccaaatgacaagtagataccaccaagtgaccctgtcaatgtcatgtgaaaaagaagaattgcttaactgtgctctgcctgaattcacgatcgacaaaattgtaaaatataataaaataatcgttttaggccaaa

SEQ ID NO: 720063 - DNA, 200 bp, Homo sapiens
acatcgctggggagagtggctgcccccacgcaccctggctgggaccaggaccatcagcacttctccatcaccaggctgagccaggatggggtgggtggtcgcagtatgtgaaaaggggccaaagatactctaatgaaagccacaggaagccacaccccattaggctgctgcctgggccgtaaggccctagtaataccccc

SEQ ID NO: 720064 - DNA, 348 bp, Homo sapiens
  misc_feature (5)..(5): n is a, c, g, or t
  misc_feature (13)..(13): n is a, c, g, or t
  misc_feature (109)..(110): n is a, c, g, or t
ccccnccctcagnccacaaaaaggtaccacctcatccacagacaaagggataacaccccattaattggtgggcgatggctcgtgttatttttgaggtgatgcttgttgnngttggaatgatcatcttaatttcttactgtattcgatgactgataaaggcatgaggatgtggcctgcatgctgcctgatcttgcctagaaccagctgcacctgctgttctcttgcttatgcaaactggctgcacctgctattcctttgcttatgccccaacccttggctatcctaactccctgttctcctgcctattactgtattctctacttctaaataaaaataaaacaaaataca

SEQ ID NO: 720065 - DNA, 359 bp, Homo sapiens
gtgtttttcacatttgcgaatggttccaccctctctcctgtactttctccagacacttctttgagtggatgatcttccgtgaagtatactgcattctcaccttttcccttccttatcaccgacacaacaagtagatccaagagacgggtccgacaaggtccttccctttcacatactgctgtccatgtggccctatcttgttttcccactctcgctaccacaactacatcatcatcccaatgctgtcattcctctctggcggagatacagacttcttgagttttgttttaaaactaacgctaaaccatccgtaccgcattccatatacctatcacacagtgccttacgtgcccctgcat

SEQ ID NO: 720066 - DNA, 214 bp, Homo sapiens
atcaaacccgggaggcggaggttgcagtgagctgagatttctccactggcatccagcctggtaacagagcgagactccatctcaagaaaaaaaaaaaaacccccattttatgtccttcataagggtggtccataataaatagatttatgaaggcctaggtagaactgcagaaggaaaagctcccatctgtgtgtcgcgcgataacatcacgggg

SEQ ID NO: 720067 - DNA, 1535 bp, Homo sapiens
  misc_feature (333)..(334): n is a, c, g, or t
  misc_feature (365)..(366): n is a, c, g, or t
tgagatcagcagacctcttgtttaacgtgagagaatgcctgtgctgcaacactcatggagagggacacttcctggccccatctgctaaatacctccaaactctgggcaggctcctgcattctcaatcgacaggacttcccttaacagtttccggatcaatgagcaccaccacgttcaggtttctgaatgcaagacctcgaccacgatgtgtgatggattcctacaccgtcacgcgctcctgttgctagtagtacgagtgcggcacaggctagtgcactgtgcctggagagaacagctctctgagcagcagcacccttggagccctcaccccgnntcacgatcctcaccagtgctgatgatgccgnncatgctgctggcctgagacagtatcccagctacaacaggacgacaccgggttcaggaatatgtggctatcaccttgagcactgacagtggccttccaggctagttgccttccaaacgcaggtagccgacctgcaggagggcctacaaacgggcccagcaagagctgggcaacagctggcttgtgaaatgagacaccttgaccaatatgctttagggtggacggtctcctaccatgtacagtgcgaggccacacagagagcatccatgagcaggggacaggggtccacacaccttacatggcaagtaagatacagatagagggtagcttggtgcgatgggccatggcaggtccgtagaagctggaactggcgcacacgccatacccagagggctcaggatgccccagagaaggaaagaagggcaaccagactacacgataggacgtagtgtggtaagactgcgatgcacactagcgagccgaacggcgcacgggaccagacagcgcagcatggtaactgactcccagaggaagcgaagagcaagaaagacctacatggaacacagaatgaaaggacagacccataagacaatgcccaaagggaacaatcccaggcactacaggaacacacacgtgaaacaaacacgaaagaaagatagacaaggccccagggaacgacaacacacagcagacaggggacaccaagaaaaaacaatagaagaggaacgacaaaacaaccagagtagacaaaaggacccagatccaaggcagggagaaaacaaagaccgcacaaagagagtacaaacaaaacaaaagccatggatggagaagatccagcaaacgacggcaccgtagccacaagggacaacgaggacacggaaacacggaaccacaaagcgacatggacgatatggaagccaaacgagggcaaaagcactcggagaatacacagtgaaagagtgaagtacacaaaagagggatgataaatgagaaagagattaaaaatgagtaacaacaagtgtgaacacaacttaaacacgatgctgacagaatgcgatcacaaaacaaccacatacatgaacatctcataaaaaaacaactatagagaatgaatataaacaacgacgtgtatacagaacaaagagatggaggagaagtaccgcgacaaaga

SEQ ID NO: 720068 - DNA, 264 bp, Homo sapiens
cctgagtaactcattagagagtagctgtgagtgttccctttctctcagtctgtgaggagggaacacacattacacagcctgctggaccatttgacatgttcctgttcacattccccttggcaaactagcctgtgttcttctcaaatgccccgcggcatgctagcatttcattccaattgatcgcatgtatttgtgattacattcgaatgagttaagttaacccaagctgacaatcaaaggctgctgtcaaatgtgtgtagacgc

SEQ ID NO: 720069 - DNA, 829 bp, Homo sapiens
aaaaatattgtatttttaatcattcatagtgctggtaaaaaaaaaaaaaaaaaaaaaaaaaatggggggggggccgggcgccaggggctcacacctgtaatcccagcacttgggaaggccaaggggggcggatcacctcacggcctggtaatcccagctaccgggggagggctgagggcacaagaaattggcgttgaacttggggagggcaagagtttggtaagtagaggccaaagatcaccgccactgggattccaagcctgggccagacagtggtgaagacgggtgctcagaaaaacaaaaagaaagaaaagaaaagaaacaaagaaaaaacacttgggggtaaattattatggtgccacagcttaaagtaacctggaaacaagtttccgggaaatatggtgtattatttttatttttctggaagagaggcaagaaggagtcgtaaaaccacgagcgcttcataaagagatagcgcattataaaatggtgtctctggtaccagagacaatatagaggtttaatctccctttgataaccactctggtgaggaaagacgagtttacaatataacacggatattctataggattaattaaaatatttgggggggctcattttatatataaagaaagacggtataaacccctttatagcacacacaataagagcgagtggcacatcaagggggagatttagaaacacatcaagaaacttgggggaaaaaaacccccaaaatcaccgtgagaaccatcccccaccaaaatcacgtggcgttaaacaaaagagaaaaaaataacacagacgatgtgaatcacaaaataactgg

SEQ ID NO: 720070 - DNA, 358 bp, Homo sapiens
cccatgatccctttgaattgttttactttccgggaacggcttttgcttttaaaaattgaagaagttttaaaccgggctttcatttggtcatccctgcaatcccttggggtttagtttggaatttgcccactggaacaaaaagaccctttaatccggggcctgccttggttttggtgctgctgctgcttcccaagatcctcagcagggttttagaaggaacccggtgtgcccaccagatcccccaaattggtgggctttccctcctggccaattgttgggtctttcccctttctgttcagggcccctaaatgtttaaatgtggatgcatccccaaattaaacccattccttgtgttcta

SEQ ID NO: 720071 - DNA, 105 bp, Homo sapiens
tcccgaggagggtgtccttgggcagagctgtgcagcagagaacctggagatgttgaaaagagtatcaggatgtcatatacgttcctacactctcgaccaatatag

SEQ ID NO: 720072 - DNA, 132 bp, Homo sapiens
  misc_feature (7)..(7): n is a, c, g, or t
  misc_feature (107)..(107): n is a, c, g, or t
  misc_feature (126)..(126): n is a, c, g, or t
tggcagngggagtcgaagcgagggtctgaagttcacgactactagaaggggaggggagtggaaaggctctcagtgaggtatggaacccttcagatcgcttaccaatnaattcagtatgtataacanattcgt

SEQ ID NO: 720073 - DNA, 145 bp, Homo sapiens
ttcattatcgtacttacgatataattaatttcttcttcagtcgttaatgagctgaaactaaatcttacagattgcttcactctattatcttcaccaaacatcgcctctagtacgtgtgatggtaatgttgaaccggctgtacatg

SEQ ID NO: 720074 - DNA, 633 bp, Homo sapiens
agcagtggctcacatctgtaaccccagcaccttgagaggccaaagcgggaggatcgtttgagcctaggaattcaagaccagtctgggcaccatagtgagaccctgcctatttacaaataattttaaaaattagtcaggcatggtgatgcatgcctgtactggggcggctgaggtgggaggagtgcttgagcccaggagtttgaggctacagtgagacgtaatcccaacagtatactccagcttgggtcacagagtgagatcctgtcaaaaacaaaacaaaacaaaaaggatcaatcttgctgggcgcggtggtcacacctataatcccagcactttgacttaggtttcaaaaagattaattggccgggagcagtggctcacatctgtaaccccagcaccttgagaggccaaagcgggaggatcgtttgagcctaggaattcaagaccagtctgggcaccatagtgagaccctgctatttacaaataattttaaaaattagtcaggcatggtgatgcatgcctgtactggggcggctgaggtggggaggagtgcttgagcccgggagggcggaggtgcaatgagccaagatgtgtgcctctgtagtcagcctggtgacagagcagactctatcc

SEQ ID NO: 720075 - DNA, 190 bp, Homo sapiens
gtaatcctgtactctgggaggccagaggcaggagccacaaaaattcgaggccagcctagacaacatgacaaaaccgcatctctacaaaaaatacaaaaatcagccaggcctggtggcacaggcatgtagtccctgccactggggggtgtgagatacgaggatcacttgagtctgttcggttgagcggaga

SEQ ID NO: 720076 - DNA, 1062 bp, Homo sapiens
atgaagtactcctatttgccgcacatattccctgagatatgacttgatcactttctgatgatcactgtcttctaatgttctgactatatcaggagccaaataccttggttatgatccatcctccgtagaaggtgcgatacaaagggactgaaattgaaatagtaaatcactctgcatgactgctcgatggagtagaaataagactcggatcgtggcaacctaatccataggcacaatggcatacaatcacgtaagtccatcaatacagccgcgtcacatctcagctaagttggatcattctgaacataaaagaaaagtgcatgatcgatcagaaccccgtatcgcgttgagctatccaaatctaattgggagcatccattagcggtgagtgatcacgtgcagacagttacaacaggcagaacatgcggaggttacatgtctataaataggaccatgatatcccccgatgtatttgctgaaatattgctagggcgccgcgtgttgacatcctatagtagcgttgtggacgcaatctgccgttgatactcccagaaaatgattgggctccacaatatatgataataaattaattaacatcccattgcacgtcattgcactcatgaagcttgtccccaacattaggcttaaaaaccagatgcaaattcccggacgtctaaaacaaaccatttcaccgtaacacgaccgggggtatactacggtcaatgctctgaaatctgtggagcaaaccaccaagtttacatgccccagtccgttccctaagaaatttaaatttcccccgtaaaaaaatcttttgacaagtaggggccccgtaaatttaacccctaataagcaagcccgcttctaaccccttcttagaaggcgaaagaaaaaaagagaaaaaagcaaagagggagtgcactgaacacaaacagaggggggggcggtgcaaaaaataacacccacgggggcgcaaataaaacaacatacaacggtttatagaaaaaagaggggcccacaaagaggggggacaaaaaaaaggggggggggagaaaaaaacagacg

SEQ ID NO: 720077 - DNA, 418 bp, Homo sapiens
atgggtttctgcggcttcagaccctaattcttgactgccttcgacgttccttctacctatgttagacttccctgtgctcctcacgccctatctgtatagaccagcactcctagagccagcctgaggatctgtaagctacctgagcgagctcattcaccactgttgcaaggtgacacagcccatcacagacattgaccttcctttctcctagtctccatagtcctagccttaagtacgtcagcatgacccgaggacgttttctgtagaattctgctatgcctgagagtggctctgtgtgtaccagcctctttcgaccattcttttgttgtcgcaccctgatctgatgccacgattcgtcccacagatgcactgctgcttggattctcattggtcagagatctgcacagcatgactttcc

SEQ ID NO: 720078 - DNA, 303 bp, Homo sapiens
taggtcggacctctccctacggtatcctaaatcatctctctcaagttcaaagttccacagatctctagggcaggcgcaaaatgccaccagtctctttgcatagcaagggtgacctttactccagttcccaacaagttcctcatctccatctgagaccatctcagcttggactttattgtccatatcactatcagcatttgggtcaaagccatccaacaggtctctaggaagtaccaaactttcccatcttcttctgagccctccaaactgttccaacctctgtctagagatacagtagggaga

SEQ ID NO: 720079 - DNA, 629 bp, Homo sapiens
  misc_feature (270)..(270): n is a, c, g, or t
  misc_feature (281)..(281): n is a, c, g, or t
  misc_feature (451)..(451): n is a, c, g, or t
  misc_feature (464)..(464): n is a, c, g, or t
  misc_feature (473)..(473): n is a, c, g, or t
  misc_feature (518)..(518): n is a, c, g, or t
  misc_feature (528)..(528): n is a, c, g, or t
  misc_feature (628)..(628): n is a, c, g, or t
gtcattcccagcgctgccctgtcttgcgttccagtgttccagcttctgcgagatgaccctcaaggcgagcgagggcgagagtgggggcagcatgcacacggcgctctccgacctctacctggagcatttgctgcagaagcgtagtcggccagaggctgtaatcgcaatcacaattgaaataactgtgaaccgaggacaatgtaacaaccaaacgggtctcctgccccaaggtaagccactgcccaaggtcaaagggacaaggaaggtgcnggaaaagtgcngaactcaataacaagtttgaagaaaggtcacaagaaagaagcccaatgggaaatcactctgaagagctgaaatgaaaaacgaagtcctgtacggtggccaagaagttcttcatggtggcaatgatccaaagacaaggctcccttcacgtgggggatgagatcctagaaancaatggcacaaangtgacaaancattcagtggatcagctgcagaaggcgatgaaagaaaccaaaggnatgatctcantaaaagtaattcccaaccagcaaagccgtcttcctgcactacagatgttcatgagagcgcgtttgactatgatcccaaaaggacaatctgatcccttgcna

SEQ ID NO: 720080 - DNA, 707 bp, Homo sapiens
ttgccgtggggctccttagctgactctattccatgtccagggttcacgttcgggcacattcaccaccatgagttttcggtatgctgatcacccttgtggccatctactgtgtggcctcaggcctaggaatgtgtgtgggtctgcgctgggcccctgagtggacgtactactttggccagttggttggttaatgatatcttggtcaatgtgtgtgcctagtgctcctggatgtagggtgggctgggttcctctgctagactattctactcctagctttcataggggctgtcaagtgccgtagctatggtgtccctggctagtctcatatgtcctggcaactaggagggggctacctagtgatcagactacattcgctatctggttatgtgtgctctggggcctgtctgtagtgccgtggtatgccctattccctaggtgtgctcctatcctctggtctcccctatttacataggagctctatctctaggcctatggctttgcactagtatacctagcttagttatttggtaagtacccatacctatggctcaaggtggctgaactcaaaggtcacacatcccgggtcctgagtctgaccatgagcccagatggggccacagtggcatccgacaaggacagacaagaatgagaacatgaggatatgagacagaatgattattagaaattgatacatgaaaagaacaaga

SEQ ID NO: 720081 - DNA, 563 bp, Homo sapiens
  misc_feature (33)..(34): n is a, c, g, or t
  misc_feature (445)..(445): n is a, c, g, or t
gattactgtagcaccgaatgtccaagcgaaggnnaacagaattcttcgtggagcaatttacaagtgcaactcttgccgtaaggcggtcacttttttgcgcgaggaggctttgatcgacaaaaacatcaacgtcatccccaagcttttcgtcagtactgcggattcgccacttagtgacgcccacatccgtcagatcgccggcatgatcattgaacatcaggtaatggcgctggtggctgatccgttaatgaaggtggatgcaaaacttgggacgttggggaagaccttgagagtttccgaatcggcggtaactcggcacacaaacccgagcaccctcccaggtggcgttacccatgccattatcttcggagactgccaagttgagcgtcaacagagggtggccaaggcattcgaacagcgaggcgtgattgtgcgaaaagtcagnattgcgaaggcctgaggtttcactctttacagaacaatgtccgacatcccttggtacttaataacgctcaggagagccatccgatgaatgcattgactcaatctacatctcacgacag

SEQ ID NO: 720082 - DNA, 737 bp, Homo sapiens
  misc_feature (199)..(199): n is a, c, g, or t
aggctggcttatttgtcaggaggagtgagctacactctctcaaggtcattgcaggtgaatgtcgacgcggcgtcctggctcgggagtccccgcgctctttacaacgtgggcttctgtcactaactgttaggtttcttctacagcatgtgagtcatgggttgttgcctgctggagcatgtttagatcggggcagcattcntcagtcaatgctcacgcatattcgaatgcatcatccccccacacacgctattgttaggttgcttatgtacaagatgggcctcagacctgatacagctcagctcagtggtgtctcccggtgcatctgtcaacctgagctgcatcgtgttcttcgcgctctatgatttaagcaatgtatgtatcaccgcctatgctatcatcgtgagcgttatgtggctcagtatccgtaaggtccaagaacctcaggtcaaggctaacaggcactgagccctctacactagccagtctgacctcatctgcttgactttggcatgtgagccctcctaaggggacagtatctgggtccctagaaggccttacatgtgcgccttctaatgtgccccctcctcttgccatacccgcacatcacaatggtccaaatgtgcaacacgctcgctcttttttacacacagagcctatggctctgtccccatggtctggtctcaaaagctctttccattgcccagaaaggaaaggttctgaccaataaagtttcttag

SEQ ID NO: 720083 - DNA, 307 bp, Homo sapiens
  misc_feature (53)..(54): n is a, c, g, or t
aacccccctccccccctgggaacccccctgttttttttttcagcctaaacctnntgatccagggtgtgttttaattaagggtgggtggaggggtttccagtgtgggaatttggccccccagtttacctaagctgcttcccatggttgtccattttggggcttaaaaaattgggcccccaccaagtaaaggccttggtgctggttgggggggggcccccaaagttttagttactgatttctttttcaataaatgggggtttgttccctgggtttcccctttaaaaaaaaaatggctttttgtccccca

SEQ ID NO: 720084 - DNA, 626 bp, Homo sapiens
atctataacattacgacccattctcactcttccacttgatgctgtggaagttactatgcatctaccacaaatagaactttgtatctatacctaacatcctatccatcctttaatacttatggacctggacaggcgtaggtggctcacgcctgcaatcccagcaccccgggaggccaaggcgggcagatcacttgagatcaggagctcaaaaccagcctagccaacatggcgaaaccccgtctctaccaaaaacacaaaaatcagccaggtgtggtggcgggcgcccacagccccagccactcaggaggctgaggcaggagaatcgcttgaacccgggaggtggaggttgcagtgagccaagatcgcaccactgcactccagcctgagcaacagagcaagactctgtctcactcaatcaatcaatatcatgaggaaaaagtcttctttaaaatttgaaaattaatttttatgtcagtagcttttgaggtaccagtataaattagtaatagggatgaattatgtagtggtgcattctgagatcttagtacaccagttattccagtagtgtacattgtaagtaatgtatagtgtaacatagtgtacattgtcgctaatgtaagaagata

SEQ ID NO: 720085 - DNA, 155 bp, Homo sapiens
  misc_feature (23)..(23): n is a, c, g, or t
  misc_feature (45)..(45): n is a, c, g, or t
  misc_feature (48)..(48): n is a, c, g, or t
  misc_feature (51)..(51): n is a, c, g, or t
  misc_feature (91)..(91): n is a, c, g, or t
gctgcggcaacccagaggattanaggcaaagctctacacccccantgntangaggagggtcctggcggctcacagcagagcaggcactgcnttccttcccaaggccgagaggccatgctgtgacatggcacacacacctgcccaggctgcccggt

SEQ ID NO: 720086 - DNA, 1509 bp, Homo sapiens
ggggcggtgggaccctgtatacaagtatctgaaaactggagggccttcaaggctctcatcgctgctcagtacagcggggctcaggtccgcgtgctctccgcaccaccccacttccatttagtgccaaaccaaccgcacccctgaatttctccgccaaatttcctgccggcaaggtcccagcatttgcagggtgcatgcatggcattctgtgtgtttgcagcagccaacgccatatgcctactcatgtgagcacatgcaggagctgcggggcaagtacatccagaaggcacgcagcccaggatggatgcagatgggtgagccttctgctgattccagatctagtgcccccagcacagatacctggagatgtaaccaccaaccttgaggccatcatgcacccaccaagcaacagcacggccacatgacgaactgcaaacggacggaaagtgacgcgcgacactctctcggcggcctgctgggcactgcctctacctctgacacgaccgacggacgcttactcctcggatggcgcagaacagcgaacgctgaccactaagagcctagaaccatcaacagcatagtcctagacaaccacacaagtacggagagactacatacataaagccacggctactcaagcagacccttacctaaaaccggcacaagggacctaaaaaccccaaactaacaccaaaaccagaaactgggctaacccataccaccacctggccacatgtcacaaccccacagaacaccacaagatcaacacagcgggccatatggtcatagtgcgagcacgaaaacggtggaacacaactcggctgatgagcaccagaattggggaacccgaaagcacggaatgcataaacaaaaaaggatcatggccaggcaagaaccccacaagcaaaccgttaaacacacgacccacacaacagcaccaaccgtgggacccaaccgcaccaaacagggcggcatcgcaccacgggagcacaacaaccggataaacaccagaacaagaccaccccacagggcccatgcaacgcacagaacaaagcgccaacgcaaggcacaacaaccaagcggtcgggaatcgcgccaccacaggacatcaccctgtgcaaagcaggagcagcaccagtggacatgacacactggacgccacccagggcacgacaatagaaatataggtcgagaaagccaaccaactggggccaaaacgagagaaccccacacacacgcagcaacaccaccatagtgagcaaacaccaaaggatacccacatatggagggtacagcgcaactgcaaccacaaagcaggcgcaaagagaagcagacagaccgaacacgacaaccgaacagacacacaaggatgagaaacaaacgggaacaaaaccaacacacacggcaagccaactacagaaacaaaggaagcgacgatagagacaccgcgagagacacacagacgaaaaaatggcacaccagagaagaaccaccaaaccaagaagcatg

SEQ ID NO: 720087 - DNA, 479 bp, Homo sapiens
ctctagaggatccgaatatgcaggagcagacaggcagctgcaagtgtctgctcttctgcctgtatgcttgcccgccacatcatcccagcgactgggcgtggagtgactggattagaacagagcatttgtgctgaggtatggaaaatactgccaggcctcctagtacagagaggctaggctgaggtgagggataggggtggggttggaaaaaactccaactcccctaagctggggcccaggatgagaggccaggccacaggaaatggaaattcttcactctgagacatagccccattgtgaaatgcgagaggcagaaggaacgagggccatgcctcagacacacacacatactttctctcctccacaagggctgggattttaagcacagacgtttccaagcctgtttaacccctaacacccaaccaggctctgggaaggcctcagccttcctggtggagtgaaagaacatttgtccgatt

SEQ ID NO: 720088 - DNA, 553 bp, Homo sapiens
ttggggctccattcaggacacggggggagggtgagcacctctccccaacacaggataaaactcatctccggtgcagaaaggatggctaaagacctttctcatgtcaacgggaaggccacacccagccccctatggactcagatgggaaacaggcctacgattggcttcatacttatccggaagattcctaagctctcagggcaggactatcacgagatgcatgttggtacttaattcactgaaagcctcggttgggaccggctctcgggaagcccagcaacataaaagcggggagggggaagactgaagtgaaaccatcatccggggtgcggtgtgtgtgtggtgtaactgggtgctgaccggttcgctcctggcaggggctccaggggggtgcaggctgagccccccacctgcagctccttgaggccacggtcaggggctgtctatggacagaaaccttgccacaatgagccactccagggtgcaggggtcacagtcccttgagtacaaactcttgtcccctaaagataaatgtcatcaggcctcaggatta

SEQ ID NO: 720089 - DNA, 178 bp, Homo sapiens
ggtttaattgacagctctgccacatcctcctcatttttcacaggggagtagcgcaccaggaagttggtcagttcaatggatggaggtggagcccagtgtgacacgtatcgtatcaggaccaacattggtaaatcgcaggtcagtgggaggagggacagctggtttcaaacaagaagga

SEQ ID NO: 720090 - DNA, 189 bp, Homo sapiens
cctactgattgtcaaaggtaatccctgggactaaaactctaacaagtgattccttaaattgccacacgggggttctggggtctataacttttaatcggagaaactgacctttctcttgggacataaacaagatgagaagaccctatggagctttaattcattaaggcaaatagaaactcgcactaaccc

SEQ ID NO: 720091 - DNA, 346 bp, Homo sapiens
ctcgagctggagatgtgccgagatcactctcactattcctataacaggtgctgtgagtgcctgcacgcagcacgacattgcattgatggatgcacacaccggtgctcagatgactagcagagttcacatgcccgggcttgcacttggccaatacatgactgtcatccagtgttcacagacccttagtcttgaagatctacgagacattccattacaccttaatatatgggaagcttaagattcaggccaacctattgcgtgtgcacagcctgaaagtgaagaggccgctgacttgaggattgctgtgcaagtggtgccgattgccatcagcttgggcatgtggccc

SEQ ID NO: 720092 - DNA, 516 bp, Homo sapiens
agtagggacgtgggagatgagtgtgtctgaaacccctggtggttgggattgggaggctgggtgaaactgtcatccttgggtgctgactacatctgagatccatggggctgactgtgtctgagaatcctggagctcccaagctagaatctgggtgagtatgagacttcttatggatgggagctgagtgagtttgaaccgcgtagcagctagggccaggagtctagtcgtgcctgagatcttgtacgctgggatagaggggttgactgtgtctgaggcccctgagggtagtgacctggcgtctgggtgaacctgagattgctgttggctggatagtctgagacccacaggtgctgagaacatgctgctgggtggtcaaacagagagtctgtacggttatatgcaccccaggagaggctgaggtgtaaaatgggctcccctggtctccacagagcttggcagagctgagagatcagcggcagggggagcgcctggaacatgcagcagctttgcggccgc

SEQ ID NO: 720093 - DNA, 350 bp, Homo sapiens
cgagtgataccggactctggttatacctgtagcctgagtcgtaacaggacggctgagtagtatctgagacttgattataagtcgctgccgtaggtctggtatactcgtccgggtggtaccattggcgggcaattgatttgatggtaagggatagatcgttgaccacgtcagtaatgtaaaggacgcgtacggatgggagtggcgatgaggactaggatgctggcgggcatgatagttcagacggtttctatttcctgagcggctgagatgttagtattagttagttttgttgtgagtgttaggacaagggcatacaggactaggaagcagatgaggaaaatgattattag

SEQ ID NO: 720094 - DNA, 150 bp, Homo sapiens
  misc_feature (144)..(144): n is a, c, g, or t
ggctctttcaggtccacctggcttatgtgtgagagatttttttgggtttttttgttctgtttttttgaaaagccagtaccaaaagcttacataattgtatgattgcattcaaataacattcttgaaatgataaaattataaaantaccga

SEQ ID NO: 720095 - DNA, 499 bp, Homo sapiens
  misc_feature (179)..(179): n is a, c, g, or t
  misc_feature (218)..(218): n is a, c, g, or t
  misc_feature (246)..(246): n is a, c, g, or t
  misc_feature (264)..(264): n is a, c, g, or t
ttccggcccgactcacgaccccgcgggacccggccggaacccggcccgaccccggcgcgcgcgcggcggaggacgaggaagagttgtggcgaggcagatcctgccccgtggccgcggccgtctcgtaggtgaccgggctggtccacaagtgggcatggaccaaagacgacgtgatcctncacgtgctcccgctgcaccacgtccatggtgtggtcaangcgctgtctgtcctctctgggtgggagncacctgtgtgatgatgcntgagttcagcctcagcaggttgggaaaagttcttaagttctgaaacgccgcggatcaatgtctttatggcagtgcctacaatatacaccaagctgatggagtactacgacaggcattttacccagcggaggcaggatttttgggtgacgttggaaaaaaatcgcggaggccgggacgtgcctgcccccccttggggaatgggaaatccggcccccgtggcgtgttgcccacccgc

SEQ ID NO: 720096 - DNA, 1373 bp, Homo sapiens
  misc_feature (1053)..(1053): n is a, c, g, or t
  misc_feature (1092)..(1092): n is a, c, g, or t
  misc_feature (1120)..(1120): n is a, c, g, or t
  misc_feature (1138)..(1138): n is a, c, g, or t
ttccggcccgactcacgaccccgcgggacccggccggaacccggcccgaccccggcgcgcgcgcggcggaggacgaggaagagttgtggcgaggcagatcctgccccgtggccgcggccgtctcgtaggtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccccaggaggctcccgggagcgcctgtcagtgcaatgccgccccatgtggtgctcaccttccggcgcctgggctgcgccttggcctcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgtgctaacgacgcctcctacgtcgtggcccagtgggcctcatggatgagcggcggtgtggcagtacccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtaccgggctggtccacaagtgggcatggaccaaagacgacgtgatcctncacgtgctcccgctgcaccacgtccatggtgtggtcaangcgctgtctgtcctctctgggtgggagncacctgtgtgatgatgcntgagttcagcctcagcaggttgggaaaagttcttaagttctgaaacgccgcggatcaatgtctttatggcagtgcctacaatatacaccaagctgatggagtactacgacaggcattttacccagcggaggcaggatttttgggtgacgttggaaaaaaatcgcggaggccgggacgtgcctgcccccccttggggaatgggaaatccggcccccgtggcgtgttgcccacccgc

SEQ ID NO: 720097 - DNA, 1354 bp, Homo sapiens
  misc_feature (1034)..(1034): n is a, c, g, or t
  misc_feature (1073)..(1073): n is a, c, g, or t
  misc_feature (1101)..(1101): n is a, c, g, or t
  misc_feature (1119)..(1119): n is a, c, g, or t
ttccggcccgactcacgaccccgcgggacccggccggaacccggcccgaccccggcgcgcgcgcggcggaggacgaggaagagttgtggcgaggcagatcctgccccgtggccgcggccgtctcgtaggtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctggctcggccgcctgtcagtgcaatgccgccccatgtggtgctcaccttccggcgcctgggctgcgccttggcctcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgtgctaacgacgcctcctacgtcgtggcccagtgggcctcatggatgagcggcggtgtggcagtacccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtaccgggctggtccacaagtgggcatggaccaaagacgacgtgatcctncacgtgctcccgctgcaccacgtccatggtgtggtcaangcgctgtctgtcctctctgggtgggagncacctgtgtgatgatgcntgagttcagcctcagcaggttgggaaaagttcttaagttctgaaacgccgcggatcaatgtctttatggcagtgcctacaatatacaccaagctgatggagtactacgacaggcattttacccagcggaggcaggatttttgggtgacgttggaaaaaaatcgcggaggccgggacgtgcctgcccccccttggggaatgggaaatccggcccccgtggcgtgttgcccacccgc

SEQ ID NO: 720098 - DNA, 166 bp, Homo sapiens
gcacgagctatgtttcagggaatctcagtctctgaggagattttaatctcacatgcaaattcagtggcttagtcagattccccaccctgcaacttcttccaacaaacttcctagaggaagaccatcagccggagacattcgcgtaaagattagacgggagaaaagc

SEQ ID NO: 720099 - DNA, 1158 bp, Homo sapiens
  misc_feature (255)..(255): n is a, c, g, or t
ggacaatccagagaagttcatggaagtcgccgagctggaccgttgaaatgagcgaatcattgaggcagatgcacgtggtgtgccaacattgccagaccctgtagccatcttcttgggtggacgcgtgcaatgcttggttacaggcgcgttcgtcgagcattgcgtcggatgacgataagtacaggactgtgtcgcataggctgatgggtcgattctagctctcgaggaactataactaggaatagtagacacccntccattgagagatgaacgaagggaagcagaaagtgctcatcgactgctcatggtggatggggcaggatggtagtgactgcgtggttagagaatgctggagtcgcgcatggcactgagtctgtggaatagaaggtagggcagatggcagtctacagacaagtctggtcctattgcttggagaaagcatggtctgagttccgggcacatgatggactgttgttactagaagggggttgccccgagcgagggtcatctacttactatgtggggactcgctaggaatagaatggacttgcaatggtgataaggatgcgcatatttcgaaatgacgccatgcgaataggatgctaagttttgcacgctggatacgttgcatgggcctatcatttgggttctcacgggaacaagattgatgggatgagaggacgaggcatagtgtgcctttgggggtgacgactcgtcacttcgggaattcagtagtggatgcggttcttcttcagaggaggtataattatgggggaatttgtaaaagataggaaaaggaaatgtgcaccgatgtctcgggattggacgcgaaggaagaggcacgaaatggagtgggcacgaaaaattgcttgggtagggatattgaacgcctcccttaaccttaactgctactttcacattcgactctaggctgtaccaaaaactaatgttcgtaggggcaaggcttaacctctcttggaaaaatgtgggccggacacggtgtgctacttgggcatggagatcggaatttggagatgtggtccaattcgtaattccgaaggaggtacataggtggcaagatgaaataatacccccgggggaaagtaatgctgggacggcctggcaacaaaagtcggcttggagagattcaaatcgtct

SEQ ID NO: 720100 - DNA, 308 bp, Homo sapiens
  misc_feature (41)..(41): n is a, c, g, or t
  misc_feature (83)..(83): n is a, c, g, or t
  misc_feature (90)..(90): n is a, c, g, or t
ctgtcattttagatactcttatctaggataggaaatatacntcgtttcctgtctctccactggccatgagctcatcacacctncaatttncttcttcagggccaacacgaggaaatacgttgaacaccggctgttctggaccaggccactcaaaggccaaggcactcatcaagaggtatatattaaatgtattaaagctttttcttatatcagtaaggaagagaggaggaaggaagagagggaggaaggaagggagaggaagtttaacatatcttgtccagggttttccacaaagtgattttgttgtc

SEQ ID NO: 720101 - DNA, 135 bp, Homo sapiens
gctctctgtcggtctctctgtctccttccccaaggccctagtgtgtatcagccaggagccgaaccttgctttccgccttgtgagtcgcgccctactcgccagtcacaacggcatcattcacaccccgataggccg

SEQ ID NO: 720102 - DNA, 163 bp, Homo sapiens
gattaagatggtcacgctgagaagaactcgctagatcattaccagtcactcatcagttccccacaccccacctcagtccctggacaactactaacttgtttttttgttcttagtgatttagctgatttgccacagttccatgtaaatggaatcatacaggatg

SEQ ID NO: 720103 - DNA, 349 bp, Homo sapiens
gtacacagataaacgacgatgatatcatttactgggggaaggcgctgtgtgaagtagtgccttatgtctctgtgtcctttcgttacagggaggaatttgaagtagatatgacaccgagcttggattactccggtctgaactcagatcacgtaggactttactcgtggaacaaacgaacctttaatagcggctgcaccatcgggatgtcctgatccaacatcgaggtcgtgaaccctattgtcgatatggactctagaataggattgcgctgttatccctagggtaacttgttccgttggtcaagttattggatcaattgagtatagtagttcgctttgactggtgaagt

SEQ ID NO: 720104 - DNA, 128 bp, Homo sapiens
tatgtcgtaccatcagaatggggcaggcagctggaatcagtgtgagtgcatatcctcgtggagctgacaacagccaggctacaccagtgcacccgcctctcaaaatcacctgggagtgccatcacggt

SEQ ID NO: 720105 - DNA, 441 bp, Homo sapiens
cagctcggggttgggtcagatatggatcttggagaaattaaagagctgatcagcaccacaccagaggaatgaacagaagacaacctgatagagatgagcgtttctgaacctgtgccagacaatgaagaagaagatgtagaagaagcggtgcgagaaaacacattgacattaggcaatttagcagaagggttctgattattcaagattgctcttgatttcttttatgacatgtacccttctacgatgcatgcactgaaactaaagcaaactgtggaagaattggtactgtataggcacatttttagagaaattaaatagcaaaaaagacagaaatttccacgtatttaatctccataaagttacactaagtgtgcctgtgtctcctgactacccttccacctcttccacctcagcaaccccgagctgggggtaccgagctcg

SEQ ID NO: 720106 - DNA, 266 bp, Homo sapiens
atcagttgatgactagacagaacacacagaacaggcataaaccgggaatgtcgggcacactgggatgtatgtgttgtctgtaggttggtgatagtcttaccacctatacaaagatctccttgtgattactcactggtgtctatttcatttgctttggttttagcaaaatcagtcaaggtgaaaattaagctcaataaaaaagatgacaaaggccgggacaaagggaaaggcaagaaaaggccaaatcgaggaaaagccaaacctgt

SEQ ID NO: 720107 - DNA, 125 bp, Homo sapiens
tgctgggattacagggcatgagccaccatgcctggctcaattttggtgttttgtgtagaggtggggtttcacctatattgcccatggctggtctcaatacaccttgggtaaaaggcagtgatgcc

SEQ ID NO: 720108 - DNA, 653 bp, Homo sapiens
tttcttacactgacctacatttccctgactccagggccatgtttcccttcaggacgattttacgatggcggaatccctaaccttaacgatccgaagcagaatctgctacagctcatatatactttacacgctgtcaaagtcccctgacgaaaccctagctgcctgagattgctcgactgcctagatccacttcggccaccatcatctagaacccaagacacaggacactagcaactaccacacactctgactaatggcacccgtaccagtaataacatgcccttcaaagatcaaagacagcgcgcacaccacatcttagcgtcgatgacttcagagatagcgtcaaatattgcctacacacaatactctgcatctactaataagtcactcactatctcacagccacaccaactttgcacaacaacactccatcgtcaagaatccatcaagactatctagcaacaccactacgcaagcctactctaatccatatcccatacatccataacatctcatactcgcacactaatcaatcatagtctcatacccccttcacaacttctccttcagataatccctctaatccgactctcgtacatcatcacaccaacgacttctacttaatccacaattacataccacgtactacctcc

SEQ ID NO: 720109 - DNA, 146 bp, Homo sapiens
tagagcgtatcacatgcggaccaaccctgccccacggagacggcatggaaccgctcaatcagaaggtgttctatgatgcggccggcaccagcctaaggatgtccccgatcttcttctagccagtaggcgatgtcctatggacaccg

SEQ ID NO: 720110 - DNA, 793 bp, Homo sapiens
  misc_feature (793)..(793): n is a, c, g, or t
atagggtcttactctgtcccctaggctggagcacagtggcacgttttcagctcactgcagggctcagctcacctcctgggctcaagcaaccctcctacctcaggctcccgagaagctgggactacaggcacaggctacctaccacatccagcaaatttttgtatttctagtagagacggggtttcgccatattgcccaagctggtctcaaattcctcctgggctcaggtgaccctcccaccttggcctcccaaagtcctgggattataaatgtgagctaccatgcccgaccactacattcacattgttgtgaaacagatctctagatttttcatcttccccaacagaaaccctgtccccattgaccaacagctccccatttcccttcccctagccctggcagccaccattccactttctgttgcagtgtttgtctactttagatacctcgtggaattgtacagtatttgtcttgcgactggctaatttcactaatgtaatgttctcaaggttctctggtgtagcatgtgtctgaatttctttttagggctgaatagtcctagagtaacacaggggagtaaagaacccataaaaggctggatcatattctgttgtgtgtataaaccacattctgatcatcttttcatccatcagtggacagtcgggttgcttctggcttcttggctattggtgaatactggtgcattgaacctgggttgtgcaaatatttaaacaacttttaaacaattaccttgtttcttggccgggtgcagttggctcaccagctgtaatcn

SEQ ID NO: 720111 - DNA, 193 bp, Homo sapiens
gatgaacacagtgcagttagtgctccccacactatatcccactttcgggcgcctggtataggacattgaatatactatcagaagtacgctgaacgagatctactttcgaaaaacaaagggtatcgtctatgggctgaggtcttgtgcatacttttgcagaccagtcaatacaagaagctctgaatggattgct

SEQ ID NO: 720112 - DNA, 970 bp, Homo sapiens
  misc_feature (390)..(390): n is a, c, g, or t
tgaggcaggagaatggcgtaagtaaacccaggaggcggagcttgcagtgagcccagatgcaccactgcactccagcctggacaacagagcgagactctgtctcagaaaaaaaaaaaaccaaaaaaaaaaaccagtcttggtttctcccttgtgttcctggccctggggccttctagttcactttcctgtggcattcccaccaagcgagtttctcctttacccccacccgagggtccgtggagtggtcgcgcggcccacggggggggcgacggggaggtaagggctccggaattgcgggagccactggacagcccaggcagttgggagacagacgacaggagaggggggctgggtccattggaccctggtggccgggcagctggtggcccnacacagggttggctgggcgcccaaaggggaagggccccttcctggtggcctggccccttgcaaggggacgtcaggggaacaggatctagcccgggcccctggcttaggcctcaagtggtggctgggcggtttggaccaaagagcggtctgggagcgggaagatcctgggccctcaggcaggcgcggaggccgggtgcccccagaaaggggcccagcagtaccagggactcaggcaaggcagccaggggcagagggcacagctggagcaggggggtgtggggcatccgaggggaataccgcagcccagtggagcggcaactgcagtctacagtgaggctgccggggctgggcaccgatgggcaggatgctgccaggaggggccataaggggagactggtgacagtgggcgtacggccccagtgtggcgccaggggggggcgaccccaaaagggggcagggcgcgaacgggggaacgccaagccgcaccaagcaggacactatgggaaccggttggagacccacaggggcccacggcaagccggcgcgcagggaccacgcgcacaatgaccaccaagggcga

SEQ ID NO: 720113 - DNA, 94 bp, Homo sapiens
cattactcttctataacatcacgaatattaagtaccaggcttagtcttactttagcaatgatagacaaaagcgaattaactacatcacagccag

SEQ ID NO: 720114 - DNA, 209 bp, Homo sapiens
gacagcatggcccacctaaatattgtagttgccattgcaggaaataaaatgtgatcttatcgatgtaagagaggtaatggagagagatgcaaggacctacgccgactctattaatgcaattttgtagagaccagcgcaaaaacgcgataaacataaatgactctctatagaattagtcgagagtcactccactgacgccacctgccatc

SEQ ID NO: 720115 - DNA, 262 bp, Homo sapiens
tcagacaccatggaggacggtaagaacggcagagaaagggttttattcaagagccaaagcaggcaacattcatccagcatttccataaaggttcctcttgttgggccagcagtcagcaggcatcagcattcagcagcacaaccaaccccaccaggcacaagcaggcagcacagttccagctagcgtcatgtgtgcagcagtttcagcacagcagcagcaaccactggtcttaacaccgcaaaggcagttgcaacccagcaag

SEQ ID NO: 720116 - DNA, 358 bp, Homo sapiens
acgtgggactcagctctcctgcatctcagtcattgcctaatcgccagcatagcgaggatagatttccaggcacttcccatcatgctccagtagcagagggcagtgctgagagagcacctagaagggaaggcacccaggcaccaggagggtccatgaaaatggaaaagggctggaggggacctgccaccttccataaatgtcatcccagcctctgaaagatcacagttccccaggaaagtccaggacaagtggaggcagagtgcgcagagaggacagccaggccgtgggagcagctctaacttacgcctaggtcagagccgggagttcctttgagtggccagcctccctaccagctgaa

SEQ ID NO: 720117 - DNA, 400 bp, Homo sapiens
  misc_feature (2)..(2): n is a, c, g, or t
  misc_feature (164)..(164): n is a, c, g, or t
  misc_feature (392)..(392): n is a, c, g, or t
anattcggcacaggggagttccttcagatctccagtaaacttgtttgtggaggtctggggagtttcttcagacccccagtaaaacttgtttaatcctaaacgagtcctgttaagaatccttcgttatcatgtcatgcttcaaggcccaggagaggcctgggcanaaactcctgatgggcttttgttccattccagcctttgtatgaggacactggctctttcagcttttaatagtaacttcaccactcggtcagtgccgaaacagatgtcatggaggcctgcgttagtgagacctgggcctgccacaacccgactccaagacgttaagagggagcttgtgctaggatacttaatattgattttaaaaatattttagtacataacgaaagttntggtttgc

SEQ ID NO: 720118 - DNA, 384 bp, Homo sapiens
atctagaggatcgctgctgctcctcttcatcaatcctgcgaggtcatttcattattacttttactttacattccaagaagcctgaaggcccaggagaagcaagtaccctcacttcaggtcacacaaaccggaaggggtacaagtgggaatccaagcttggaatgctgggccacagtgtccccctttagacaaatgatggaataaagtgtgtgtgcactgggcgagattatagggagtgggacacacagtcaactgctgaaggatttcactttagtccaaagggtagccagtaacaaaaccaatgcgtttatgtccccgtggacattcagagagactgaagtgtgggctggccaggtattgtggctcatgcctataatcccagca

SEQ ID NO: 720119 - DNA, 105 bp, Homo sapiens
cgagtcggtaccattgatacacgggctcagaacctgggccaggattgctatgtcagatggcgagggcacgaggtgacaaattgctaaggcccttcccacatgtcc

SEQ ID NO: 720120 - DNA, 391 bp, Homo sapiens
gagctgacatgggagttgttggattctttgtttcatagctttttctatgccataggcaatattgttgctcttggaaagtttattatttttttaactcccttactctgagaaagggtattttgaaggactgtcatatatctttgaaaaaagaaaatctgtaatacatatatttttatgtatgttcactggcactaaaaaatatagagagcttcattctgtcctttgggtagttgctgaggtaattgtccaggttgaaaaataatgtgctgatgctagagtccctctctgtccatactctacttctaaatacatataggcatacatagcaagttttatttgacttgtactttaagagtatgtccaccatccacatgatgcactgagctcttgt

SEQ ID NO: 720121 - DNA, 426 bp, Homo sapiens
  misc_feature (5)..(6): n is a, c, g, or t
  misc_feature (59)..(60): n is a, c, g, or t
  misc_feature (174)..(174): n is a, c, g, or t
  misc_feature (281)..(281): n is a, c, g, or t
  misc_feature (348)..(348): n is a, c, g, or t
  misc_feature (362)..(362): n is a, c, g, or t
  misc_feature (378)..(378): n is a, c, g, or t
gagannccccagtctccactgaggatgcaaaggattggccgggcgtggtggcacatggnntgtgattcccagccactcgggaggcgggggttgcagtgagccgggattgcgtcattgcactccagcctgagcaacaagagtgaaactccatctaaaaaacgaaagaaagaaaanaaaggcaataactacagttacaaaccattgttacaatactaggttttataattacccgactatttatctttattgagatccttatttcttcatatagcttctgcttncttgtctaagtgttcttttatttcttctttttttaaatttaatttttgtctcatttttccaagaaantctccactctgtcnaccccaaggtttgganatgccagttggctccaatcctttggctccacttgcaaaccttcccggc

SEQ ID NO: 720122 - DNA, 677 bp, Homo sapiens
  misc_feature (157)..(157): n is a, c, g, or t
tcttgtgatctcttctacacaagcaagacctgctgctgagaagtcccggtggcaaatcgagattgaggactactttccagagttcgctcgctacacactctgtagggatgcgactcccgagccgggagaggacccacgcgtgacccggccaagtacnttcattcgggatgagtttctgagaatcagcactgctagtggagatgggcgccactactgctaccctcactttacctgcgccgtggacactgagaacatccgccgtgtcttcaacgactgccgtgacatcatccagcgcatgcatctccgccaatacgagctgctctaagaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagc

SEQ ID NO: 720123 - DNA, 246 bp, Homo sapiens
gagatcctgtttagcatttaggatcgtcagtttgtttgattttagctattccaataggtatgtaatggtgctgcattggagcttgaatttgaatttgtctaatgactaatgaggagcatcttttcatatgcttatttgccatctgtatatctttggtaatttttccttggacattaatttctctaaaggagagagaaaacccagacagacggtgatggagctaccaagagggagagtctccgtcga

SEQ ID NO: 720124 - DNA, 896 bp, Homo sapiens
  misc_feature (34)..(34): n is a, c, g, or t
  misc_feature (73)..(73): n is a, c, g, or t
  misc_feature (84)..(84): n is a, c, g, or t
  misc_feature (93)..(93): n is a, c, g, or t
  misc_feature (105)..(105): n is a, c, g, or t
  misc_feature (196)..(196): n is a, c, g, or t
  misc_feature (231)..(232): n is a, c, g, or t
  misc_feature (291)..(291): n is a, c, g, or t
  misc_feature (293)..(293): n is a, c, g, or t
  misc_feature (325)..(326): n is a, c, g, or t
  misc_feature (337)..(337): n is a, c, g, or t
  misc_feature (367)..(367): n is a, c, g, or t
  misc_feature (371)..(371): n is a, c, g, or t
  misc_feature (415)..(415): n is a, c, g, or t
  misc_feature (421)..(421): n is a, c, g, or t
  misc_feature (442)..(442): n is a, c, g, or t
  misc_feature (463)..(464): n is a, c, g, or t
  misc_feature (469)..(469): n is a, c, g, or t
  misc_feature (476)..(476): n is a, c, g, or t
  misc_feature (493)..(493): n is a, c, g, or t
  misc_feature (495)..(495): n is a, c, g, or t
  misc_feature (507)..(507): n is a, c, g, or t
  misc_feature (517)..(517): n is a, c, g, or t
  misc_feature (524)..(524): n is a, c, g, or t
  misc_feature (526)..(526): n is a, c, g, or t
  misc_feature (575)..(575): n is a, c, g, or t
  misc_feature (596)..(596): n is a, c, g, or t
  misc_feature (713)..(713): n is a, c, g, or t
  misc_feature (778)..(778): n is a, c, g, or t
  misc_feature (803)..(803): n is a, c, g, or t
  misc_feature (886)..(886): n is a, c, g, or t
gcatcttagctgtgaaggagaaagcagtgcacgngaaggaatgagtgggcggaaccaacggcctccacaagcngccttccagcngcctgccanggccatggccgngagagactgcaaacaaacaaacacaagcaaacagagtctcttcagcgggcgtggagtctgaaagctcatagtggcatgtgtgaatctgacnaacttaaaagtctgcatagtccattacatgcatannacactaataataatcctgtttacacgcgcctgctgccggcaggtccagctccaccactncnctcctgccacatcacatcaagtgccatggttnngagggtttttnatatgtaattgttttattctgtaaaaggtngcanaattttcagaacaaagctttccctttttaaaactaatgttacanatctgngttatcacttgtgtataaatngtatatagctgatcattaatnnggggnataagtncaatgtattctaaaacngntaagcaaaaaanaaaaaaaaanaaaaaangnaaatccaagtgtcctcctccccccctcccgctggtgatcactgtgctcnctgccagctgcgtggggtganggggggggggaatcactgtgtgtgcgagagtgcttcagactcaatttccaaaataattttcacccctctaagcatgtaaatatacaaagatggatccttcatagaaattaaaaaatnaatttgagctcatttcgaatacagaacaagtatggcacagatggaagtcctgccacgtttccttnaatgatgctgactcttgtatcacanaggccagcatgaagtttcttactcagactttacaggcattttccgtaattcacacagtcctgctcccgcacaacacaggaggngattcgagat

SEQ ID NO: 720125 - DNA, 342 bp, Homo sapiens
ataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattggctgggtctggtggtggatgcctgtaatcccagctactcgggaggctgaggcaggagaattgcttgaacccagggaggtgggacggtgcagtgagctattactccagcctggggcaacaagagcgaaactctgttctcaaaaaaaaaaagggggggggggacatttaaggagattg

SEQ ID NO: 720126 - DNA, 829 bp, Homo sapiens
gcaacatgtccccttctcggttttgttctcccccgtatactccgggttcctcattttccgaacacaccacacaaacctcgctcattccaacactcattgctcccgccctcgaaaagttttcgtcaccccccctaaccgaagggattcccacaaagattctcgttataaacacccttgtatgagggtcgccccccaccgcgaaagagttggaaaatattctcgtggtccccacacatttcttgggcccactttgcgcccccccctaagattctcgggccccccactggggttttgttttccccaccaataaaaaatattttggttgataggaccattgcccaccagggcccacacgggtgtgactttgggaaaggcgcctctgaggagtttaccacgtggagatacttgacaccattccaggcaccatacaccacggccccacagattttgaaggttggtggccttcttgcgctcttgccctggatccatcctaagcgcctcactagggaacccaccccagagcaccagaagatagtaacaccaggagaaacaccatttgaacacaccacgatgggaataatcaccatttgatgcagaattcgtcccaccattgctccgaccagatgccggcccccgatcctttagccccgagaacatctttggaacccttaaagagatcctggggactgccccctccatgggctgtaatagttgatggcccccctcctcatgacatcatcgatgaccatccaccgtggtgctgtggaatgccccgcccacgttaagccccaagggaaacctttccaataaaggatccatttgaccactg

SEQ ID NO: 720127 - DNA, 484 bp, Homo sapiens
ggatgatgtgggcgagagtgtccacgagctggagaagtacaagcgggccctagagcagcaggtggaggagatgatagatgcatgtggaagagctggatggacgagctgtaggccaccgaatatgccaagctgcggatgttggtcaacctgcaggccatgaaggcccagttcgagcgggacctgcaggggctggacgagcagagctgaggagaagaatgaagcagctgtgtcagagctggtgcgggagatggaggcagagctggaggacgagaggaagctgctgctctgatggcagtggcctgcccggaagacgctggagatggacctgaaggacctggcggctgcgcatcgactcgtgccaataagaaccgggacgaacccatctaaacagctgcggaagctatgtagtgccagatgaaggactgcattcgcgaactggattaccaccctcgcctctcgtgaggagattcctggcccatgccaa

SEQ ID NO: 720128 - DNA, 343 bp, Homo sapiens
catgaaggcagggactgtgtatgtcataaatctatataggttaccattatatcctggtaaaagccggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcacctatcacagtgctggcagatagcagatactaatatgaattgatgaatgaatgaaaaaattagtgaataaaatttatgctgaattcttaccacaaaaaaa

SEQ ID NO: 720129 - DNA, 449 bp, Homo sapiens
  misc_feature (319)..(319): n is a, c, g, or t
aggggaagtttcccctgcacaaaggtcctccttaaccttgtctgctgccatgtgagaacatgcctttcacccttctgccatgattgtgaggcctccccagccacgtggtactgtaagtccaataaacctgtttctttttttaaaaattgcttagttctcaggtatgtctttatcagcagtgtgaaaacaaactaatacagtaaactggtgccagtagagtggggtgctgctaaaaagatacccaaaaatgtaggagaaactttggaactgggtaacaggcaggagttggaacagtttggaggactcaaaagaagacagnaaatgtgaagaaatttggaatctcctagagacttgttaaatggcttttcccaaaatgctgatagcgatttgcatgataaagtgcaagcgtgaggtagtctcatggtggaaagtgaggaacattgttggaa

SEQ ID NO: 720130 - DNA, 778 bp, Homo sapiens
aaggctagtagaggcctgggtgttaatcaggagaggccctcggccttacctcctcttcccggcgcggcccccggcttccgcgcgcctgcctgccaccaatcctcttgctaccatgtccagtggagctcgaggagtgccctgccagtgacgacctgcccgagggaatgtgccaatgaacggtgaccaatggctgtgcggctcgtgcggctgttgtccccatctaatgaagatggaatgaatagcaaggaatgaagaaccagccgggcaagtacagccagctggtgtgtggatgaccatccgtagtgctgggcgagcgcaacggctcgtcgctggccaagatctacaccgaggccaagaaggttccgtggttcgaccatgcagaatgtggctgcacctacctcaatgtactctgatcaatggctgctggtgcatgaacgacactgcttctgcaggtgaatgggcaccggctgccaactggttccttcaagctcaacctgcaagaagctggagggcggcgagggacgcagtgccgcgggagccccgtgcggcgccacacggccccggaccccacctggcacaaagcgaagaatggcatgccccgtggtgcggccggctcccggcgcgcggacaagaagcccgccagggggcccagaaaccggaagaagcgctcgcacaaagaagggcgctgccgcccagaaggaccacggcggcaggccagcatacggcggccgccggggccagacgctacaaacgcggccacccagggtcccaagtccaa

SEQ ID NO: 720131 - DNA, 102 bp, Homo sapiens
atattctggcatacatagatatctccagataaatggcagaagcaggaagcagccgtcctacctcccagagaaacagacctcagccctggcagaagcaggaag

SEQ ID NO: 720132 - DNA, 191 bp, Homo sapiens
tgtgcattcactgcgtagtcccatgcatataagcatgtacatattattattaatattcacatagtacatatcattattgctcgtacatagcacatatcatgtcacataattcccagtaacatgcgtatcagcaccattagatcacgagcttcaattaccatgactgcgtgaaaccagcaaaccgcttggca

SEQ ID NO: 720133 - DNA, 213 bp, Homo sapiens
ctctacccgactagcccgacagccggtggtggttagcagcgggcagcctgcagagacaggaggcgcaactccccaggccaggagttgcttcagcccgaagtcttgcacctggcagcaccatcgcaggtagaggctgcggagggacgacattgggtggacaagataggctgaggccatgtgtcctggtgatgcgtacacacccgtgtcggggct

SEQ ID NO: 720134 - DNA, 160 bp, Homo sapiens
gagacgcgggttaggggcttcatctctctgcgtcctcagttctgggaggccttggtgattcggccacaaccttagcctccgtcgttttttaccctccgggtattggatgattggtagctaagacttcccaatacttcagaagttggggaaattgaacctt

SEQ ID NO: 720135 - DNA, 169 bp, Homo sapiens
cgtacaggcgtcgttcgaggattaagaggagttaaacatatgtaaagtgcatcagaatcatacctggaaacaacagtaagtgctatgtccgtctaggctgttattcattcattatctgtagggtttttagagcaccagtcttgcaactccgtgtgcctcaagttgattc

SEQ ID NO: 720136 - DNA, 215 bp, Homo sapiens
tgggggagaggaaatgtatgcaactgtagtcccagctactggtggggtagcggggagttgggaagccaacggcagcttatgtgggaggatcacctgatcccaaaaaggtcaaggctgcaatgagctaaacttgggctactgcactcagcctgggcaacagtgagcaaagtgagacccccatctcgaaagagaatttcaacaagcaaaaaatgaac

SEQ ID NO: 720137 - DNA, 905 bp, Homo sapiens
ggggggcgggaactccttccgcccttctgaggaggggctgcatgaggtgagagtgactgaccagactcagtcactgaagagggaaaggggtgagatgacaagcgtaaagccccaaagtttgtattgctccagcccggtgcataccccggagctcccgaggcactggctcaatcttgtggaacacgccagtacttgattgataacaggaggctatgaagggaccctgtgagtaagccagtacagttcctttcttttctggaggatgccatcccagaactggatctgtcggagctggaaggactgggtctgtcagatacagcacctaaaagtcaaagacatgcgagcgtgcgcaccgaatgatcggggcaagcatcgtgcaggcatgaccaggagcaaacaccccttgaggtgattggccctcctatgagttacagcgcaacctttcaacttctggaggagctccccatctgccagcattccatccttcgaaacgtggagctggctctaaggccaacgattttcttctcccataacacttgcctcatggcttccactctaaggcccgttctttccagtcctatccatgttaatctttgttctatacctaaatgtgtggagatgatgaggaaatttgacagagttgaagtaaggaataatgaacgtaatcgaacagtcaattgtgtaaaagctaagtacaaggttagtgtcagcaaggagaagtggcaaggattccgtaccgccaaataatcacaaatggtatgggaatgaaaataatgatgaaagcacagtgtgacataaagggaagtgtaatcaatggtgggggaaacattgcgggacaggattggctgaattagaagacgtgagattaaagggagaagatatgatgctttctttaatattatttt

SEQ ID NO: 720138 - DNA, 450 bp, Homo sapiens
  misc_feature (26)..(26): n is a, c, g, or t
  misc_feature (86)..(86): n is a, c, g, or t
  misc_feature (141)..(141): n is a, c, g, or t
  misc_feature (409)..(409): n is a, c, g, or t
  misc_feature (438)..(440): n is a, c, g, or t
ggatcctattaaaagctgtttacccntatgcctaaaagcatcaataaacctaaggaaagtgcccccagtaattgtccccgtacccnatattgtaatattccttgcaaaactctgttttgaccctacctagtcactgtttcnataagttttcatcctattaaaagaaactgggccgggcattgggtcgtcacgcctgtaatccccagcactttgggaagccaaggcgggcagatcacgaggtcaggagatcaagaccatccctggctaacacagtgaaaccccgtctctactaaaaatacaaaaaatcagctgggtgtggtgcgggcgcctgtagtcccagctactcgggaggctgaggcaggagaacagcatgaacccggggggcggagcttgcagtgagccgaaattngccactgcactccagcctgggtgatagannngggtccgtct

SEQ ID NO: 720139 - DNA, 109 bp, Homo sapiens
accacttcagccggaacagcggcggcatggcgagatagacgaagccagcctcgatgagtccgcgcatgtaacggaacagcagcgtcagcagcagcgtcgtgatgtgctg

SEQ ID NO: 720140 - DNA, 750 bp, Homo sapiens
cgctacaattattttggattagtaccggactacattgtggaatgccaccaccagagttgtgggcatttctaggaaaggggtctcatcccccggggttaagagggctgtaatagaaaagccgagcgcaggggtgtgatcgaatcccagaacaaaatgagtacgcgcccttatatgaaggagtaaagtagcaactgggtgtaaggagttcccggaaaagaaaggcccataggttaggggctggacttttaataaacccttcaactgaaagataggcggtttcacctgagggcacaggggatgttccctaagtggggggcatatatgtgaaattcctggattggcgatctcagagttattggttgtgccggagtatgggtcctgtcgctggctcaaattatgtcttaaataaggtcctacctggttcctcgtaatgagctcgcataaagaaagcaccagtagaggggacgttttgtaacaataggctcgggagactgtcaaaaccttttggggtgatggaaccgcaatgctcggctccacgggacaaaaaaagccagattatttgtttagatggccggtctgactacaaaaagtgccacctgcaagacaatgcaaggcatagaaacccccacactccccatcctccaacccactggtctcatgcccaaagaagagttgaaggcatgggagccaacattttattgaagaaaccacagaggctgaaattcaataaacgcaagttttgtcagtaga

SEQ ID NO: 720141 - DNA, 435 bp, Homo sapiens
  misc_feature (139)..(140): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (345)..(345): n is a, c, g, or t
  misc_feature (353)..(353): n is a, c, g, or t
agcgggccagcgagcgagcagagcacatcgctgcgggctcacaaagcggccagacgctcggcggcggcgtgtggcaggagcgcaggggcgcgagccggcgatcagccttcccggcgaccgtgccgcgggagctcgagcnnctcggactaggggacccgggccggcccccaagatgccggcgatcgcggtgttggcggcngncgncgcggcgtggtgcttcctccaagtcgagagccggcacctggacgcgctcgccggaggcgcgggccccaaccacggcaatttcctagacaatgaccagtggctgagcaccgtctcccagttacgaccgggacaagctactgnaaccgctntcgagacgcatgatgcattgcagaaaactggcaatcccaagaagcccctatgaccacagccctggaacccatccaaggaccc

SEQ ID NO: 720142 - DNA, 513 bp, Homo sapiens
  misc_feature (1)..(1): n is a, c, g, or t
  misc_feature (140)..(140): n is a, c, g, or t
  misc_feature (225)..(225): n is a, c, g, or t
nagtgatcctctgtgaatagctgttcttgaactcctgactcaagtgatccacccgctcagcctcccaaagtgtggggttacaggcgtgagcacacgcccagcttagttctatttgtgagtgaacaacactctccattggnagggaaagggtcaccttggtatgtggctcgcttacggagtagagtttctccagggcctctcccagggctgttcaaatgacccagnacaacccttcaagtgacttccccttctctaaagaactcagtttccttatctgtccaatggtggaattggagtaaatatttgctaagtttccatccagctctaagtgtactaaaaatctatgaaaatcgggattttcccatttccagacaagccgtggtactacttcaacttaatctacaggcaccaagatgaaaccctggtgcagagccaatcgctgacaccaggaccatgagcttcagttcacaagcaccattctcactggagccccaacagaactcgatggactgt

SEQ ID NO: 720143 - DNA, 342 bp, Homo sapiens
aactatacctattttgatggctttcggttgagcaagctctgcaaggcatcctgagaccaacaccccaggtcgggtagcgtaagcagcctcagcacaggggctttcttcaactttctttgagtgcagctgcttgtctgccaagcccgataccacctccctaatgccggtgggccaggcccgagcctgagagcctcttcttctcttcttgtcaaggggtcaatgacccggggcactaagaaccctcccattgcgttgacaccttgggacttatctagaaacacacacatatagtagctataatatatgtctcatggttttaagtgtgtgagagctacaagaccc

SEQ ID NO: 720144 - DNA, 81 bp, Homo sapiens
tgcgccagcagcttagtagcgggggggccaggtacccagtacttcgggccaggcacgcggctcctggtgctcgaggacctg

SEQ ID NO: 720145 - DNA, 152 bp, Homo sapiens
cattctcgttattgcttgtagcagatgctcatatcgacgaccaggtcacggataaccggcaatcctggcagcggacgaacgatcagcttgttgcctttgaccacggcggacagcggcgtgatgcacgccagcgccgtattttgccgttgatg

SEQ ID NO: 720146 - DNA, 136 bp, Homo sapiens
gatatgtggtgataagtaatttcatgattaaacaatgaatcttcttaaactaaactacactgcctctgacatttgcacctgaccgatttgataaatctttaagtaaacaacggctttactacactccctgtagcct

SEQ ID NO: 720147 - DNA, 183 bp, Homo sapiens
gttacagagcagactctcaaaaaagaaaaaaattttttttaacagtgagctgggtgtactggcatgcatctgcggacccagctacttgtgaatggctgaggtgagacgatcaccttagcctgggaatttgaggcttcagtcagctatgatggtatcactgcagtccagcctgggcaacaaaga

SEQ ID NO: 720148 - DNA, 199 bp, Homo sapiens
atgtatcgcccaacaccttcctcaatccatcatcctcactgtcaccataattgcacttctgaaataatcatatttacaagtctttgcctaatatgacttggtacatcatgcgatggagcttgaattgtctttaaaatgcactggaggagttcccgtcgtggcgcagtggttaacgaatccgactgtgttggggataaca

SEQ ID NO: 720149 - DNA, 168 bp, Homo sapiens
tcgacactaggccgtttagaccagccatgaagggaatctagcattattctaggcttttcggacctctggagggcatttgagagaggagatatacccgagtccaagaattcaccaaggttttaaaggaaataactgattctttaaacccgcaattagaattcgtttcaa

SEQ ID NO: 720150 - DNA, 393 bp, Homo sapiens
tatcatgtagggatttaaaaagcccaaatactaattatttctttggagggggtaaaggaatggttttaaaagaccaaaaccccactctttgtgggtttttatcaactctttactcagagcccctctccaatgcaggtccccctcccattatgatggaagatattttttatacttaattgcagtaggggctcctttcccgacaaagccatagtcccggcttcatggaacccatccatggattgttttttgaagactggccataaaactgtcccttcaattcccaaaactgggtttaagggaaagcccctgatattctttcatggttagaaattctttctggtattattcaagaaaatggttttaatcctgctaataaacttttttggggatgga

SEQ ID NO: 720151 - DNA, 352 bp, Homo sapiens
  misc_feature (60)..(60): n is a, c, g, or t
  misc_feature (101)..(101): n is a, c, g, or t
  misc_feature (166)..(166): n is a, c, g, or t
  misc_feature (331)..(331): n is a, c, g, or t
ccaatgggcctgccagaataccacattccttttttaggcacatgtatcattcctcaaggntagacccatatgttaggtccacaagtccttaaaacattaanaaagttgaatacccatcaagcatcttctctgacccacagtggaatacaactagaaactaataacnagaggaatttttgaaactacaaatacatgaaaattaaacaatatgctcctgaatgaccattgagtcaatgaagaaattaagaaggaaattgaacaatttcttgaaacaaatgataaaggaaacacaacataccaaaacctatgggatacggcaaaagcagtactnagaggcaaattgatagctatt

SEQ ID NO: 720152 - DNA, 417 bp, Homo sapiens
tttgtgtctcattatccatgtttttcagttttctcaccatattccaggtcctaaaatgtgcatttttcatttttcatttttcagtttcctcgccatactccatgtcttacagtgtgcatttcttattttcctcgtttttcagtgtttcttgccatattccagctcctacagtgtgcatttctcattttccatgcttttcagtgtttctcgccatattccaggtcaaacagtgtttgtgtcttatttttgacctatttcactttcctcgccataatccaggtactatagtgtgtttttctcattttcgatgattttcagatttctcgccatattcctattcctacagtgtgcatttctcatttttcacgttttttagtggtcgacgcggccgcgaatttagtagtagtaggcggccga

SEQ ID NO: 720153 - DNA, 284 bp, Homo sapiens
  misc_feature (29)..(29): n is a, c, g, or t
  misc_feature (46)..(46): n is a, c, g, or t
  misc_feature (79)..(79): n is a, c, g, or t
caactcaaagcaagtgcttccgagctatnaagtaaatgtaaacatnttcttggcagataattgggttgagcttgtctanaagactgggatcgatacgacagggaaatgttcaggttaaaaataaaggattgtggagaccaagttttattgtgcagaggaagtgctcagatagcccaacttcagagaacagagggttgtaaattgtttcttaatgggacttaaaaggggtgcctggctcttaatttggattattttccttccttgcaaatgttggggggtaccga

SEQ ID NO: 720154 - DNA, 112 bp, Homo sapiens
tgtctcgctcacgtcggctggccgctccggcctgctgctccttggtcggggctgctttgctgcaactgtccaccccgcacagacgagccttactccgccaagtattctgctg

SEQ ID NO: 720155 - DNA, 187 bp, Homo sapiens
gcttgattgccttggcagtcctggcgtgcttttctgtttcttctcattgttggctttaacttccggtttaagaagcaaacttctctatccaaggcgtctctgtgactcgcgctctgcgcacatactcgtgttctctgtgggacccagggacctctgtggacctctaggtgttcccaaggactttcag

SEQ ID NO: 720156 - DNA, 1111 bp, Homo sapiens
cggacgcgtgggtcgacccacgcgtccggacccacgcgtccgatcgggactacccgggcaatgatggccacaagctcatcatcttcatttacatggtgcaacggtatggctctgtaagcggactccggcagttgccgaggatgtattgacagacgagctcacgtaatacggtaacagcgtatggtatcgacgaaagagctgagggtagcgacgataacggacgatagggagcccgtcgaagttggataggtcgtagtaggctgagcacgacacaaagagaagacaaaggaccaaaatatacaaacagaaaacaacagagacaaagagaagaagcatagaggaaagagagcaaggggaccacagaaacaaacaaacagaaacaaaagatagaagaaagcaaaagagcaaagcaagagaagaggcacagagaggaacaaagagaaggcgacaaggaaagagacgacaaaccgacacagaaagaagaaaaagagacaaccacaaagcgcagagacacaacggcaacaggaagacaagtacaaagaaaacaggaaaaaaaagagagatcaagacaaagaggaaaaaggcagaaagaacacaaaacgagacaacgaacaacaaagacaagagagacatgagacacaaaagacacaggacaaaaagacacaacacaaacaagaaaggaaaaacaaaaacagagaagaggaaaaagaaaaagaacagcacagaaaagaaaaagagaaaaaaaagacaaaacaaagaaaaacaagaaggaaacagaaaagaaacaggaacacaaagaacaaaagaaacgaaagggacaaaaaaagaagaaacaggaaaaacaaacagaaaggagaagacacgagggaagcagataaaagaaatagcgaaagaggacaagagaaaagaagacagagcacaaaaggaagaacacaagaagagacaaggagaaaagagacacacagcgaaaaaacaaagcaaaaagaaagagaagagaaaacaagaatacaaaagaagaggcaagaccagagaaagaagaaagagaagacaacaagaagaagagaacaagagaaagagaacaaaagataggaaaagaagaaaaagagaaaga

SEQ ID NO: 720157 - DNA, 554 bp, Homo sapiens
  misc_feature (225)..(225): n is a, c, g, or t
  misc_feature (399)..(399): n is a, c, g, or t
aggtagccacctgtacttctgtcttccagtttgccactgcaaacgtctatcttcgtccaaatagtttcatcctaccacgtcccagattaatctgttcgcattgttcgtctgcgtatagtagatgcgtaactaggctgaaatgacgcgattctccctgcgtcatggattcaaggtctgcagtcaccttcggtcaatctctcctaaaagatcgccttcaaattatgntaatcacctacaagtttaaactaaactttagctgtttaagtcaccttcagtttaatctagaagcgtgccctgctataggtatgaatacggggctcagtagtcctttctctcaatgttcttttaaagtacatttttgactccatgaagaagcttcatctcaagctccgtcatgtntgagaaaaaccattttatctcttccttcctcatgctactcttctaagtcttcatattttctcttaaaatcttaagctattaaaattacgttaaaaacttaacgctaagcaatatcttagtaacctattgactatataattgaagtagtagtatca

SEQ ID NO: 720158 - DNA, 386 bp, Homo sapiens
ctagaggatcccccacttgagccccttgatgcagctggctgcttctgaaaacaatggaggagaaggaattcactacattgtgattgagatagtggccactattctttcattggacaggcttgggactactaccatcagggcgtcctaaagatgaagtgttatgcaaatcgattgcttgatttcgctaatgaaacatgtctttcagtcctaaaaagagctgtgtttagacgcaatcttgaaattataaagaccctatgtcgagtgctggaaggacttgtttatccttcccttataggtccatatttgaatagtttcccggttctagatcctcattctaatgactactcactccggattcgtttgctaagcctcccggggcctctctg

SEQ ID NO: 720159 - DNA, 475 bp, Homo sapiens
  misc_feature (9)..(9): n is a, c, g, or t
tctgagcanagctgggaacaccgtgagcccaggagtacaagaccagccttgagcaacagtggcaagaagctgtttctacaaaaaaaaatgaaaaattagccaggggtggtagtgcacacctgggtagtcccagctactggggaggctgaggcaggaggatcccttgagaccagcggtcccaggctgtagtgagctggtgatcggtgccaccatactccagccggggtgacagagcgagatcgtctctaaaaaatacaaaaacaaaacaaaatcaaaacagatcaggacagtgaccggctaaaaagccttcaaactccggtattttaaacccagcacccttccgggttgggtcccccctcttctagcctcatacacttctccctatggacatgattcacgggggccgttctaaacttccgggagtgcccagatgcagttggtatcttacaactctccaccttcccactggctcaga

SEQ ID NO: 720160 - DNA, 338 bp, Homo sapiens
tactgggactacaaggtctcacactgtcaaccaggctggagtacagaggcacaaactctgactacactgacagcaccaactgccaggctcaagcaattctcctgactcagactcccgagtagactgggattacaggaagtgacctcacaatgactcaagctaccacatgctgttgctagtgaaatgccagtagacgcatatgtcctgcgcgcttaggggtgctacaagttgaccactgcaacagtacagatgactctgaagaatggcgtgggatggatccttccgcatgcacttgaacagcggtctccaaacacagggacacagagctggaggtgagc

SEQ ID NO: 720161 - DNA, 188 bp, Homo sapiens
ccccccaatgttgaaaaagtcaatatccgaggataaaaactacaaggaagttatctgagaaactgctttgtgaggtgtgcattcatttcctagtgttaaaactttccttttattctgcattttggactcactgttttgcagtaactgtgaagtgaaatttgggagcacattgaggtctttgatgatat

SEQ ID NO: 720162 - DNA, 212 bp, Homo sapiens
gtcaaggtggttcgtcgggcagaggctcatgagagaagacggactctccctgaggagcacgtagagctccgggtgtcgggaaagctgggggagtactggtccagtggcagtggacagagtccagcgtactcctggcctggaggtcaaggccacgactgcggtccatggtcttccaccgagctgcttgaacggtgggtctctgatgagggcac

SEQ ID NO: 720163 - DNA, 141 bp, Homo sapiens
caatatcacccgcaggcataccaaaacagccatacttgttgttcactagcttccaggaaatgctgcacactcattgagttttgggttttttcttttccgcctcaccgtgcttctgttcactacttcttccggcttatctct

SEQ ID NO: 720164 - DNA, 160 bp, Homo sapiens
cgctttttttaaagtccagctgaattcttgccctttagacgccttagccctgcatcagtgagtcccttattcacgatctgactcacgaccgtcagtttaagacacactgcgactgactccggcaaacacgtagcgtcacactagcacagcaggcagcact

SEQ ID NO: 720165 - DNA, 168 bp, Homo sapiens
aggtggctaccctgccaatggcagagtcacacgtaggaaattgtgagagagggtgggttggaagttgaggccaagaagaagaaagtgatctatatacatagctgtgatggagaaggggtgagaagcaaaaagaagggactaagtgaggggcagggagaagcacagaga

SEQ ID NO: 720166 - DNA, 977 bp, Homo sapiens
  misc_feature (29)..(29): n is a, c, g, or t
  misc_feature (67)..(67): n is a, c, g, or t
  misc_feature (184)..(184): n is a, c, g, or t
  misc_feature (192)..(192): n is a, c, g, or t
  misc_feature (203)..(203): n is a, c, g, or t
  misc_feature (208)..(208): n is a, c, g, or t
  misc_feature (213)..(213): n is a, c, g, or t
  misc_feature (230)..(230): n is a, c, g, or t
  misc_feature (270)..(270): n is a, c, g, or t
  misc_feature (275)..(275): n is a, c, g, or t
  misc_feature (281)..(281): n is a, c, g, or t
  misc_feature (301)..(301): n is a, c, g, or t
  misc_feature (314)..(314): n is a, c, g, or t
  misc_feature (356)..(356): n is a, c, g, or t
  misc_feature (379)..(379): n is a, c, g, or t
  misc_feature (412)..(412): n is a, c, g, or t
  misc_feature (426)..(426): n is a, c, g, or t
  misc_feature (453)..(453): n is a, c, g, or t
  misc_feature (522)..(522): n is a, c, g, or t
  misc_feature (545)..(545): n is a, c, g, or t
  misc_feature (547)..(547): n is a, c, g, or t
  misc_feature (551)..(551): n is a, c, g, or t
  misc_feature (576)..(576): n is a, c, g, or t
  misc_feature (660)..(660): n is a, c, g, or t
  misc_feature (671)..(671): n is a, c, g, or t
  misc_feature (699)..(699): n is a, c, g, or t
  misc_feature (710)..(710): n is a, c, g, or t
  misc_feature (713)..(713): n is a, c, g, or t
  misc_feature (749)..(749): n is a, c, g, or t
  misc_feature (782)..(782): n is a, c, g, or t
ggcccgggccggggccgaggttgccttanggctctctgcccagtaacaggcatcgaacggtgcagantgaagacgccctccgtcagcgacgccgtcgcaatggccatttgtcaattcttccttcaaggccggtgccgctttggagatcggtgctggaacgaacatcccggtgctaggggtgcanggaggagngacggcagaanccgangcagngagccttcaggtaatantagacgtggatggaatacaactagccagagatattccaantgtcnatccangccatccagtttctccaaantccacaccatggngggggcagcagagatcaagaaaagccatatttcagttcttcngattctggagcttcaactaacanggaaggaaggcttgggattgtctgagaacccantttgcttcacttangtcctgatgagcagaacagatgaaaangaacacttctggaacgacatcgtcacagatatgcgagggttgggcaatcatcagggcagtggatgttcnctgtatattcacccagtgaaaanangaancctaatatttcaggttttacagacntttcaccagaggaattgaggcttgaataccataacttcttaaccagcaataacttacagagttatctaaattctgtccaacgtntaataaatcantggaggaacagggtaaatgaactgaaangtctaaatatntcnactaaagtagctttgctctctgatgtaacaggatgnagtacatcaagcagcacctgcatttggatttgncagcagtcaagcagcaacatttatgtcgccaggctttccagtcataacaggcagcagtgataatggctcagaactttagtgttcaaacaaactctggatttgctgctgcctcttctggaagccttggtggtttgggagtcccccagcattgggagctgcagcctctaccagttcaaggtatctctaattctggtc

SEQ ID NO: 720167 - DNA, 791 bp, Homo sapiens
ggcaatccggagtgcccaacatggcggcggccgtaaggtgcatgggtagaggtctgcaagggaaaacaaaaaaaggtgctaaagaaaaaaccaccaggatgagaaaaacgatgaatagaaaaaataaaagcatatccctatatggaaggcgaaccctgaggatgatgtctatttaaaaggcttatacccgagacagatatattgaggtgagaaagctgtcacttacttaagaaattcaaattcttgattaattagtccaaagcaaagtgtaatctttgatttgacactgatatggccactgggaaagacagaaaacggttggagcccatttaccagtgttctaagttcgccatacccattgtgcttccgaaatcaactaaagtggcggtatttcacagagaatgcatcagaaggtcaaaatagcggagaaaatggagctgcattggcggaggcctagtctgatacacgaagatttgtgggatgactgaaattgttgcagaattttacgtagctgtccagaaataattgcctgaacttactcgatagggaaagaaactgattaaaaatatcaaaaggttctcgaaatccaattggcgtgattccccaagaaggttgacttatctaacactggcttgaactacggtcgatcaacaacaggagacttctccagaccaatagcacttggatttgcacgtacccgataggtgcatctcgagcacgtattaatgaagcttgtagcagacgtgatggcccttgtggaagcgctcttcgaatcacaaggggtttcagag

SEQ ID NO: 720168 - DNA, 148 bp, Homo sapiens
ctgcgtggtaggtgatgtctgcgaggcccggtgtcatcaggcgcaggaaggtcagctggatggccacatcggcagggtcggagctcttggcgccatactcgaactggaatccatcggacatgctctcgcagaaccagacttgcgtctt

SEQ ID NO: 720169 - DNA, 462 bp, Homo sapiens
cagggtgggatggattttcacagttcagctcttgcaaagtgatttccccaggagagtaggccttttcatggagaaggttctatgaatgttttacaacagttacactccccattcctctgccaggaccaggaggggatctattttggatccttaccatgagaatctggtggaacgcttgaagaaaagttcagtaaagtgtaggatctcccttaaggcagggtcccacagtgttttctgactctcaagctagtccacactcagcctccagcaagtcatcatttcaattcccatctctacaaaaattaaaaattagctggacatgatggtgtgcctgtggtcccagctgcttgggaggctgaggtggaaggaccacttgagtctgggaggtcaaggctgcagggaactatggtcacaccactgcactccagcctaggtgacagagcaaaaccctatctcaaaaaa

SEQ ID NO: 720170 - DNA, 674 bp, Homo sapiens
  misc_feature (164)..(164): n is a, c, g, or t
  misc_feature (303)..(303): n is a, c, g, or t
  misc_feature (432)..(432): n is a, c, g, or t
  misc_feature (639)..(639): n is a, c, g, or t
ggctccaccaccgtgttccacagtcctgggctcccggctcagtatccccacctatggctctgcagtgcacccgactctgcgccccttgacgatctatccacacgtcctggcgtggctacatagcatcgatctgcagtcagcgcagcgtgacagaccctgaaggnctcccatagccgtcgctgtgtccgcgctaactcacttactgtgtgcggcctagcagttggtcgcttttggaacatttgttgcttcctcagacttgccagtgcccaggacagtagtcccagggcctcgcacgccagcaancaaggccgtgctttctcttgattgcagaacgtgactatcgtcgcacaatgcatagctggtacctagagtcacttagcaactcccaggaaggcctaacacgggtggccaagacgacttgtagcctccaanggttcttgttggaagggcgttgaagggccttgaacgagccgggagtgccctatgagttgcctttccttcccgtgtgccacgcgaagcttccaccgtgtacccagtgtggggagacccactaaacaagtgggttgcctgagaagtggcggcattgtcgttgcgcggcgtgcacatggggcccttagcatggaagccggattgtgtgcnaggcccggcctgatggggaacccttgtaatccact

SEQ ID NO: 720171 - DNA, 248 bp, Homo sapiens
tgttcataggtgtctggtcgaagagtgcggggagttgctgatgggggacatggaagacagactctcctgatgggaggtcctcgatagcggaagctgcagtcgtccaggtctggctcttggaagaagggaaggcagcgatcagtgtgaaggagtggtagctagctcaggatccccgaccccagaatgcatatgggattgggacctcaccgtagatccctttccccatgaatccccaatcccagactggc

SEQ ID NO: 720172 - DNA, 270 bp, Homo sapiens
agaagagcatcctcatcttctataagggagcgaccacctaagaagttgcagctcgccttgcacaacaggaaaaacaggaccaggttaaattgagtttatgtaaaccagacagcttcttagggatttgggtcatctcccagtggctctcttcttaactatcagcacaggttggtcatctatcactagtgtggttctttgtgctgcggtgttttgatggcatgcttatcatcacctcattcatctaactctctaccagggacaggctttctg

SEQ ID NO: 720173 - DNA, 288 bp, Homo sapiens
tgctttggtttttgatgaagtcttgcactgtcacctgagctagagtgcaattgcgcgatctctgctcactgcaacctcgttcacgcaattctcctgcttcagcctcccgagcagctgggattacaggcacctgccaccacacccagctaatttccatttcttctagattctttagtttatgtgcatagaggtgtttataatgttctctgatgtttgtatttctgtggggtcagtgagaatattcccccttatcatttctgacggtgtttatttgaatcttatcacttt

SEQ ID NO: 720174 - DNA, 843 bp, Homo sapiens
gcaaagagaaatggtgagtaactgttcaaagtcagaaatgaaacttgaagactaaaaacccatctctctacgtgagtctcagatgtttatgatgaagcattttttaaaaagagtgagacagacttcctcatttattattacaaaaagtgaatccttggcagaatgtgttgtccaaaaatgtaccatttggtttctttgaggattggagttccagtggagtgatgagattttcatttttcaagatagaaagctgctggaaactctgcaagcaaaatgtattcgggtctctagtacgtgccaccactcaagatgtaatcgaaaccgctcgcggagaaatttcgacctgatatgcgaatgctgtcctctcccaagtattgcactctgatgaagtgcagtgtcagcggaggtcaggtatacaggaagggtttgtagaggcatgactgagctgtgaagagacagttgtccagggtcatgtggtcatgtcaggttacctgtcgtctccatctttcttctcttatgggggtaggagagtagctggaggctgagaagactgtgcatgtcgtgggaaggtgtgcttataagtcactggcacatatatctgttggaaggtagaatgaatatattaattttgatatgctgatttctccaagatagtaacgtaccatttatccagcgtattgggggccaataattgggtagtatgctactggtttgggaaggttaaggggtctatgatgagatatattattatatgtccacgtgaatataaggggagacacaaatggggagatatggcgtgggaaaaatcatgtattggaagaaggaagataagaaacagagata

SEQ ID NO: 720175 - DNA, 889 bp, Homo sapiens
gcgggattggggtcgcagtgctggtcgtggatcggctgtgatcgtcacttaacaatgcagatcttcgtgaagactctgagtggtgagaccatcacgcctcgaggttgagcccagttgacagcatcgagaatgtcaaggcagatggatccaagataagggaaggcatccctcctgaccagtcagaggctgatctttgcgggggaaatcaagctgtgaaatgatggagcgcagcccgtgtctgactacaactatccgagagaagagtccaccctgcagctggtgctgcgcctcaggaggggggatgcagatctacgcgaaggagagtgacgggcaagtagcatgagccttggaggtggagccagagtgatggcatcgatcaatgtcgatggcccgagtatccatgcatggggactggcattcactcctgaccaaggaagagcggtttgatgcgttagcagggaatgcatggttgggatgatgggcgcacgcggtgttgcttgaactacgaactacttcacgagaaggagttcctgccgtgcaaccattgagtgtcatccgtctgcacatggggggaaaatcgcgaaattcttcctctggcgactactgtaggagggtaagacaacaatcaatgctacggaagtaggaagacgcagtgagcacgcagtgggcggagatggtcgacgtgcaaagggagcctacgagaaggggacgggcatcaccgtccctggaaccacaaacctgtgaactaccgccatgggaaaggacatgggcaagatcgggcgagcacccttggtgtgattcctgacagtccttgagagagtgcagagctggctgtggttggcaatgtaagggcggagaccaattcacggagaacgataggtcgcaatcc

SEQ ID NO: 720176 - DNA, 408 bp, Homo sapiens
gaatctaaatatatttaatggattcaagccatatatcacttggccaagaaattggaatttcaaaatgttcgtgcggggataaaccaaatgaggacagtgagtagttatgtatccccagactgggttattgccaagttatatatcaccaaaagctgtatgactggatgttctggttacctggtttacaaaattatcagagtagtaaaacttttaaatatatgaggaaattaaaactaccctaaggatcctttgattcgattcaaaaaggactttgatatctctcagtgcttcagtgctatcattgtgagcaattgttttttaaaaacgggactgtaaccaaactaggcccgtctgtggcattctttaaatgttttttttttacccaataaattccttaaatcaccttta

SEQ ID NO: 720177 - DNA, 364 bp, Homo sapiens
ttcctatttttttatgcgggaacttaccccccatttttatttttggattttttctctttaaattttgaagttggccagccttttccaaccttttttttaaacccctgtcttttatattaacctttttttatttttctttaggtaaaaatgattgatgttggctgatattggggtggtccttccccctgaagtggataaattcttttccagacctcccccagggtgggtccatcaaggagggaagcccccagccgactgcccccgtttttagggtcaggtgagctgtgtccccaaaaccccccaaaaggggtggaaggaggaatgaacgtttctttttcgtttataaaggccttttcctttttta

SEQ ID NO: 720178 - DNA, 195 bp, Homo sapiens
  misc_feature (41)..(41): n is a, c, g, or t
gaggactcccacggtaatttctccaccatccaccggaatgnaaggcgtatctgctggccgtcattggcgcggaatacgtctcaacatgctcccgcgcggcacgcatgattacgctaaattcatccgcccgtcagagctgagcgcgttcgtacgcacggccggcctccaggcgcaagagatgcgcgggctggaata

SEQ ID NO: 720179 - DNA, 702 bp, Homo sapiens
  misc_feature (53)..(53): n is a, c, g, or t
tttagcttgtcccccagttcaggttaccctctaaataggcaaaactgaggccncacgtgtcgtcgatcttggcagtgtttctcaggccgcctgatcgcctcatgggaaatcaggtcttgacgttgctctaagagagtgtctaggctcgttatcaaccacctctgcaaagcttccgcctaagcacccgcaactcagccctgactacctgcctgagatctgtatagaccttaactatctctgcccgtgaccacggaatggtctctccttacgatgtcttgcactctgttgattttataaacacaaagtcgcattctgtgccccatactaaagtgcattggtggcatctcaggtccctgtttcctccgcctcccctggtcttgtgatcctgcaacctcagcttgtcaagtaggtagaaggtcaggcactcgccggcatgagtgggtaacttttgtattcattgagtaccgttcgggtttaagcacattgaccaggctgtagtgtctactcctagcttcaagtgatgcatctgccgtagcctcccccagtcctgagagtgcaggcgttatcccttacgcagtagccgacacgttgtatttttaaagaaaaatgttcattttaccagccgagtcttttgtcatagatgcatatttttatagtaaagacgcttcacattacagaaatgcggaacaggcaaaatcactc

SEQ ID NO: 720180 - DNA, 703 bp, Homo sapiens
ggacgcgtgggcagcagtattctgaaatggctatccagatgatgatgctcatgcatggatcagcaactcgcaaggagatctgggcgctggttgggttctgtgatgaggtgaaagagatgcccatggagagtctggtccccgcgcaaagtggactccaagaatgtcatccctgccctggaatctgggggagcccatgaagaagcacgaggtcccagcgaaagtcggatgtggtacagtgaggtgtgtgaagttccgggtgaatggaggtgaccaccgcatgatgaccaagaacaagacggtgagaaagaaatagctcgacgctttttgacaacaatgtgcgtcgaacggctgccgaagtcccatgtcggaagagtggcaggaggtggggacacgttacggcagcgtacctctcgctgtccatccatgctggaggagagtcagcgccctgagtctggtgtgcaagcaatgcatgacaccacatctgcatctggcatcgcggatgcctggacctgaccgttcacgtgacgtcagccaagggacggtggacttctgcgagaagtgtgcaagaagctggtgggttattcggactcgcaaagcctggagcaaagacgaagcaccaagcaggagatccgtggggctccttgtggacaaggctgcagcttgctggcgagaccctgtaccagaagcaggtgatccagagggc

SEQ ID NO: 720181 - DNA, 266 bp, Homo sapiens
atcgtagacctcgacgggagtccaggacgccggggccgagccgcttctatgcgctcctcctcctcgtactccttcatggccttctcgatgcgcagcttggcaaggccccgacacacgctccttgaaggcttccagctcgtcgtatgaagccctccatgtactggcgatcggatgtcttaatcttagtgaagaactgccggaagcacggcccgggggtccaccattataggctcttggccagctccaggatagaagtgcgccgggtg

SEQ ID NO: 720182 - DNA, 126 bp, Homo sapiens
tgctagaattacaggtgtgaagcaccatgcccagccagatctcccctgctcttaactggcccaatcctagcactcttttttttttcccgaattttaagtagaaatggggtccaccatttgggcaac

SEQ ID NO: 720183 - DNA, 351 bp, Homo sapiens
  misc_feature (251)..(251): n is a, c, g, or t
  misc_feature (265)..(265): n is a, c, g, or t
  misc_feature (326)..(326): n is a, c, g, or t
gcaaaattggccttcccttcccggacacaaaattcactgttggtgttcagtgtttccaacgggcccctccaagacagtcccagttccttaaggaaaatttcgggcaaaaggaggcttaaaaagtggcccgggtgaaggccctatattaggagctggatttgccaccagtgttcttgcaatatgaggaagacagttccagccccattatggctttcattgaacagtacgcagcccccctgcccccacccgtntttttggggcttgngcgcaaaatttccaaacggagaaagtgccctaaagattgcaagggcggggaaaggaggctntcaataaataatcgtgtacccttta

SEQ ID NO: 720184 - DNA, 304 bp, Homo sapiens
  misc_feature (59)..(59): n is a, c, g, or t
aggttggcgattgcagccacgcattctagcgtctgggaaagaggcacgtgggccaggtngtggtggctcatgggaggatcatttgagtccaagagtttgagaccagctggggcggcacagtgagacctcgtgtctacaaaaaaaaaaaaaaaaaattagacgggcatggtggtacactcctgtggtcctagctacttgcgaggctgaggtgggaggatcacttgaggccaggaggtcgaagctgcagtgagctatgatcgtgccactgcactccagcctgggcaatggagtgagaccctgtctc

SEQ ID NO: 720185 - DNA, 653 bp, Homo sapiens
  misc_feature (44)..(44): n is a, c, g, or t
  misc_feature (220)..(220): n is a, c, g, or t
  misc_feature (331)..(331): n is a, c, g, or t
  misc_feature (503)..(503): n is a, c, g, or t
  misc_feature (539)..(539): n is a, c, g, or t
  misc_feature (623)..(623): n is a, c, g, or t
cttacagtgactggggaggcctcacaatcatggcagaaggtganaagcatgtctcacatggcagcagataagagaagaagagcttgtgcaggaaaactcctattttataaaccatcaaatctcgtgagacttattcactaccaaaagacatattcactaccacaagacagcataggaaagacctgctcccatgattaaattacctcccacagggtccctnccataagacatgggaatttaagatgagatttgtgtggggacacagagccaaaccatatcattcttcccctggccttttcatgtcctcacatttcaaaaccaatcatgcctncccaacagtcctccaaagtcttaactcatttcagcattaactcaaaagtccgtagtccaaaatctcatccaagacaaggcaagtcccttctcctatgagcctgtaaaaccaaaatcaagttagttacttcctagatacaatgggggtacaggcattgggtaaatacagctgntccaaacgggagaaattggccaaaacaaaggggatncaaaccccatgcaagtcagaaatttagcagagcagtcaaatcttaaagctcccatgaatcttctttgactccatgtctgatatncaggtcatgctgatgtaaaaaatggggtac

SEQ ID NO: 720186 - DNA, 184 bp, Homo sapiens
cgtggcgactattcatagggggggcgcctgacctactcagacagcataaactcagcaccaagtcacatacacggaaaacagcagtaaactatgtcagcagtatcaacaaacatcagtatcactttttgttccaaagtatatctcagatggaaaaaatgaggtttatcaccactcagtgcgtatt

SEQ ID NO: 720187 - DNA, 104 bp, Homo sapiens
gggggggggattgggggaccggggcatttttcttacttttttaatttttggggggtggggggaagggtggttttgggggggtaataaacccccttcgggaccca

SEQ ID NO: 720188 - DNA, 1006 bp, Homo sapiens
  misc_feature (68)..(68): n is a, c, g, or t
ggtcgaccagcttctgagggtgaggaccgaggagcgcgagcagatcaagaccctcaacaataagttgnctccttcatcgacaaggtgcggttcctggagcagtaacaaggttctggacaccaagtggaccctgctgcaggagcagggtcaccaagactgctgaggcacgaacctggtagccgttgttcgagcagtacatcaacaacctcacggaggcagctggacagccatcgtgcgggaacggtggccgcctggactcagagctgagaaacatgcaggacctggtggcaagacttcaagaacaagtatgaggatgaaactcaaacacagcgctaccactgctgagaatgagctttgtgcactgctgacagcacacggactgtagcatgctgccctacactgacacacaggctgggaggcctgcgcggccaccggcctgactgcactggactggatgagcactgaaccttcatgcaacgatgtatcttccgaactgccggcaggcttgtccccaggaatgcagcacgccatggtcctctgcaccacccttcagatgggtccattctaccaatggaaccaaccaaacgcgccacacccttgggaaccttgggactaggccatgtcacttccgccatgaacgggctcacacggagtccgccaaggataatggcagcgggaagaaatacggccccaactcgcgacgtgcccccgggaaccaggcaacgacccgcaagtatcacagggggattatattgatgggaaacccaacaggatggactgtgacaagaggcaaggcctttggcccaagcagacgtacaactaacgcgcctggggcacaacagagcactgtaggaggcgactaggaacccccatacccagggtaaagacaccgtccacaaagcacaattgaacagacaattctctcgtatgagaagagaattgagataacccggggcgaaataggaaatacacacaagaaaaacggctatggttagtgatagccacc

SEQ ID NO: 720189 - DNA, 181 bp, Homo sapiens
tgggctgactagaggaccccctcctatctgaatccagataaaaagtacaaggcatccgtctcattttagtcatcatgggcggtctggattcagataggaggcctcctatctgaatccagatcctcctatctgaatccagaccgccaaaagtacaaggccatccgtctcatttttgtcatca

SEQ ID NO: 720190 - DNA, 447 bp, Homo sapiens
gaggacccgccgacggggattcatcaagctaaaaagcttctacacagaacaggaaacaacaaagtgaaaagataacctacatatggaatgggagaaaatatttgcaaattatttgaccagggattaataaccagaatatatgaggaattcaaacaactcaatgggccaaataccccagataatccaattttaaatgagcaaaagacctgaatagacatttatcagaagaagacacacaagtggccaaaaggtatgtgaaaagatgttcaacatcactaatcatcaggaaagtgcgaatcaaaaccataacgagctatcatctcacctcagttacaatggctattatcaaaaagacaaaaaacaaatgctggagaggatgcaggaaatggtgaatgctcatacacttggtgggcactgtacaattagtacagacatcatggaaaacat

SEQ ID NO: 720191 - DNA, 223 bp, Homo sapiens
agtctcttatgtataattaccttgtttggtaatactcactttgacatgtgttaattccattattttttcatgattgtttatacacatttttagtcacaggttttgtcttggtaagagtactatttatgaatacaggagaatggtagaaggaaagggccagtaacatgaaagattctcttcattagcccatgaatgttaaacgttgatttgcgacagtggtggg

SEQ ID NO: 720192 - DNA, 100 bp, Homo sapiens
aggcttccagtgcgtgcaccatgcttcatgtgccaggcagcagggcacgtccaggcttccagtgccgtgcagggtccctgcagctcgcaattcgtcaatc

SEQ ID NO: 720193 - DNA, 177 bp, Homo sapiens
ctctcccctgacaaagccctcaacagcctcccaggtatcagtatcctgcaccacaatggtacatttgttacaatcaatgaacctactctgaaacatcattatcatccaaagttcatggtttacattagagtcccctcttggtgttatacatgctagaggacaaatatatgatgatat

SEQ ID NO: 720194 - DNA, 116 bp, Homo sapiens
gtcgtgcctcagcttccggagtagctgaggaccacaggttcatgccagcatggccagccaactttcgcatgtttgtagagatggggtctcacagtgttgcccaggctggtctcaaa

SEQ ID NO: 720195 - DNA, 450 bp, Homo sapiens
  misc_feature (141)..(141): n is a, c, g, or t
  misc_feature (196)..(196): n is a, c, g, or t
  misc_feature (206)..(206): n is a, c, g, or t
  misc_feature (239)..(240): n is a, c, g, or t
tgtcgagaaagggcgccaagggaagaaaaaaaaaccccccccccccccccccccattctttaagtacaaccccttttatcaataaatggcaacggggggaatataagcaaatatataataagcaaatgcaatggaagggangaaggaaaagataatatttatatgtacacttcccccagatgtggagattcaccancccagacggnaagcaacagccctgggctccagagtcggacacnnaaacactcaccagatacaagaggattctcatgaagtttccgcatggtctgggacccctagctcttattgtaacaagttgtttggcatgagacccagtcacaagggcccttcccgactggactcaaggaacacaaaaaggtcaacttgtgtttgcgattgtctgttgtgtttcaataactaacaaataggaatttaaatagagatttattt

SEQ ID NO: 720196 - DNA, 103 bp, Homo sapiens
  misc_feature (76)..(76): n is a, c, g, or t
taaacatgtttgagaaccatgacgaagctggccgggcttgcaattcccaagcacagagggggccctcaccatgaanctcggcccacggattgggtcacccagt

SEQ ID NO: 720197 - DNA, 277 bp, Homo sapiens
gcccccagcaaaagcaaataataataatattaataataataaagagaaataaaatattaaaataaaaaccaatagcccagcccttgttgaggtcaccagggagaaggggctgcccggagttgggtccttgcctggattttgacccagcaacttcctgtagtgagccctttgtatgaatcgtggccttcctgttttcaaggcgcaggtatttattttgtatttgtttagagccccccccaaaatccacccttttaataaacatgagggggcagtccca

SEQ ID NO: 720198 - DNA, 372 bp, Homo sapiens
tccacaaaaatacaaaattagccaggtgtggtagcgtacacccgtaatcccagctacaggaggttgaggcaggagaatcacttgaacccaggaggcagaggttgcagtgggctgaggctgcaccactgcaccccagcatcggtgatcgccagactccgtctcaaaaaataaaataaataaaataaaataaagtgttctcgctgggctcggggactcatgcctgtaatcccagcactttgggaggccaaggagggcagatcacttgaggtcaggagttcaagaccagcctggccaacatggtgaaaccctgtctctactaaaaatacaaaaattagccgggcgtggtggcagatgcctgtaatcccagctact

SEQ ID NO: 720199 - DNA, 330 bp, Homo sapiens
acatatactcacgctattataaaccaaaggcactcccaccacttttccttacttaaaaattttacagttggacatcaggtgcctgatgatgagactatttaaaattcaaacacgctgttaatgggttttttgaaagaaaatagagatattgataaacttattgggtgcccactgtacccatggtttaaacagggctggctacctcatttgcagatatttgatttatgtagagggcgtgaggccagatgatgcaattgaattattcaatagggtccggggacatttcttagaagacaaaactacattgaggacctccagaatggtccctca

SEQ ID NO: 720200 - DNA, 265 bp, Homo sapiens
gagccggcagggccgatacgcagggcatggtcgcccagccgggaatggcatggtcttgtaagctgcacttgcacaaggactggcagcgggcgctggggacacgtggttgaaccagtcggtccggcaagatccgcagacgtatgggccaggacgaagacccgaaggggcgacacgcatcgcgtccgcgccaccgcggctcgcggctcccgatccgcggcctatcgatgcggctgccaaccgagggtctcggctcaccaaggacgca

SEQ ID NO: 720201 - DNA, 1110 bp, Homo sapiens
ggttgtgtgttttcggggtccccacttcgggttgtacgtaaggccccctgcgcgttttttgctgcccgcccacaccgcctttggggtttctttgggtgaggacatattgggactccacagcaccccggagtgatttggagccctcgcgttactccaccggggtcactggccacggagctcttggcggctggttgtgccgcccaccgctctttgccgtgcggcccctgtaggccacccttgggcccacacttgccgctggccccacagggagggatattcccccactttggggccacgaggacttttttctgttcaccaggtggggccccccagagctgattaacccgtcgtggtccctcacgcggctttgtttttctttacaggctggggaagtgatgtgggttcttttcaacggcgctcgctcttgtctggtgcccccgtgtgtggtgcccctctcacacacggcaccttaggtgaattgtgccactggtgtgcgcacgcacccccaccttctcacgctcccccgtggagaacctcttgttggggagacacccacgccccgagtgttcacaccctggagggcacgggaccacttctggagaaaccccctgggaacccacgcgtggtctccacaacacatggtggctacacgccccgcgccacaggtaaacacaccgcccctggcccaatcgcgctgtcccctcgcccgcggtataaacacacgcccctgccacaaagccgggcctcgccccgtataacaccgccctgtcacaaaccctgcctggcccacacaacacacggtttcacacgctgcacggttcacaggaaaggccctgaaaaggaagcccttattctgtggctctcacggatctcacgaagcccttctgggccacatggtccacattcccgggaacgcacgtcacggaggccacggccggcgagccctgtggaatgagccctcagaaacccttggcttgcccacacgtggaaaaagggatatgaaggttgggtttccccccttttatagatggtcacgcacctgggtgcttcccaagttgtatgtggcatgaatactttttgtaatgattgattaatgccagattgtttatc

SEQ ID NO: 720202 - DNA, 540 bp, Homo sapiens
attgcacccgtgtttgttctcatggaacagattactcttaagaagatgagaaagatcgttggatggtcaaataaagatggtgatgggatattttctcctgggggagccatatccaatatgtacagcatcatggctgctcgttacaagtacttcccagaagtgaagacaaaaggcatggcggctgtgcccaaactggtcctcttcacctcagaacacagtcactattccataaagaaagccggggctgcgcttggctttggaaccgacaatgtgattttgataaagtgcaatgaaagggggaagataattccggctgatttagaggcaaaaattcttgatgccaaacaaaagggctatgttcccctttatgtcaatgcaaccgcaggcacgactgtttacggagcattcgatccaatccaggaaattgcggacatatgtgagaaatacaacctttggctgcatgtggatgctgcctggggtggtggactgctcatgtcccggaagcaccgccacaaactcagcggcatagaaagggccaat

SEQ ID NO: 720203 - DNA, 208 bp, Homo sapiens
agcagatgagcttgagattgtgccactgcactccagcctgggcacagagtgagactctgtctcaaaaaaaaaaagaaagaaagaaaaaaaaagaaatgatgctgggagaagggaagtgagggaggagagtgtcacccttgagaattacggtttccagaatcaagtctgcttgagacccaaagcataactctggaacccctagggcatt

SEQ ID NO: 720204 - DNA, 609 bp, Homo sapiens
gggtttcacttctggacccacagtgtattttttggggcaagcatggataactgctggcttgcactattggggtccagtgaactgaccatcaggcatctgaaaagttaggactgcaggtgggtgccaccacccctagctaaggtaaaaaatatacattcgtagagatggggggaaactgagttgcccagactggctcaaactcctggactcaagcgagtcttctgtcttggcccctcgaagggtcggtattattggggggaggcaatgcacctggtctcacgtgaataatactgcatgagtcagatgtaagctgactttaataactaaatattagacatttggttcatcccgctcaatctttagaagtacacttttaggaatggttaaaaattcactgttaactttatgctaccaaactaaagaccaaatcattcatttttatttaacactggcacagaatagagcaatgggaagcacagtttcttgtctgggaaccccctgtgtaaaggacaagttaagactgggtttaaaataaatctccaaatgctgtgaccgaagtatggcccgtgcaccatggaaacaagggagaaatagggaagtggaagaaat

SEQ ID NO: 720205 - DNA, 1771 bp, Homo sapiens
  misc_feature (286)..(286): n is a, c, g, or t
  misc_feature (295)..(295): n is a, c, g, or t
  misc_feature (305)..(305): n is a, c, g, or t
  misc_feature (318)..(318): n is a, c, g, or t
  misc_feature (889)..(889): n is a, c, g, or t
  misc_feature (1042)..(1042): n is a, c, g, or t
  misc_feature (1565)..(1565): n is a, c, g, or t
gctggctcccattgacctatcgccgcagggcctggcactggtccatacggagattgatctcggtgaaatacctgtagctggtcagtgtctcaccctagagtatggccatgtagaagatccgtgtttcagatcgaggcccattactcgtggactcgttgtctgttgccacttcaggcaccatggcgagtagcaagaagctgctgcctgcagtgcttccttcttatggagtgttgcgacatcattaggcgctcccccacacatcatgatcgcgcgctcatggtatccntcacaaggntatccacacnacctgcacaagcnctgtgatatgtgctacctccggggtcctggtcccaatagacatgatcctccacatccccatgatttgtcagataggtcttgtgcagtcgcatgcattggacattgccgtgtcaagcgttatccagatattgccatagaggatcatatttggtcttagatgagcgtagcgcaagggcgccattcaatttgagcagacgctcaacacgggcatactggtagcgtaacactcattcgcttaaagttagacttatgccatttcgcttaataaatcgtctcatcaaaataggacttcctcttttggccctatttattctgcggaattgggggtcccgaacgtatgtgggccgaaaggttccctataatgaggaaggcccctattaaaaaaaagagtcactatagcgcgcctacccggctaagttaattcacgttatagacactggaagccaatgtgtgttgtctcaacacacatttggcgccttggccaatttgttatgcgcataagaccgcattttttaaacaacgccacattggttatggaaagcatatcatccaagagggtctacccacaacncgctcgcggaatagcggtccctttaggaagagaatacgcgtcgcgtttacgagtggcgaaacaaacattggtagcgagtaccgagccgatattgaggggttctgagcattcgaaacatataggataagaagcatgttaggttaggcccgtttnttacagaggttgggcacagttggggggagaagcttggtttaatcagatgacgccatattcccatttgaaggtaggcttcagaaggcatagtttcaatacattaacactataaattcaggactggcgtgccacacgtggaggtttaggcacagaggaaagaaaagcattaccgcttgacttgagacttccctaaggacaaacacaaacattgtgagcgttggtttcttaacaatgtggacaatgttggtaggacatacagtactaggggcgactctccaacggttagccacacacacacctcgttccgggagcaacgaaatcagtagagaacttcaaagcatggcaacaataggtaacacgaacggagagcccttgagggcagaaacactgggggccagccgcataattgaaggacaaactgcttaccgggagaacagacggacacacagacgcccctgtagcaccaacacgatgtacaaagggaccttgcgcgggagagcagaactaggcagagggacgccanggaagacgagcgagcgaacaaccttgagaaagacagccgctacgagacggtataacaaccacgaggccacacagaaagacaaacggcgatcacagagagtgaacgcaacaccgataccagcccgcggacaacacagacagcaacacatgcagaacgacacgacaacagaagcaggaaacacagccgaaacaacacaacatgaagag

SEQ ID NO: 720206 - DNA, 185 bp, Homo sapiens
ggatgatataccagctacagctagataccttgcttctgctaaatgagaagtgtattgtgtggcacgaaaatggaggccaggaagcaggggtcagagatggaggctgacctggtgcagagagtcacggtgagcctatggtggtggtgaggtggaggacatacgagggcctggtagatatgcctgct

SEQ ID NO: 720207 - DNA, 172 bp, Homo sapiens
ttcttatccagttgattgtcagatcactgctgtcgttgtcttctattcaccatgcttcttctgatatccaggtgaaagactgagagggtgctcaggccagcttttgagctgatctcagcctcggtcaaagatctgtccagattcccctttcccttcaagagagatcttcctg

SEQ ID NO: 720208 - DNA, 277 bp, Homo sapiens
aactgctacccctggggccttttgccccccggggtggggcctcctgcctgcctggggccctgttccagcccccggttttgtgcagggcccctgggtgggttcacacccggttttttctccccccgggggttgccagggcttccaccccgccccccccttttaaagatggggctgcctttttgccgggggcctttttttttgggccagaggagtccccctccggcctttccgaattcccttggggttccttttaatcccgtcccccccccccccccca

SEQ ID NO: 720209 - DNA, 142 bp, Homo sapiens
agaggaccaggaggggtgtagggtgggagggtaggaaagagccagagtagaccaaagtcaggggaggtaatggtgacagatgtaagtgtacatctggctagatttggtactgagctgggctctgtactcatgccctatgggg

SEQ ID NO: 720210 - DNA, 327 bp, Homo sapiens
  misc_feature (257)..(257): n is a, c, g, or t
aactttggaggggacaccatcactcaaaccatagctgtaaatctattccttgagtccagatcacaaattaccaaatgaacacgttctccatttttagtacttttttacctgtaaccctctgtctacctaagatgaatatttattcattgaatgaatcatttaattttggtgccccaaaattctcagtgaaacaatttctggatacctctccatcactaagataatcactatagcagtgtcatattcttcaacttagnacaaatctaaaggctccatttatccctactagaagtgttctgttgtctttttcactctcaaaatatcctc

SEQ ID NO: 720211 - DNA, 524 bp, Homo sapiens
gtatattatattctggtcgttccttgggttttaaacattggaaccaagcagttttcgctcttttaaaagtacagtgccttatttatcctttttgctatctttaaatttacaaaagctaaaaagctgatctatgtgattaaaggcttgtatctctatacttgatgcacatagcacttgtactgtagccgagaagaccaccatcatgcacatcaaaggagctgttctcagcagccagccctgcagcatctgccgcacgaacagatgcccttctatggcaaacccacagcagtgaacttccctctctgtcttgcattgttctgtttagatgatgtttgaaaggctaaacccaaatcattttactggtatgcagaggagtatataattatataaagattactatcttctgttacccccttttaaaaaagatcatgttcattgttggtccctcctctcaccgtttgatgatttgtcatttgagagcatgtattctaaattatgttaccatcggagccgagatctgtcat

SEQ ID NO: 720212 - DNA, 404 bp, Homo sapiens
tcaggatctcattcggccgggcaatgggaccacagagtgactgagatgtaatcagaagactatagacagctggccctccccacaccctacaactacaccaacaggactccagtgtacaacagcaggtgaaagctgggagagctgcacgacactcactctgtctgaggaagggaatttagggaagcccagagccagaggacaaaaacaagggcactgcaaggatcggaatacgccggcactcacagctacaacaaacattacacgtagcccacagccagattaacagaaaacctcacgttaaaggcctgtttacctcagttcccatcaccctatacatcatatctagcttcaaataacttacaaggcatgctagaagacaaaaaggacaacatgtttcttttttt

SEQ ID NO: 720213 - DNA, 167 bp, Homo sapiens
agatcggccgtgtcgggcgatcacatcgaggaggatcaccatcagtactcttggcaggatgaaatcgtgcaggggactcgaagggggacacagaaggacggtgcagtgggcgagaaggttgtgaacgcccttgtatgtcccagcgccctactctggaggggggacct

SEQ ID NO: 720214 - DNA, 609 bp, Homo sapiens
  misc_feature (84)..(84): n is a, c, g, or t
gaagttcggcggtcccgcgggtctgtctctgtgcttcaacagctgttgggagggaacagatccggggacctctcctttccaagncttccggaccggccctccggattttccttctccgtgcttggaaacccttccggggaaccaatcttctcgggccatcctcctggcattccgtgggacctgtgcacagcaaccgggtataaatggtggagtaaggcatcccattctcattgtgacccagaagacccaaaagacactaagttggaaacggcgtttccaccccagaagggaccacgttccaccggggcattccacagaggaacacattgttttaaatttttcccacaaaagcgcgtggaaaccgcatgtgtgttgcacacaggggcgcaccaaggggccgcccgtgtgttcacaaaaacagcgagaaggtcccccctgtgggggccctcccacaaagtctgtgggggggttacacccctgttgtgccgggggccctttcgcataaagaacttaaccttctctcgggggcctataatatttgcggagcggcgattgagtgtgcgctcctggaaaggccgtttgaacccaattatcttctccgggaaaaat

SEQ ID NO: 720215 - DNA, 750 bp, Homo sapiens
  misc_feature (32)..(32): n is a, c, g, or t
  misc_feature (61)..(61): n is a, c, g, or t
  misc_feature (65)..(65): n is a, c, g, or t
  misc_feature (79)..(80): n is a, c, g, or t
  misc_feature (86)..(86): n is a, c, g, or t
  misc_feature (118)..(118): n is a, c, g, or t
  misc_feature (120)..(124): n is a, c, g, or t
  misc_feature (137)..(137): n is a, c, g, or t
  misc_feature (167)..(167): n is a, c, g, or t
  misc_feature (203)..(203): n is a, c, g, or t
  misc_feature (274)..(274): n is a, c, g, or t
  misc_feature (313)..(313): n is a, c, g, or t
  misc_feature (345)..(345): n is a, c, g, or t
  misc_feature (384)..(384): n is a, c, g, or t
  misc_feature (396)..(396): n is a, c, g, or t
  misc_feature (423)..(423): n is a, c, g, or t
  misc_feature (437)..(437): n is a, c, g, or t
  misc_feature (454)..(454): n is a, c, g, or t
  misc_feature (464)..(464): n is a, c, g, or t
  misc_feature (479)..(479): n is a, c, g, or t
  misc_feature (604)..(604): n is a, c, g, or t
  misc_feature (624)..(624): n is a, c, g, or t
  misc_feature (663)..(663): n is a, c, g, or t
  misc_feature (668)..(668): n is a, c, g, or t
  misc_feature (724)..(724): n is a, c, g, or t
atgtcagtaaataaagtaaaaacagaactggnatcacacctctgtccagcaggcacttgtntcangtgaggcagttttnnaaagangctcccaggagcagcatctcaggacacctganannnnnggggctgcaaggnacacctctgtgtgcacacgcctgttctgtnctggagatgagctgtcaccttgaggtggcgtcagancttgactctggcttgggagccccaaggttaagggaaggttaagacatgatcaaggtgcccatgagattgtnacagggacatgctgggtttctgtggcttgactgcttggntgaacatctcatttttcaatcacacagttgcngttcagataggcatcaggaggcttggtctggtattaggnactgaagatgcngcccaatccctgaccagaacggtagcntcaaatgccttgtngtttccaggtggctgtngtagttactnaggagttctttagtntgttctcgtgaacaccaggttatgtggatggcaccttatacttttcaaagctctttcaatctgtccgctcattctcttctaggcattgtagcttataccccttcctctcaccgacgctggtttanacctgttaagttcttgatcntcacttctgctcccatgagttcttgcaccagttcctctnctgtngactttacctgcttggcagtttggcccatgttcattgcatcattaacccggttttncaggaagcgccaagtgttctcaaagt

SEQ ID NO: 720216 - DNA, 280 bp, Homo sapiens
ggagggtgttgccatttacagaaatcaggagatgagacagagaatatatgcaagtttggttttgaatattagattgaggggcaggtgggtagttgaggtagccatatccagtggacagtttaaaagctgggtctaagattggggccaggttgttttttgatatttagaaggtcattggtgactttagaaagtaatttcaggagagtggtggaggaggaagccatgtcagaaggataagaaatcggtggttgctgaagtggaactgtgggagtgggaaggg

SEQ ID NO: 720217 - DNA, 908 bp, Homo sapiens
  misc_feature (2)..(2): n is a, c, g, or t
  misc_feature (67)..(67): n is a, c, g, or t
  misc_feature (104)..(104): n is a, c, g, or t
  misc_feature (126)..(126): n is a, c, g, or t
  misc_feature (145)..(145): n is a, c, g, or t
  misc_feature (219)..(219): n is a, c, g, or t
  misc_feature (252)..(252): n is a, c, g, or t
  misc_feature (263)..(263): n is a, c, g, or t
  misc_feature (269)..(269): n is a, c, g, or t
  misc_feature (279)..(279): n is a, c, g, or t
  misc_feature (281)..(281): n is a, c, g, or t
  misc_feature (285)..(285): n is a, c, g, or t
  misc_feature (293)..(293): n is a, c, g, or t
  misc_feature (295)..(295): n is a, c, g, or t
  misc_feature (302)..(302): n is a, c, g, or t
  misc_feature (306)..(306): n is a, c, g, or t
  misc_feature (310)..(310): n is a, c, g, or t
  misc_feature (314)..(314): n is a, c, g, or t
  misc_feature (316)..(316): n is a, c, g, or t
  misc_feature (336)..(337): n is a, c, g, or t
  misc_feature (340)..(341): n is a, c, g, or t
  misc_feature (343)..(343): n is a, c, g, or t
  misc_feature (366)..(366): n is a, c, g, or t
  misc_feature (432)..(432): n is a, c, g, or t
  misc_feature (442)..(442): n is a, c, g, or t
  misc_feature (454)..(454): n is a, c, g, or t
  misc_feature (461)..(461): n is a, c, g, or t
  misc_feature (465)..(465): n is a, c, g, or t
  misc_feature (520)..(520): n is a, c, g, or t
  misc_feature (588)..(588): n is a, c, g, or t
  misc_feature (682)..(682): n is a, c, g, or t
  misc_feature (905)..(905): n is a, c, g, or t
gngcgggtaacaacgggatggctaggaagctacatcacctatttggttatgaacacagcattttcanatggctgggggaatagatgccacttcccactcaaganagggatttgctcagcgggaaancaggtaataaaggcagcanatcctgcactttgaactgcatccgtctcatcctgcagccaccctgtagctcaaagcacagttctggagcctatnaagtccaaatctcaatctacccttgagtcagcnaagccttaagnaaaaantccctcaaantntgtnttcctgtngnaaataangacngccncacnanaaggcattcgctgggccggnnccnntntccgaggtggcagtgtgcttggnctccatttgcctagcccgtgcgtgtgttcatcactggcagcggtgactgcgtgctgcttggggganagcacttganctgcctcaaaanaccctgntaancggaggacacttgcatggatggaagcaggaccgaggcaccgtgttggtccctgtnaaactctgggtgcactgaactttggggaggggtggtggcacagacctgggcctttctactctcctggnacacagaaataagcgctcccacttcccttctccactacggtgtttctctctggtgtggtttgggtggaagttaccagaaacgcaaagccctggncactgctacttctcctggggggagaacagatttgtggcctgcctttcgccaggagggctcctggccttgccttgctgatcggcagagacttgctcctcaaagggaaggggtagttggtccttctgagccatgtttccaacccatctggtaggctggtccctgcccgctctcactgcagcctgggccgcttttctctggcctgcatggaaggctgaccactggntta

SEQ ID NO: 720218 - DNA, 201 bp, Homo sapiens
gggcctggctgggtggggggaggcctttctgggaaggcgtttggtgcaggcctgtgctcactgtggcaccagcaaccctgggtttccctctttgttgctcccccgaaccccggggccctcctgttttcctcaactgtccctccttaccccatgtagctcgatccgaagccggggtgtcaattaacctgttttccgtgcgga

SEQ ID NO: 720219 - DNA, 480 bp, Homo sapiens
  misc_feature (313)..(313): n is a, c, g, or t
  misc_feature (323)..(323): n is a, c, g, or t
  misc_feature (362)..(362): n is a, c, g, or t
  misc_feature (436)..(436): n is a, c, g, or t
ccaggtgtaatgggcacagaggggcatgcctctggagggtgtacagccaggtggaatggacacagagggatgtgttctccggaggtgtatggccaggtgttatgggctcagctggggggaatctcaggtgtgggatcaggtgagggggtcaggcaagcttcatgaaggtgagttgatctaatacctgaagttcttcaaggtctcgttctattgtttccgctggtttctggtcatggtcctctctgggggttctggagaacgggcaggatgtgagtgctctacctgaaggcaccctggaggagcaggggtgggnctgtcacagnccaggcagaggttggtagaaacacagttagcaccctganttccagaggtccagtgagcaggagaaggtgagtgcagggcctagaaggttgtgttggagactctgagacttctngctttcatctttagctcccctgcaagcttggaaccactgtgcac

SEQ ID NO: 720220 - DNA, 269 bp, Homo sapiens
ctagaaggaaataccaaaataccattatatgaagagcagttgtctcaggttgggggatttcaggctagtgggtttttaaattttattgtttattacttccctgaaacctccaagtttcttacagcaaacaaacattacttttaaaatctagggccagcgtggtggttcatgcctataatgccagcactttaggaggctgaggcaggaggattacttgagtccaggattttgagaccagctgggcaacatagtgagactcccatttctgc

SEQ ID NO: 720221 - DNA, 262 bp, Homo sapiens
tagaggatccctgagagacgtgtgcaatgccttttcttggctatcatttgggatgtgaataattcatttagataggtccctttggacagactttctcgtttttcactaaaaagaacatatttttggtcttttaagggccatacccatggcatatgggaagttctcagactaaggggttgaatcgggagctgcagtggctgacctacaccaaaaccacagcaacgagggatccaagccacatccatggcaacagggtctctca

SEQ ID NO: 720222 - DNA, 225 bp, Homo sapiens
ttttgtaatcttgctgctaatgaacatatgtatacatgttatttaaaatagatttatattcctttgggtgtatgcccagtaatagtattgctgggtcaaatggtatttctgcttctaggtctttgaggaatctccacactctcttccacaatgcttgaaataatttacaatcccaccaacagtgtaaaagtgttcccttttctccacaacctcactacatgccat

SEQ ID NO: 720223 - DNA, 336 bp, Homo sapiens
tctgacgggtctctgttctgtagcccctattgaaatcatgtgatgtgagacagactcctaaacatggaccttgattctaaacctgtgccagtctatagcctctgcctcctcaatcagagctcaagccaaacgcttctgtcctctttccttctgcattaaccttttgctgatcctcacgggccatctcccccaacactccctgaacttgaggtgaggcgatgtttggactagagcctgtatttcctgttactggcatgatgggggttgttgctagactatgctttagctctttgaggctgattgtgaacaagtgggactagaagggcccagggggaa

SEQ ID NO: 720224 - DNA, 132 bp, Homo sapiens
ggtcagttctatgatggatccccccgctgtaccccatttgctgcgatattggtactgtgccctggtgctgagcatatacaccactctaccccctggattttcaatgggccagctgatgagcttcacctggac

SEQ ID NO: 720225 - DNA, 1343 bp, Homo sapiens
ggacgcgtgggcgacccacgcgtccggactccgtctcgaaaaaaaaaaaaaaagagttcttccatgctgacgcccccatgtttcgtcatgtgggttgttgaaccatgtgagaagttttgacaacagccttcaagattcattcagcaatgtgcctccgtgcaccaccaacgtgcttatagcacccctgtggccagggttcattccatgtgacaactttgggctactcgtggggaaagggacttctattgaaccaacaagtctcccagtgcccattaactgtggcaacccaagaaagaactgtggtgcgaagtggcccctctccgggggaaacactgtgggtggcgtgtgaagtgggccagacgggggctctcttcccagaaaacaatcattcccttggccttctacgtgggcgcgctggccaagggcttggtggtgcgcaagggtcattcccttggagcttgagaacgggagaagcgcctcaacttgggcattagggcctttccggtggtccccaattggccaaacggtggtccagtgggtgggaccttggaccttgccggtcttaagaaaaaccttggccaacattattcgattgacattcaaagaagggtgggtagaacgcagggcgtgtcggaggggcccccttcaagggggcgcatccttggggcattaccacttggaggccaccagggtggctctccctcggacctttcaacagcggaaaccaaattccttccacctttcgacgcttggggcgggcattgccctcaaggaccactttggtcaaagctcaatttcctggtatgacaaccgaattgggcgcttcacagccaaccagggtggtgtgggaccttcatagggccccaaattgggcctccaaggcagttaaagacccctggggaccaccaaagcccaaggcaaagagcccaaagagggaagcagagagacccctcaattgctgagggagtcccttggcaaattaagttccccagcccaagttgaaatttttcgccttcttaaaaagctacccatgggtaaaccccttgaatacggggaggggcgccgagggaaagcggacccgtttggttggtgccccgcaataaacgtccccggtgtgtcaaccaaaaaaaaaacataaaaaaagacaaaccaaatacgacaatactatacgaaaacacaaagcgggcggggggacgaaaaaaataagggggaccgaatacacccctattatagaaggccactaacgcagtaaaaaacagagcgggcaaaatagggagaaaaagctgcactaagagcctttgggcaaatccacacatcgacaatatttatacggatgggaaaaa

SEQ ID NO: 720226 - DNA, 177 bp, Homo sapiens
aaactcacgcagggaagtaatgtacgctgaggatcctcatgaatgctatgccaaagtgttccatgaatttaaacctcttgtgaaagagctttaaaatttgataaaacaaaaccgtgagctttttgagcagcttgaagagtacaaatgctaaaatgccttatcagttggttatactaa

SEQ ID NO: 720227 - DNA, 242 bp, Homo sapiens
caaagtgctgggattacaggcgtatatcattatttttgagacagaatctcatgttgttgcccaggctggagtacagtggtacgatcatatctcactattgcctcaacctcctgggctcaagcaatcctcccacctcagcctcccaaatagctgggactacaggtgtgccccccgcccagccagttgttaaaattttgtagagactgggtcttgtttggttgcccaggttgatcttaaactcc

SEQ ID NO: 720228 - DNA, 255 bp, Homo sapiens
atagctcactcacatggacttccgtcatgaaatgcctgcacgggtatcctcgtcttatcagcgcgtcggtagggacgcgcggcaatgcccgcaacttgcccgccgatgttcagtgcatccagtatttattcaatttgatcattcccaagatggggtttgccttgctggaaaacggcaagtgcgacggccagttggtgcaatgcatcagccagtatcagtttcgccatctcaagtacgcccatgggtgtgctttca

SEQ ID NO: 720229 - DNA, 369 bp, Homo sapiens
gctatccaattttagaaaccacttgccaaaggaatttgtactcattctcagtctcttcggtcaatttcgtatgacaaagaaatttgtgtcattccattctctaagtgcctatattgagccctgttattttgagacttcctcatatgcttgaataaagccaatgcttaccaaaatccaattgtcatgtctcactggacccagccagagggtacagaggcgcattaagcgtgtttggaattcactgaaagtaaagccaccactttcttctgtcaattgtaaatacatatattttcttctctctcttttttctcttttctcttttttttttagacagagccttgccgtgttgcacagtctagagtacagtgg

SEQ ID NO: 720230 - DNA, 671 bp, Homo sapiens
  misc_feature (573)..(573): n is a, c, g, or t
agtatgaagacatctcttcatcgaggactaacccctacagcttatgcaatgagtactgaataagccagagtttcttacctaccatatgtggccattaactttttgtcagcatcagaattggcaagagctggtttttattatatagggccctgcgagatacggatagctctgctttgccgtgtagggtgggacagtcttcgagtaagctgaggaaaccatagaggtatgatcgctatgtcatgagacatccggaggcgttttcccaactgtaccatttaggggataaattctctggaaactctgaggtattagcatctgtcaaatctgaggcatgcagacgacatgcagactctgaatgagcagacattatatgtacgtggccgtctattgtcacagttcagcctgagcagcttgcaagtgctggtcagattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtntgtgatgagattcaaggtagatatcctcatcttcttgaacagctgttgtcaacttcagataccactggagaagaaaatgctgacccaccaattattca

SEQ ID NO: 720231 - DNA, 401 bp, Homo sapiens
gggatgcgtgcacgaggtaagctggcctatccctagttctgtgcacccgccatgagggcctgatcctgttcccaagaggagctctcagatgggagctaatagatgaattagcaccttcctgcacgtctgggccagcgctgagttgggaaatggccttcagagttactccggggcagatcaggaaatcctggccagcagaacagacagtctgctgtagggtaaaccttgtaaaacccaggagcctgcagaagtgacagtcattaagcagaatcctcccccaaagctgcagagaaatgtgactttgtctctgacaggaggtgggggaatgtgggggtggcaggatttatataaatgtgtggtgaggctttgggggcttcacagtcagggcctcagcagcaacc

SEQ ID NO: 720232 - DNA, 227 bp, Homo sapiens
atcaagctgagcgggccccgcgcgccttgggagctgaacaataaatgcaccaagttgcggtcggccgtcgagcgtatcgcggcgcaacatgcgggtgcgccggatgccgtaggggcgttggtccggctgctcaatgtcagcggtacgagtattgaatggggttacctcaatagcggtgtgcacgacgctcagcgcgatcatgagtttgatcgggcgacggtaagaac

SEQ ID NO: 720233 - DNA, 157 bp, Homo sapiens
  misc_feature (120)..(120): n is a, c, g, or t
gctgggatcagtgcgtgagcactgaatctgtcgtagcatatcttatatacatgttatatgccagccaggtcccatgctgaattcttcatgtatgatctggccttcatccgcagcaccatnttacacctattgcctgtggcttcagacacatctagtt

SEQ ID NO: 720234 - DNA, 310 bp, Homo sapiens
cagtccccgtcccaatgagaaacaagaaggagccccctccacatggattcccccctgcaagtggacagggacattcagtcctgcactgttcccctgggtttattgatgattcctgggtgcccccccatcctttttgatttgtgagaaacaggtaagctgctgtgacttccctttaggacaatgttgggtaaatttttgaaggaccccccgaagccctttatactgtgtttttttccccctttcacttttggcttttttatgttgctttcatgaatggaatggaaaaaaaatgactcagttaaggccccca

SEQ ID NO: 720235 - DNA, 144 bp, Homo sapiens
accgtatagggcgatagaaattgaaactggcgcaatagacatatagtaccgcaagggaaagatgcacaattttacccagcataatacaatagcaaggactaacccctataccttctgcctaattgaattaactagaaataactt

SEQ ID NO: 720236 - DNA, 845 bp, Homo sapiens
tgcgcataccagacttcgctcgtcactcgtgcgcctcgcttcgcttgtcctccgcttagcatgtctgagccaaacccgatattggctgagatcgagaaattcgataagtcgatactgatgaatacatagacgccagagagaattccacctgctcttcctataggagaatagcgattgagcaggtagagcgctcacgcaggcgaatcgtaatgaggggtgcgcgccgttcaatatgcactgtacattccacaggctatagccttcttatcttattttcttttatgctgtataacttttgtaagtatgcaaaacgtagtgtgagtggatccatgtttggttgactgttctgtcccctttcactattcaaatgaagctacctgttatcacatcgtagacgtgcctgtcgtcctgcctcttcgcacatctgtctaatactaatctggcttgggcagggaaaggacagaaacttgcatgttggtgaagggacagaatgtggggtggaaagacatgtgcgaggtgtagatcgactagtgaaggatctagagtaagaacctaggctgacccaaaggtgtcctgcaagagctgttagtgcagctttactcagagtgccatcgttttcctgggtcccagatgacttctagtctatggggtagtgcccagaatgagttgaatatgggcatgtccttcggttcatactcctttgagtaacaaagaacaatgaacaacctttaataaccgtactaggtggggaacacactaacataccctaaacgtcaaaatgcatagaaggaaaataatacaacaaaaagaaatcaagaggtcccacaccaaacaaaaatacacag

SEQ ID NO: 720237 - DNA, 809 bp, Homo sapiens
gttgcagtgagccgagatcgcaccattgcactccagtctgggcaacagagtgagattccgtctcaaaaaaaaaaaaaaaaaaagggaaaaaaaaatagctttatacctctttccttggtctcaaccggccatgaaatttcctggaaacactccaaatttcaggtggaattaatcttccaaaacaaattttataggtataaaatattttactctcttataagtaataggtatacttaaaaaagcgcctcaggggtatatttatcttctaaacaggctacaatccaggtggcagcttactttacccaattaatgtcctctagtggagaacaacctagtggcctattttcactggctgggtgtatgcctcagtggcctaaaacttgggcggtgccaaataaattattttccgtagattttacacctggaatttggtaaaaacccattccgtttttggtttacaattggccaaaaattctcaaaaggcgccctgtattttaatgtaatcccttggacaatcatacatttaatttggaaatttctcagttatggacgggagtgggggggggctttagtacataagtactcaaatatttattaaaaccctcaaatattgggacttggattttacacaagatctttcccttttctacaagttattttttttacaaattcatgggggttatctcctaaataggtatatataatgggttctagaaccatgtttcaaattatggtgctttatcagaatacatggtataaatatatcccaaacaatttcatagttttcaaagactaatttctggatgaga

SEQ ID NO: 720238 - DNA, 195 bp, Homo sapiens
  misc_feature (123)..(123): n is a, c, g, or t
gttcgacggaagcatggtctttgtaaggagtgaaaggagtcatgaagaatgatgacaaagtgctgcaacccttccaggtcccaagacgactgaagaccactgccgtgctctttacctacgcantccttaatcaggggagggggctggtcccgggcaacaagcagtctcctaggagcagaaggtgatggaggggca

SEQ ID NO: 720239 - DNA, 974 bp, Homo sapiens
accagtgttaggaggttaccctctcaatcaagatactcaatgcatttccactacttgcactcattttatgagtgcacgcatgaactatgtacagaagagcgacatccatatggagatcgcagtctttccttatgtaatatgttcctagatgaaatggccaaaccaagctcgaaatctcatcactgatattgcacagaacagtgtaccttagtgaccagttgctacccaagcattgtgccaaaactccatcagtcacagcagtgaataagcacatcaaacaacagcagactggtaagcaaaggggaactgaaacagggagacaccaggtgtgagagcatgaggcaacaaccccggctggttgtgacacacttgatacaatcgcacgactgcactttctgagttatgcttctctataacattatgtaccaaacatggtggtactgggaacatactttacccacgcgaatctttcgacttctcatctggaaactacgctttaccaagtcactgtgggatgactatgtatcatcaagccacacaggaaattgccaaaccttcagacatatctaacaacgtgtcaagagcataatgcacgtagtccagtcaatagaacaactctgtgcacgatgatactacagagtattcatcactgtgcttcttccacaccaccacccacatgtagaacagctctggagagcccagccactccaggtctattccgcacattgctaccggaacacttgtttagcaccgttagcacggccacttagcattttcccgccagcacaggcgttgcgacctcctacgcgctgtatccatccatgtcgagacttcggcacccaaccgagcacaccactccaggcgatggataccatccgcagacaggattataacggacgcaccgcggcaagctccacagcaccacaccaacgtccagcaatcccagcgccaagtcaagcacctggtccatcaca

SEQ ID NO: 720240 - DNA, 417 bp, Homo sapiens
tcacaagtccggattcagaccttgtttagacaaggtagattggcgtataaaatagaaacgcagtgactcatctcttatatggtgttttgtagccacgtgtccagtttatagatatgagatggcaaggtctagaaactctgttaaatatcaatgttcccttccaagaagggaaaacaagttccaattttgttttaaacaagaagtatgtagtcttagagggactgggcatgaatggccatatgtgtaacctgtaccaaattaagctctcctaaatttacagacgacaaggaactgaacccaaatgtctaaatgtacaggctttgctgtactacatttcagctaatattggagaacgtgatgacaattttaaaagttgctattaccaattctgtctactgtagcaagataccttaagtt

SEQ ID NO: 720241 - DNA, 302 bp, Homo sapiens
ggtcagacacttgtagagataatactggctcagccggcctgcagtggttcatgcctgtaatcgcggcactttgggaggccgaggtgggtggatcccttgtggtcaggagttcgagaccagcctggccaatatggcgaacgcccgtctcttctgaaaatacaaagattggctgggtgtggtggctcgcacctgtaatcccagctactcggaaggctgaggcaggagaaccacttgaaccagggaggcagaggttgcagtgagctaggatcgtgccactgcattccagcttgggcgatggagca

SEQ ID NO: 720242 - DNA, 821 bp, Homo sapiens
ggctaggtctgaggctggtttaattggccgagtgtgggatctcgtgcggttgcggtgcagtgaggccgggcagtgggtcggatgggaccgacggactgcacgggctgggcgtgctgggagccattgagcgcggcccttggtgcccggggtgcgctgggcctggtggtagtgcttcccacggcactgacatgatgacctgtgttgcgaggctcccttgggtgctcgtgctttgtgaccgcgatggggctgggccctgagcctcctaactggggctgctgtctgggtgcgtgtagcttggggtgtgtggctgctctcccccctgcccgctgactcggagcacccccacccctccccttgcctgggccaggccgtgggcggcgttgttggcgtggggccccggtggaggcccggccttgtggctggtgcccgccatgaatgggcttgtcgctgagtgagctctgcctgcctcgttctgctgcccggccctgcccctggcctgcatcagctgccaaggctcgccattccttgcctgcggtaggccacctactccctggttgcctgagcccgagccggggccttgttgttggccggtggcctgcccctttggggaccctgagagcctcctcggtgcgcaacccggggcgctggaagctgcaccttgactgagcgtgccgagtttcccagtaacagccagcggcgagctggacaccatcgaggtcttccccagcgagagcgccggtggaacagagtctcttgcgtgtatttcgttgggtcttgtgcggttcccggtcctcttttcgggggaatcggggctgggcgta

SEQ ID NO: 720243 - DNA, 161 bp, Homo sapiens
ggctgaggacgcacggagagacagtagacagaatgccagtgtcggaacgcagaatgtacgaacctcgcatgcacgagtagttcacagtagctacgctagtctgacctcgcgtcgaaggttcgctgagctcggtatgatccgtgcgatcgcccttgaccatg

SEQ ID NO: 720244 - DNA, 114 bp, Homo sapiens
caaagcccagtataacaggggtgagctaggaaaggatgaagccaaagtcgatgtaggatagatagtggcctatctagcgtaccacaacaggctattcccactagtagtctagtc

SEQ ID NO: 720245 - DNA, 468 bp, Homo sapiens
gcatagcatggtggatgttacgtgaacacatggttctcgtatggtgacctggacaggttcggggaaggagcacgagctagtgggcagggggacactgatagttctcttgggcctatttcaactttgatatgtccatgggacagccaagtgcatggcttcaggaggaataccagtggacaattcatgatagatccattaatgaaacatcaaactttgaaaattattagcatattgatgatattctaaaccatgctgggatatctgcatagaaagagaatttcgataacgaagataggaggatttagatagaaccctaagggagtccaacacttaggggcagcctagcaaataagactgacagggaaagatgggagaaagtgtggtgtcatggaagctgggaggatcaaggcatttcattaaacaagacagagtggtcaactgttcaaaacgttgtcaagagttgagaag

SEQ ID NO: 720246 - DNA, 279 bp, Homo sapiens
tggacaaacccttgttctgttgcccaggctaaattgcagcctctgcctcccggtttcaagcaattctctttcctcagcctcccaattagctggaatcacaaacatgtctccaccaggttccagctaactttttatcctctggcagagacgggtttcaccagtgtggccaggttgttctcaaactcccgatcctaagtgactcgcctgcctcggccccccaaagtgctagattatagcccacccaattccttttttttaaaagtgctgtccataaggtgc

SEQ ID NO: 720247 - DNA, 990 bp, Homo sapiens
  misc_feature (163)..(163): n is a, c, g, or t
tataatctatcggataggccatcttcatttctaggagtactagtatgatcggtgacctctcattatcgtcccgtactatgcctatgaggcataatttaatattgtcgatacacacagaactactgtcataaacctcattaccaaacctctctcattaggcgantgattgtcgacccttaatatgcgcttatctagggcatataggccggcattgcaatatactgggggggagggccacatggcctatgtgagatctgcgaatcgtccaatactattcattgggcccgagcatatagtgtatcataagccttgaatactacatgcccaggtgactaaagagacttatattcgaacacgacatcacacggtatattcactatctcacttgtcatgacttgggtacccataaaggttccatggcatctttgaggtgtgatgatgccggcgcctccatgactatgtgtatcaagacatacatgcgttctggctcatgtttcaaagctgatgcgaacatcctactattgtagactgttcgcctcgcccttgggacatccgatcccctcttactgccacgactctactcctaatgcctcggaaatacctatacctgacatttgttcgtaaatgggcacggcccttcggtgacgctcagacattggcaaagacaacctaaattataagctctgcgaaagggagcaggcacctctcactatcattaattatttaatgttcgaaaaccgggtccaagtatcgtagttaccaagttgtcttggccaacgacaggtgttcgcagcctggaccaagtctcacgcgaggcggcagcgggccactggcctgcgaccgctggattcacaagcacacccaaacacacgcgcctaccgtggaccatggaccacagacccaagcgatgagacccgtgcccctgggcggaatcaacctccggctctgagacccacgtagggaccaggagagcacacgcgacacggaacg

SEQ ID NO: 720248 - DNA, 124 bp, Homo sapiens
ccgtgctcgccgcctgcgacgcggctcgggcggggctggccggggccgcggtcgaggacgccgcggccggggtcgccgcccggtgccgggtgctgttcagcgtggagaacctggaacggctgcg

SEQ ID NO: 720249 - DNA, 1615 bp, Homo sapiens
cgttttggttgtcgttgttgctctctttttccttcttgtttgtggtctgctcttcgtctctctcccccttgttgttgttctctgcttcctcttatgttttctgttttcctctcccgcggtcgtttttttctcggtttggtctttcactcttttttttgggtggttcttttcctaacttcctgtctgtcttgtgtgctctttttttctcttttcattctgtcgcttgtgtgtatggatgtttgtcttcgttccttttattatgttcctgtctgtgtgcgtgcgttcttattctcatcgatgctcttctgtgttggtagtagctcgctccgctccctgcatctatcttgtcgtgtcgttcactctcttcttgttttccatcctcttttcgccttgtggtgcgctctctgtgtgtcgtttcttcaactgccgtttgtgtcttttccccgtttgatttttgtggttgttcatacatttctatcctctgctgtattttttgttttgttgttttcttcctttcgtgtcgtcgggtgactccctttctcttttttttgtggtgtttctcgatcctctctctgtgttctcctcctcctgttgttgttgttacctcctcctgttttcgctctctctcggtgggggctccccctcctgctgtgttttgcctccgctctcttctattaccctcttttgtttttctttgttttcgatttctgtcttcccccccctttattgttggggtggctcctcccctctctttttgttttgttgtttttttttttatgtttgatttattgtttccctcttgtggtgtgcgctctgtttttttccgtcgtccctaatttttgtctcgctttcttttctgtacggttgggttcttctcccccccctttctatcttctcctcttctctctctccacacgcatcctctctctctcgcacacacctcccccacggtgctccccgacgggggccacacaccggggctctcactaaaagccacaccgctctctcccctccgccacccgcgcggtagagaataagagaggtatcctccccctcactagagagagagtgcgcacacaccgctgcgccgcgccccctcgtgtgtgggactctttgtgtggtcgttccctcccctccttcctctctccctcctcccccctctccctctcctctctctctcggtggctcccccacatatttttttttgtgtggtgggctcccgcggcggggtgctccctctgtcatcccctctcttccgccgccccgcggggcccccccgcgcgtgggctcctcttgttatcccccttcctccctcttgttgggttccccctcctctcttctcttctctttatctccccccgttttctcgcggcggccccccacagcgcggggaacataaagggcgcgcgggagctcacagcggcccccccttttacccccccccccccgcgcgagacataaatcaaggtcccccccccccccccccaccacctttgccacacccaaaacagggggccacccccgccgcggggccccgcgcgcccccccccctgtggggggggggacaaacgccgcttgtgtgtttataagaagaaaaaaaatttttaacccccca

SEQ ID NO: 720250 - DNA, 169 bp, Homo sapiens
gcgagcttcataagatgagaatgggaagtcaaggggtgttgtgtggttaatgttcgatgttgccagaggtgtgcgagagagcctgccggatgatgaatggcatgaacgcgaggttgctttggtggaggaagaggaggtggcgtggtgggcgggtgtataggaccgacgt

SEQ ID NO: 720251 - DNA, 753 bp, Homo sapiens
  misc_feature (753)..(753): n is a, c, g, or t
ataccaggcctggcacagtggcttgctcctgtaatcccagcactttgggaggccgaggcaaggggatcacttgaggccaggagttcaagaccagcctggccaatatggtgaaaccctgtctctaccaaagatacaaaaactaactgggcgtggtggcatctgcctgtagtcccagctactcaggaagctgaggcaggagactcccttgaacccgggaagcggaagttgcagtgagccgagattgtgctgctgcactccaacctgggcaacagagcaagactccatctcaaaataaaaaaggcttggcatggtggttcacgcctgtaatcccagcactttgggaggccaaggtgggtggatcactacagcccaggaattcgagaccagcctgggcaacatggtgaaaccccgtgtgtaccaaaatacaaaaaattagttgggtgtggtggtacgcgcctgtaatcccagctaccctggaggccgaggcatgagaattgcgtgaacccagaggcggaggttgcagtgagctgagatcacgccaccatactccagcttggacgacaaagctagactctgtctcaaaaaaaaaagaataccttaatacatgttccacctaacttaggatagattagctgtgccaatacaaatgaatcccattcttttccttaaccacagaggtaaccactactcaagtcgaattctcaatgttggtcaacccggttgcttgattagctttgcttacttcagggaaan

SEQ ID NO: 720252 - DNA, 154 bp, Homo sapiens
tttaactagatttgtctccaaataggagactctgcgatagatttaactcatattactacaatagagccaagacagtagatcaaaagatattctacgatatatgctcaagcctacaagcaaaacgccaggccaacaacaagcgtcaccgagctcc

SEQ ID NO: 720253 - DNA, 696 bp, Homo sapiens
  misc_feature (13)..(13): n is a, c, g, or t
  misc_feature (83)..(83): n is a, c, g, or t
  misc_feature (115)..(115): n is a, c, g, or t
  misc_feature (131)..(131): n is a, c, g, or t
  misc_feature (133)..(134): n is a, c, g, or t
  misc_feature (137)..(137): n is a, c, g, or t
  misc_feature (142)..(142): n is a, c, g, or t
  misc_feature (157)..(157): n is a, c, g, or t
  misc_feature (165)..(165): n is a, c, g, or t
  misc_feature (174)..(174): n is a, c, g, or t
  misc_feature (177)..(177): n is a, c, g, or t
  misc_feature (216)..(216): n is a, c, g, or t
  misc_feature (225)..(225): n is a, c, g, or t
  misc_feature (236)..(236): n is a, c, g, or t
  misc_feature (243)..(243): n is a, c, g, or t
  misc_feature (257)..(257): n is a, c, g, or t
  misc_feature (266)..(266): n is a, c, g, or t
  misc_feature (268)..(268): n is a, c, g, or t
  misc_feature (270)..(271): n is a, c, g, or t
  misc_feature (275)..(275): n is a, c, g, or t
  misc_feature (279)..(279): n is a, c, g, or t
  misc_feature (282)..(282): n is a, c, g, or t
  misc_feature (292)..(293): n is a, c, g, or t
  misc_feature (297)..(297): n is a, c, g, or t
  misc_feature (300)..(300): n is a, c, g, or t
  misc_feature (311)..(311): n is a, c, g, or t
  misc_feature (385)..(385): n is a, c, g, or t
  misc_feature (440)..(440): n is a, c, g, or t
  misc_feature (547)..(547): n is a, c, g, or t
  misc_feature (602)..(602): n is a, c, g, or t
  misc_feature (605)..(605): n is a, c, g, or t
  misc_feature (630)..(630): n is a, c, g, or t
  misc_feature (634)..(634): n is a, c, g, or t
  misc_feature (675)..(675): n is a, c, g, or t
gagggggggacgnggggggttagtactagttgaatatgatttaaatatgtctgcatttagatgaacagaacagggtaaaaggnactttgccaagccaagctcaattcctggccanatggggggggggggcngnnggngcccncgcccatttctcggnggtcggtntcggcggcngtnggctgaggacaaacgggctcactatgttcttcacaaagntcatttttnttaagtggggnaaatgtntcggctctcttgcntttccttcngngnntggnatgnggngggctggggnngccnggngctcgggcgcngcgagggcgcatggtgcaggctggcgtgcgcaggtagccaaacagaattccccaagaccttttatttgtttaanatactttggtgtcagcagagtctgagcagacacgttactcatgatgctcgggagnccaggcagggccctgctgagctcttctgaaagtatgtggaactattcaacgcgtggcactaaaagggtacagactcccgaattagagttcattaatgcagttgggcnaccggcttttctgtttagccactggttacttaaggtttccaataaggtttgggcnaanggtcacacgtcctcatagatgaganacantgtaccagccttgagagttacatcaagtgtgtttaaaaacncccaccccatcaacagcagct

SEQ ID NO: 720254 - DNA, 338 bp, Homo sapiens
  misc_feature (7)..(7): n is a, c, g, or t
  misc_feature (41)..(41): n is a, c, g, or t
  misc_feature (64)..(64): n is a, c, g, or t
  misc_feature (179)..(179): n is a, c, g, or t
  misc_feature (334)..(334): n is a, c, g, or t
cagtttnccccccaccaagagtcccctaaccaagggttgancctggcctagaatgaccagaatnccagtatatgggcagaaaccaaagattattgagatttggggagggaagacaaaaccccaatcccaaggaataagaatccacaataatgtgatacaggagctgaaggatgaaatancccagtattagaaagaatttaatgggtctgacagagctgaataacgcaatacaagaatctcacaatgcaatcacaaggattatcagcagaatatactagtctgagggaagagtttcagaacttgaagactggttttctgaaataatacagtctantaaa

SEQ ID NO: 720255 - DNA, 166 bp, Homo sapiens
tatctgaccagaagccatttattacagtaaccaatttatttcttagagttcaaaaccttctgtgagaatgttctctggcctggttggagatccaccttcttcttttttttttttgagacggagttttgctcttgtggctcaggatggagtgcaatgacgtgatctc

SEQ ID NO: 720256 - DNA, 289 bp, Homo sapiens
tgaagcctgcacgcggcagttttttattaacgatctgagggactcctcagtcttggggggtcaccgcctgcaacctctgccaagccctgcgtccagcgagcgtcacagcacagcctgcaaaaacggagttgggcttcagctggggctggcatggactttcatttcagagattcggtttttaagaagatgcatacctaatgtggtcgttttttgtgccaatgacctctaatccacattttatgactggaaactttgtttgtacaacactccaataaacatcttgatttta

SEQ ID NO: 720257 - DNA, 377 bp, Homo sapiens
tacgtcctcacccaggatccaggttctgcagcccagccccccaacttttttttgttgttttgagatggagtctcgttctgttgcccaggctgaagtgcaatggcgtgatctaagctcactgcaacctccacctcccgggttcaagcgattctcctgcctcagcctcccaagtacctgggattacagatgtgtgccaccacgcccagctaatttttgtatttttagtagagacgaggattcaccatgttggccaggctggtctcaaactcctgacctcaagtgatcctcccatcttagcctcccaaagtgttgggattacaggagtgaactgccacacccagccagagaatagtgttctagacggtaagggagatgag

SEQ ID NO: 720258 - DNA, 138 bp, Homo sapiens
cctacgtgcgctgcgtgggcgaatcctgtgccgtgacgctggatcgggcgcgcatcgaagcggaaacgctgcgggttcacggcggtttctgcccgcggcatacggtaaaagtcttgcatcacgatcccgaattggcgg

SEQ ID NO: 720259 - DNA, 1556 bp, Homo sapiens
cttattaaggtgttcccgtcggaggtcttcagaacgggggggggttcgctatgttgcttggcgtcccgagcgtgtgtgtatgtgcccccgcggtggtccgccctgtctgcgacaaggcttgtggtgtgttggggagagtggtggtggcccctgttgttgtcgccacgtacgtcgtcttccaggggagcgccgtggggtcacatgtggagacttggacggattgttgggcggtgatttctacccgggcgagtgatgagtttccgagcgggtgtctcctcttgtggccctcttgtctcgctggagcgcattgttttgccccgctggggggggccgccacgcgttgggggtttgtctgccacgacgaggcgtttgtgcagacaccccccgtggtatgtagagcacgcttgtgtcttgttatacactgggggggggagaatatgtgcgccgcagattgggcgcgcgagtagatttcgttcggcgccctttggcgcacatgagaggttgctttgccgccgtggcggaagcacgaaggcgctttgcctaatgtccgggggggccgtgcgtggagcgccctgaattctgttgtgtagtagcccctaagcaggtgtggccgttggtgtgattttcccctccgttggccccccccctctcggcgaaaggagggttttaattatgagggggaaaacaactgcctcccacttatgggttgagcacccgctcgtcaccacaccgctctggggatagaaaagcgcgctttgggcccgctatagccttgggcacaaaggacaccacaggggcttctcacaggggtagagtatttgccctctgctgtgtgtgagcagtttcggggggcgcgggccacacacggcacttggggttttcgaggcgtattagagtgtggccacagacccccctcggtgcgctgtcacctctgttgggtgagacacagagacacccttttctattgggagccccgggagagcgcgcactctcgctctgtgggccccctcggtgttgacacatggcgcctatagacgtagacgctgtgggtgtgtgcacacaaatatatcacgacagatggcgtgtgcacatgtgtgtgcgcacataacctgtgtgacacacacgtataagagccacgcgtaatggtgcgcacatggcacattctgtgtaagccacacacacaatgacacagcccaccacggttttcacagagcacaaaatgtgttcacaggtgttgagggtgagaggagaaaacacatggtttcacggtgagaggagataaaacacacattctatgagcacacaatgttgtcacggtgagggagaaaataaagggggaaaattggggatatggcacgaatgttgaacttgaggaggttaaatgtgagtctttggggagagaatacacttcttaataagagttatgagaaatatgaaatctgaaattttctaaaagggaagaatttctggcttgggaagtacatgtaggagttaatccctgtgtagactgttgtaaagaaactgttgtaaaataaagagaagccaatgtgaagcca

SEQ ID NO: 720260 - DNA, 154 bp, Homo sapiens
  misc_feature (4)..(4): n is a, c, g, or t
taangacacttaccaccactcttctgggccagacagacacgcaattctcatcttctttaggccaggctcaggtattccacagtcctttctccgttagataccctcaggtccttcctccaacttctgcccctcattaagcattatacttgggtcc

SEQ ID NO: 720261 - DNA, 135 bp, Homo sapiens
agagtcttgctctgtcgccacgagtgtagtggtactagcaatctctgcctacccagattcaagcaaatctcctgcctcagactcccgagtgactgagattgcaggcacctgccaccaaacctggactaatttatt

SEQ ID NO: 720262 - DNA, 211 bp, Homo sapiens
tgcttagtacccgcgtgttcgcggcggcgattggacagtcactccggaacacacacaactcgacggcttcaacagccttggcaccagccagtcaggcagcaagggaaaccccaggccttgttgtgcggcgatcagctgtgcgtcgagctcgttgatgcggatagcgtctttattgcaacagcggcgacacctcatgcctggggtaccgggc

SEQ ID NO: 720263 - DNA, 191 bp, Homo sapiens
cggctcgcggaaaaaaaaaaaaaaaacgaagaaaggaaaaaaattagccgggtgtggtggtgcatgtctatggttcctactcaggaggctggggcaggaggaacacttgagctcgggaggaggtcaaggttgcagtgagctgtgatcacacttttgcattacagactgggtgacagtgagaccctgactaa

SEQ ID NO: 720264 - DNA, 380 bp, Homo sapiens
  misc_feature (24)..(24): n is a, c, g, or t
  misc_feature (48)..(48): n is a, c, g, or t
  misc_feature (58)..(58): n is a, c, g, or t
  misc_feature (62)..(62): n is a, c, g, or t
  misc_feature (76)..(76): n is a, c, g, or t
  misc_feature (109)..(109): n is a, c, g, or t
  misc_feature (142)..(142): n is a, c, g, or t
  misc_feature (149)..(149): n is a, c, g, or t
  misc_feature (151)..(151): n is a, c, g, or t
  misc_feature (218)..(218): n is a, c, g, or t
  misc_feature (233)..(233): n is a, c, g, or t
  misc_feature (250)..(250): n is a, c, g, or t
  misc_feature (255)..(255): n is a, c, g, or t
  misc_feature (260)..(261): n is a, c, g, or t
  misc_feature (265)..(265): n is a, c, g, or t
  misc_feature (276)..(276): n is a, c, g, or t
  misc_feature (280)..(280): n is a, c, g, or t
  misc_feature (284)..(284): n is a, c, g, or t
  misc_feature (311)..(311): n is a, c, g, or t
  misc_feature (325)..(325): n is a, c, g, or t
ctatccaccaggggttggagttgnctttgtatatcaaccgtggaaggnctgttttggntcancattctgtggtctncctgggtagacctgatgcagccgtgtttctgangaaaggaagaacagcttttgttttgtgatatgntaatggnanatgtagtgccatggaatgatgcagatttcattcagatattcttggatcttggccccaggactgcacncattcttccctatantgagcattggtagttancaggntttanncctncctttaattgnaagncttntgaagccaaaaactgtatccaatttgncactgtcccctaanagtacttagcagtgtctgatgcatcacagggagtttgtaaatgtttggataaata

SEQ ID NO: 720265 - DNA, 425 bp, Homo sapiens
atctcattcgtggtcttgttagagctaccatttaggataccattggattaagtttctcctaatctccattggagtagtgatctgtttccatgtctacatcattactggtgaagtttttaacttgttgtgatctttacttcttaatactgtttagttctggtacattcaagttggatgactggtgtttattactattgcaatatgattgatgtgctttatttgatattacaccattactacgactttcaaaacctgaacaatgtgcggtgcttcctttgcctgatgctaatttgctggatattcattccatggctggggctcatacttggactactaaaaggtcgaggactaacaggataactgtcttgagactttggacttcggcctcccaaacatcgtacttcactatctgtaccattcaccat

SEQ ID NO: 720266 - DNA, 379 bp, Homo sapiens
acccccccaggggaaaaaaaacttttttggtgggttcccaaaaaaaggtaggggctcaccccttttttttaaaatttttaaatccatttcccaaagggtccctttttttttaccggtttttccaaaaattccctttaaaaaccaaaaaccaaaaatggaaattttaagaaatggccctttttaacccccccggtttttttttcgggggggaatttttagcgcccaaaattaaaaaaagggtttgggtttttccccccttgaaaaggcaaaaacccaaaaaaaaaaccccctcccaggccaagggtttggccttttctttttaaattgggtttgggggtttttttcccaaaaaaaaaaaaaattaaccccttttttttta

SEQ ID NO: 720267 - DNA, 138 bp, Homo sapiens
accctgaataattatgtaactgcctttatttgaacgtagctacatagctaccagattacatcacttttcagagttagggtaacataataccttgaaaactatagcaaacagcttgacaaagcaagagtacattaattt

SEQ ID NO: 720268 - DNA, 1124 bp, Homo sapiens
gtactcacaaacactgccatttccttacgcagactggcttgagcaggagtaacactactggtctctacacacgcttgcagtaacaacatgccaaacactggtagtacccttggcaacccagctttacttcttgtgcctaagcagaacctgtacaacactagttacaacactgtccttactccacagctaactttcgcccgaatttaacaacagcacaccactctcgctctcttctctacttctcactctccttcggcttctctaaccttcactgctggctagctgcactaatttctcacactaccttcttcctgaatccaaaaccagcgcttcacaacgctacaacaccgttctcacaacttttcaacacttctcctcttctacaaagcaaacctctctacacagctgttaaacaagctctcaacgcccccattaccctctccaattacacgcctggggcttacaaccgcaaacacgggctactacacacacttcttgggcacacaaccaaatttctgtggctctgcgcgccaacttaggctaccctgcaacttctggcccgcttgcacaccccaccgggcacctaccaaactttctactctacttcccaactacacctggccacgcaacacttggttgccccttggtttaaacctttgggcgaaaaccgcttacgacgcgcaaggcccttacacacgcgggaattgggcttctctccctttatctccaagccttctcctaaacgctcaagcgaaaaaccctgggggcgaaaaaccgggcctctcgtttcaacccctaactttcttaaagagcacccccaattggggggccccttcttcttcacctttcacccactctttgggccaatttgggggtttcccccaaaagattaaaaaacattttctctcaatttttcccaacccttgtggtgtaaaacgggcatacactttctctaaaacagttcttcccaaaccattgtggtttccaaagggccctctcttacactttctaacacattgggcttgttcatatcacccctgtggcataaagcccccccaacgtttctaacacgtttggacacacacttctctctcaacacaactttttaacccaaaccacacaaa

SEQ ID NO: 720269 - DNA, 1228 bp, Homo sapiens
  misc_feature (349)..(349): n is a, c, g, or t
agcggacactctgagtgcagcccggtggatctctcagcaagtgtcatcttcctatcagtcacaattgtcctctgcctggatccctgatctccctacacgcctgtgtgtctgctgactgactggctggcgcccgcctgtaagctccctgaggccgtgtcccattgcctagtcagattgttattcatccacgtatggtacttggagcttcatggatgtgacccatacgtcagtgatgtccctctgcgcctgtggtggtgtgctgcgtcttggacgtgattactcctgatgtggtgtgtagaccctacgtagtactacgtgtacctggtatgtgcaacgtcatataccctgntgcggaggcagactgttccacacagtggtgcatttacattgcatgcacataccttcggcgtgggagaacctgttacgaacgtcttactaggtgagtacccttggattcgaataagacatacctactgtgcttccagatgatgattggctaagactgagtatgtacccaaactacatacaatcgtggcctatatgctataaagtgggagtctggctgtacatatatgcaccagttttgaactgaatatggcgagaatcgagtagcatagcaaccggtggagagggctcccatgcgaaaacggagcccagatgttctcccaggagacataaattagcaagccaaaaacagtgtctccagcgcagcgtaagaccggagaaaaaagaccccccgtacttgaccttagagaagaatggagctaggagtcacaaggaacctcttgtaacaccaaggcattaagccactcaaggcaatttctacgtggcactccaggacttgccaaggacttttgggcctttccttttggcgggcctgagccgccccgaatttctaagattctttacacgaggaaaagcacatttatggttctcggcaccaagaaggttgggctccgtaacattcggtttggggggaactttctggggaaacccagaaaaacgggaaccacaaacgcacattgtccgtgagctccttcttgcttcgcgaaaggcccacgtgggggatatgcaattcccgcaatgaaaataagtagatttttttagactctgggaacgaaaaacctttttagcctatccacgccctaaaatcgaattggttgtccagggtttgcgccactaacagggacaagtacggctgtccagaaagggggagtactttcccgaa

SEQ ID NO: 720270 - DNA, 161 bp, Homo sapiens
ggtaagtcacaaactcgtgaggctcagtaccccatatcccaccttggctataagtcttttggaccagatttggtatttaattgacaccttcttcgtaagagaggggaggggagtgtccctagagggggatgtcagagaagaaaactagagtcgtaaccacc

SEQ ID NO: 720271 - DNA, 195 bp, Homo sapiens
ccgctgccgatgcgcattttttcatcgagatgctgggtttgatggatgttgagcggcgtcaggccgggcgcggggtttgcgtggcttcggcgccgttgcgcactttgcgcaatttgccaatttcattcagtttgttgatgtcccggcgcgcggtggccggagagatgtcaaacgccgcgatcacgtccgccacgg

SEQ ID NO: 720272 - DNA, 809 bp, Homo sapiens
gtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgttttctcattttttctcatgttatctatccaagcactgtcccagtggctcagcaagctcatatttccataagtgtggatttcccaaaataattatggaatacggctatcctatggctactttaagtgtttcgggggcatgtggtgtgggacgtgtttatggaattacccagtatcttaaattttccaaaggaacccttggaagtctatcactctaattgaacgtctgtcactctacattgaattatgtgctcaaattttgaccaactcagctttaagacacaaaaccagtacttttgaaccagggaacacacttgacgagagtttctagttaaaggggttaacacttttggttgttgcaatagtaagttcagtcttcttataatatttctaaatgaaaaatcataggtattggtacccatgttgtgacgattacttgcgttaaaagcaaaagtggtcgtgtgatatgctaaatgtcacttactgattcatatgttaaattcacgccaaacaaatttatgtctgtgccatcccagggtctgtgagtcaatcttttcctgagtacttggattggggataacggggcttgtacctatgcacttttcattactgcactacttaggaaaacgttaagtacaacaacagcaaaa

SEQ ID NO: 720273 - DNA, 301 bp, Homo sapiens
  misc_feature (193)..(193): n is a, c, g, or t
  misc_feature (197)..(197): n is a, c, g, or t
gaaaaatttttgggttttttttttttaacaccggccggggggtggtttttaaaaaacctttttccaaagccccgggggggagtgtgttcccccccccaaaggttttcccccttttttggggcccggggttgggccaaaaagtttttccccaaacccggattccttgaaaaaaggggtttttttggggccaaantggnaaaagggtttttgtgccccccccaccccccccgggccttgccaaatttttttttttttttttgccccccttaccttttttttaaaacccccttgggcccgttca

SEQ ID NO: 720274 - DNA, 199 bp, Homo sapiens
tttttccccccccccccccccttgcccggccatggcccccgttgggggtggggggttgttgtggggggattgggtaatttacttttttcgggcccgggggcgggggtttttttcccttttgggtcccgcccccgggcccccccgaggggcctggttccaaattttgggttccttgattgattgccccctgatggattta

SEQ ID NO: 720275 - DNA, 685 bp, Homo sapiens
tcaaggcaagtgaccggaatgggtcggaagcgcgtcccgagtctccctctgatgccgaggcgaagctggactgtactgccgccatctcggctcactgcaacctccctgcctgattctccatgcctcagcctgcccagtgcctgtgattgcaggcgcgcgccgacacgcctgacgtggttttcgtatattttttttggtggaaacggggtttcgctgtgttggccgggctggtctccagctcctaaccacgagtgatctgccagcctcggcctcccaaggtgccgggattgcagacggagtctcgttcactcagtgctcaatgttgcccaggctggagtgcagtggctgtgatctcggctagctacaacctccacctcccagccgcctgccttggcctcccaaagtgccgagatggtagcctctgcccggtcgcacccggtctgggaagtgagcgtctctgcctggccgcccatcgatctgggatgtgaggagcccctctgcccggctcccagcctgggaagtgaggagtgcctcttcctggccatcatgtctcaggaagtgaggatcatctctgcccggccgccaatcgtctgagatgtggggagtgcctcggccccgacgccccgtctgggatgtgaggagccgcctcttgcccggaccgagaacccactctgggaacgtgagg

SEQ ID NO: 720276 - DNA, 253 bp, Homo sapiens
taggatcgagcgaggagggaggagaagaaggagaagaagccccagaatgcggcagacaagttactcctgggttccagagcgagctgagagcatgggccatggagaaccagtacagtccgacacctgggacagactgctgaaagtgaggtggccctggtagacactagagtcaccagtccaccatcctcagagctttgaactccccattccagaggggcacccacatttttttgaaagactggactggaatctt

SEQ ID NO: 720277 - DNA, 89 bp, Homo sapiens
gagcccgggaggcctgcaggccttttcctgaagaactggggacttggcatcaccaccacggctaagtcgctcctgggtccccaacgccg

SEQ ID NO: 720278 - DNA, 253 bp, Homo sapiens
  misc_feature (26)..(26): n is a, c, g, or t
  misc_feature (158)..(158): n is a, c, g, or t
tatggtaaaatgtaacgtaaatatantatttgaagcatttttatatctacaatgcagtggcattagtacattcacattgttatgcagatcatcactactgtccatttccagagcttttttcatcttctaaaactgaaactctgtaccccttaaacaancagttggccaggcatggtggctcactcctgtaatcctatcactttgggaggctgaggcaggcagattgcttgaacctaggagttggagaacagct

SEQ ID NO: 720279 - DNA, 238 bp, Homo sapiens
gggcagattacttgaggtcaggagttcgagaccagcttggccaacatggtgaaaccccgtctctactaaaaatgcaaaaaattagctgggtatggtggtgcacgcctgcaatcccagcaactagggaggcggaggcaggagaatcgcttgaacctggaagggcagaggttgtgacgagccaagagccaagattgcgccactgtagcctagccttaggtacagagcgagaccctgtctc

SEQ ID NO: 720280 - DNA, 1147 bp, Homo sapiens
cagggccagtgaggcaactactgctatcaggatgtaccactgagggcatactgtgtgagacgcaccccctactccacatagcagtaacatataaatacctacacagaccataccagcccagggatatacacacatcagcacatggagcatgaaccccacatggcatcgcgacgtggaccaatgctgccaacaagcccttatctcccacggatcttattgcctcaagacgctagaccaacaccatctgccttcctgcggcacataccctcatacaccataaacaagaccaacagcaacacccacgcagaacaagggatccaagaacctcacaagggacgagatagggaccacaaaacaacacacccacacataccaagagataagagcaacagggaaccctgacgaacaaaaccaatactaaaacccacaaccacccccttgcccctaaacacggggtccccaacctgatgaactattgctctcaacacacgccaacacatgtaaccccataaacttacacttcaacaatccaacatctactaccaccactacctgctcgctaagaacaattaaaaaacctacatccacactacactcaacttaataagctactaaacaatcgctaaacacaacatacctactcacaccaccgcacaaacctaacacataccctaaataccaaacaccatacacaaaaaagcacatccactctccaccacctcaccaaccaaacccccaacaactacataaccctactctctgctcatactatacctccctaacactcacacacctcactccaccaacaacaaaaaccctatactaactccatcctcccttactacacacctcacctccaccccccactacacccctcaaacaccctttcaccccacccgacataccccaaaccccactcctccctacacccccaaaaaacaatcacaacataactaacaacaacactaacaccacctcatctcctctcccacccaacacacctacctccatacaccccacaaccccccacactacaccccgtcccacccccacacactctcctccaaccaccaccccaccaccactcactccaccaataacaaacaaacccatccacactacaacacacctacatcccccaccccca

SEQ ID NO: 720281 - DNA, 143 bp, Homo sapiens
ctctacacggataccccgagtgggtccctgcctagtgggtccctgcgggaaggcggaggttgcagtgacgctgagatacgcgctcactgctaccttctcagcctgggtcgcttagagcactgattcctgtctcaacaaaaaaa

SEQ ID NO: 720282 - DNA, 653 bp, Homo sapiens
  misc_feature (526)..(526): n is a, c, g, or t
  misc_feature (529)..(529): n is a, c, g, or t
  misc_feature (550)..(550): n is a, c, g, or t
  misc_feature (560)..(560): n is a, c, g, or t
  misc_feature (579)..(579): n is a, c, g, or t
ctccgctccgggttcaggtgattcacctgcctcagcctcctgagctgctggaacctattccctatgaattcatggcataataagtgttaaaaaaaaaaataaaggacctctgggctacaaaaaaaaaaaaaaaaaaaaaagttcggggggatttggccaaagttcccaaaaaagtgggaatccgcggaaaataggggacccggttaatgggggcctccctccgggaaatggggtggaagaaaatttggaaatcagcgccaggcacggccaaatgtacactggctctcttctggtgggcaaaccccaatgatagaaaagacgagacgctggtggggagatctggcgcactggtggtgtctccttgctatgaaagacaggtggcgttgggcggtgtcgccgtggagaccgtgtacaaatatacccatctttccggctgtggtcaccggggataaaagggctccggccattcaagagaagagacttggaagggagtttagacaagagacccagggatagaaggccttcnctnttaaatacttcttgtgggagnacacatctcnaggtggggaccttatatanatatacacgtgggggttaaacattttcatgtgtgtttaacaaagaagaaaaagataaaaagagcgaagagacag

SEQ ID NO: 720283 - DNA, 451 bp, Homo sapiens
tcgagctcggcacccgtcagacgctgaactatgtgcggacacccgatcggcatagcgcactacagcccagaactcctgggctcaagcgatcctcccacctcagcctcccgagtagctgggattgcaggcatgcaccaccatgcccagctaattttgtgtttttagtagagacagggtttcgccatgctggccaggctggtctcaaactcccaaccttaggtgatccacctgactcagcctcccaaagtgctgggattacaggtgtgagccaccgggcctggccaacacactggattttaaaatgcaagtgttaagtggaaatagaaaacacggtaacaatcagcagacaaggagggtttggttgaagttacttgacaataagaagaatatcatgcacattactgcaaccctagaaagacagattaacaattatatgaaagtatatcagaaa

SEQ ID NO: 720284 - DNA, 196 bp, Homo sapiens
  misc_feature (167)..(167): n is a, c, g, or t
agaagtggagaaggtaagaatggatctcccctagatctgaaggcagcaggttagtgacagataagttggccagtgagacccattaagatactgacttctagaacagcaagataaaaacgtatggcttaagccactaaatctgtggtaattagtggtaatacaattcncatcattagtatgggaacaccacagtacg

SEQ ID NO: 720285 - DNA, 439 bp, Homo sapiens
agccaagaaagaaactgtttcctcctcctagaaagtcctgctgggtggctgccttccaacaaccacacaatcccctccctcattcactctaatgattccaacaccccttcccggagggctcagaatccccactgcccctgcacctgggagtcctgcccaccctgtttctgaaccactgagtgactctgtttgggtgtctcagtgcgccagggcctgtgctccatacagtgagagcaggtttccatcagagaccttcagcccaccccaggggactatgaggcatggcttgggcgtagggggagccatggacgctctcaaatccaaagccactgggcagatgggtgagcttggctcaaatccatgaacccaggtgtgggcaacggggcttgcgaggctgggtgaaggcctggggactctgaggtggctggactgcggacgc

SEQ ID NO: 720286 - DNA, 1487 bp, Homo sapiens
ggcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720287 - DNA, 726 bp, Homo sapiens
gatcctctccgacctctcgagataagagcatcatcatgtggaaactgaccagggaatgagaccaactatggaattccagagcgtgctctgcggggtcaagtcccacttcgtaacgtggatgtggttatctacctcagaatggccagtttgccctctcaggctcctgggatggacaccctgcgctctctgggatctcacaaggggcaccacatcgaggcgattgtgggccataccaaggatgtagctgagtgtggccttctccgtcttgacaaccggcacgattgtctctggatctcgagataaaaccagtcagatgctatggaataccctgggtgtgtgcacaatacactggccaggatgagagccactcagagtgggtgtcttgtgtccgctttctcggcccaaatcagaagtcaaccctactcatcgtctccgtgtggctggggacacagctggtcaaggtatggaacctggcctaactgcaaggctgaatgaccagtcacattggcacacaggctatctgaacacggtgactgtctctccagatggatccctctgtgcttctggaggcaaggatggccaggccatgttatgggatctcaacgaaggcaaacacctttacacgctagatggtggggacatcatccaaggcctgtgcttcagccctaaaccgtactgctgtgtgctgcaacaggtcccagatcaagatctgggatttagagggaa

SEQ ID NO: 720288 - DNA, 1451 bp, Homo sapiens
  misc_feature (20)..(20): n is a, c, g, or t
  misc_feature (46)..(46): n is a, c, g, or t
gaggggtgcctcaaccacantccgtccacggactctccgttatttnaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720289 - DNA, 818 bp, Homo sapiens
  misc_feature (23)..(23): n is a, c, g, or t
aaggctagtagggacgcgtgtantcacatctccattcaccgataagtcgtgcttacgctaatggcggtggtcttgctgagggcaacttccgcaccggccgattgcctgaggccacctccagcgcagtggaaactgcttcttccagaatcttgcgctgcgcttcaactggagagattacttctcatgcaagtgccataactgtagagagtttctctgcaccgtctacaacagagaaccgtgttcgcagtgcgcatcttaactggtaacattagcctctttttttaaggagcctgagatgactaagcagcccgaagactggctcgacgacgttcccggtgatgacatcgaagacgaagacgatgaaattatctgggtcagtaaaagtgaaattaaacgtgatgccgaggagctaaaacgccttggcgcggaaatggttgatctggggaaaaagcgcgctggataagatcccgttagatgcggatctgcgcgcggctatggagctcgcccagccgtattaccgatggaaggtcgccgtcgccagtggcagctcatcggtaagatgctgcgccagcgcgacgtagagcctattcgtcaggcgctggataagctgaaaaaccgtcacaagcagcaggtggtgctgttccataaactggaaaagctgcgcgatcgtcggatcgatcgaggtgatgacgccactcgctgaggtattaaatctgtggcccagatgccgatcgtcagcaaatggggtactctgatccggaagcggaaggaagaaacaagaaggggattaaagccggcgaaaattccggaggccaaat

SEQ ID NO: 720290 - DNA, 1408 bp, Homo sapiens
  misc_feature (1392)..(1392): n is a, c, g, or t
ggcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgcaatcnatcggtaccgagctaa

SEQ ID NO: 720291 - DNA, 243 bp, Homo sapiens
  misc_feature (211)..(211): n is a, c, g, or t
gaggtgtgctattagttttcttttatttaagaaaaacaaagcatggtttaaatatttcttacaagtacaaatataatttaaatttaataaaggtccaaaaatatcggtaatggatgtttcattcaagcagacatatgtctaatagaagaactggcataagtcaagatataaagggagtgattacagtgaaacaaatcacaataattatcangaaagagtcttaaagagtcagagaagagaccc

SEQ ID NO: 720292 - DNA, 1085 bp, Homo sapiens
ggcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattggccagcgggggtaagagctcgattctatcagta

SEQ ID NO: 720293 - DNA, 208 bp, Homo sapiens
gacaaagtgagaccccatctctacaaaaaaattaaaaaattatccagatgtggtggtgtttgcctgcggtcctagctacacaggaagttgaggcaggaggattgcttgagtgcaagagtttgaggctgcagagagccaaggttgcacccttgcacttccggcttggtgtcaaagcgcggacctgtctcaaaaacttagggaattggct

SEQ ID NO: 720294 - DNA, 1281 bp, Homo sapiens
ggcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccatgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720295 - DNA, 1370 bp, Homo sapiens
ggcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720296 - DNA, 808 bp, Homo sapiens
aggtactctacaggatcttcccgctggcgcaatggcagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720297 - DNA, 630 bp, Homo sapiens
tccatatgtgtttcctccgcttggaagattagaaatggtttggagaactgatacaaatggctattacttcatatattaattgcatgtgtttactttgaaggtgaaatacaaagtacctttgttgctaggaaaggaaatgaatgagatacacagttccatacacagcataaagaagttgttctaagaacacttcctcaagcagttcattgggctgaatttcctcttttgaccttgttacttgtaagagtatgggcctaagccaaactgtttgggatcagatcccacctaagcctcttatcagatggataagcaagctatttaacctctgtgagcttcattttctcttctgtaaaaggcaatgacaaggtccctaccttcaggattgctgtaaggatgaaatgaattactagatgtaaagtgctcagaacactggtccctgcatatatttaatgttcaaaaaaaaaagtgagctactattattcagtgcttacagcctcctgggccaaatattttaaaaaagcaaattaattaatttgcttagaagcaacttaattacgctacatggcagtggagactgaagtttcttactagataaccaaatgataggggttaaaggattaataagggtaa

SEQ ID NO: 720298 - DNA, 112 bp, Homo sapiens
gcacgagatcatgattatctaccgggacctcatcagcacgatgagatgttctccgcaattacaaggatccgggggatcggcggacgggttttgcctggaggtggaggggagg

SEQ ID NO: 720299 - DNA, 810 bp, Homo sapiens
  misc_feature (22)..(22): n is a, c, g, or t
  misc_feature (29)..(29): n is a, c, g, or t
atacgaagtcgagcttgtaccnccgctgngccaatggcagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720300 - DNA, 929 bp, Homo sapiens
ggcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtacgacctttaaacgctgccagtcacaacatgataacgcagccactctagcgatgacccacacgcttacatgtagagaccaccctggcccatcatgatcagcaagggaccgagctcaatgtcgaatatga

SEQ ID NO: 720301 - DNA, 1376 bp, Homo sapiens
tatatgcgtaccccccccttttgatgtagtccttctttattaatagagatattatttccgtgcttcgttgaagaagattttgtcgttatagatggagccccccaacttagaatcccctctgaataatgggcgggggcccacaataataaaactactggtgggggtaaggacggcacacgggcaacgtataacgtttggaatcaaggggggggtgcaatagaatacctcaaactgtgtgatggcgccaccttttcaacattgtggggaagaagccctctgggagatgtaacacagtttggggggtggaccaaagtcacaacacagcccccacatagttgggggtctttaagacgctacgccctctactgtccacaaaggggggagttggcgaacgccacagctggctgtgcaccgagtatgtagtctgtcatcgtgtgttgtcgtgcgcactcaagaagagttgttataatgccccaactagtttgttttgctgtgtgtgcgcgccttccacccctcttttggtccttcttctcaaactcccctttgttttttcacgaccacataacccacagcccttggggaaattatagtattggggcgaaatatcccacggagataagatgggagacttgtgtgcgtatacccaccataggggattggcccctacaacattttgcacaaccgtggccgctaaatcttcctcccccccaccggtttttggaccgcaaggcggtcccctgttggggccttccccccccggcgagaggggagagccacacagaaatttttctacacataatagtgtttcacgagagacccccacggagagcgcgcctccttgtatagacccctatattgagagccctctcttgggaaatcggggaacctgtcacacactttccctcgagctattttccctcgagataatttggagaagaacaaggagacttttgtgtaaatttctttcttccccccacatatggcttctgtctggcgctataggttctacacacattctctagactgcacgagatcacccgatacaccacattccctgttaagtgcttccctccacagctccacagaggccaccttgggagcacaaaatgcctttatattgagaaacgtaacaatacactataatacaccaccacatgagagagtgaaagacacaatattatgaaagtccgcaatatgtcatcactaatcccgttccttggcccggttgagggcacagctcacagtggctgaggcccatgtccaagccacaacccgcacagcgttcactcacgacttcaagatttgatgctatattcctctttggatttctcaccagttattaaataagtgtctgagtgggaaaaaaaaaataaaaa

SEQ ID NO: 720302 - DNA, 939 bp, Homo sapiens
ccccaatggttcctggcccagcttatgccaagtatcttgccacgcagaatggccatttgtgcccatcagtggagccctgagattccctccactgatgggggaccaatgaccttgaaagcgcctgccaagttatgtgaccgacgaagggtaaatggcctaccctgcctgaccaagtgcaaggtgggcatggccggggaacactggggctaacccctatcctctcctccaccccactatccacccgtgcgcctgctgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatagccattaacccccgcagcatctgccagtataaccagctagtccg

SEQ ID NO: 720303 - DNA, 126 bp, Homo sapiens
gcctagagttcccctggtaggaggtggaggctgagtagctgagattgtgcactacactcagcctggcacagagcggacttcatctcaaataagtaataactaataagcctttcacatcaaaggaat

SEQ ID NO: 720304 - DNA, 383 bp, Homo sapiens
gaaaattccctggattaccaagcagagactcttgttctcttctctcactttcccccaaacaaatagagtctctctctctctctctctttctctctctctctctccctctcattctctgccgacctgcctgaatctggggtagggatgacacaatcacatttgtagtcaacaccattgggactgtgctaggtcagacccaaagctgcacagcactgagtctcgcccaacgcccacagagaccactccctgggtaatgtctgtgtttgctcaaagcctaagggctatacaatcagtcagtggtgaagccagcctgtcttatgtccttaccttcagggtgatgagttcctcaagcaggtccagggatggtgtccaggacgcaaggc

SEQ ID NO: 720305 - DNA, 941 bp, Homo sapiens
  misc_feature (408)..(408): n is a, c, g, or t
gccctcacgcctctgatccccagtacagtagaagaagtactacttcccggatccgttgaaggctgggagcgctcagcgtgcgcttcgagtatgaaagggcggacggacggtgagtcggtcttccttggcacatccatgaaagatctggtgcgcgtacgcaccattcgagccgccaactcgatagcaagaacagtactgccatcagtacggtgcccgtgcagactgcacggcccaggccgagaaagaacagtggcaaccctggctaaccagcgcgccaatcagcctgctgaagtacgtgtggtgcatcattgtctcacgcggtctcatcacatacgcagtggttgtggaagcttagtctgggagccttgcaactgcacatgacttagggaaccagagacgtgcaacccngaaacgtagctttcgcacctcggcacgttgcatggcgggaccttgcctgcggtaagtgcgcagcactcgtcttgccttgccgccgaatgctcccacgtgggacacgttactgacatatagcattcgacacacttgtcttagggaagacccctctggtggtccgcggcagtgacgcatggaagctggacgatgtgccaggggcaagttgttgcaatccacggggggtgtggcccctacagttgcgcagaagaacggtacagattgcgataattgttgttgcagttgagtgcttgcgactgcccgaagggcactgtaagggcaggctgctcggccctgcctgacgcgagggggcaccggtgagctgtggttccggcgcgcttgcgacagcggtaccatagggacgtttctactcggaccttggcctccgtaacaaacctttgcgtcaagtcaataccggtccagaggttggagcatgtgtctgggccaagccttgaagccctgggttggtggttgcatagcacccttgtcccttc

SEQ ID NO: 720306 - DNA, 594 bp, Homo sapiens
  misc_feature (536)..(536): n is a, c, g, or t
cagagcagacagtgcctattgacactccgtttgaagtatcaccttctcataactgaaagagcagaaaagctaacagataagcttctcatctgaggacactctaggcatacattatgaccgtcttgtttttcattgtatgttaggactttatcactgcatctatgggtacggtgattagaacattgtagatgtgtatgccgatagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtntaatctgtttaaacaagttctagtaacacatctggttagtcagttttttatggtgtat

SEQ ID NO: 720307 - DNA, 1040 bp, Homo sapiens
  misc_feature (1032)..(1032): n is a, c, g, or t
tgcgattccatctggagcgacaaatgggatactatctgatccagatgtacattcccagtctcctgattgttattctatcctgggtttcgttctggatcaacatggatgcagcaccggccagggtagctctggggataaccaccgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataagacagaagcttttgcactggagaagttttaccgtttctcagatatggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatncaaaagca

SEQ ID NO: 720308 - DNA, 198 bp, Homo sapiens
agaggttgatgagttaattaaaggagaagattcctaaaatttgagagacaaaataaatggcaagaatttgagaaagtaaatttatactcaggttctaattttactttctcaaattcttgccatgagaggttgatgagttaattaaaggagaagattcctaaaatttgagagacaaaataaatggaacacatgagaacc

SEQ ID NO: 720309 - DNA, 219 bp, Homo sapiens
aaagcagaggcagccggcataggatgtagacgtcctttcccaaactcaatcgcagagatgagagacgtgagaaattagagaaaggtggaacaaaaaaattaccaagcaacaaaaaaagtctaggaccagatggattaacagctgaattctaccagacattcaaagcagaattggtaccaatcctttagacactattccacaagatagttgtacatggcg

SEQ ID NO: 720310 - DNA, 548 bp, Homo sapiens
aagatagaggacgttatataggcggttattatctgcctgctcatacacgtgctgtgagctccacacactagtctgagatgcgcctgaaccagctgttgcatccatccccacatgacgtggactctgccttcagctatgtgcccgccttgcactactcacagaacagccacgcccgcttctgcggcctcaagccatcagcctgcctgagcctggtggcgggcgaccaaacatggcctgccactcagagaacacaccaccgccttggccactgaggtctctgcctcccagccggctccgctcctctcagcagcagcttgctggtgatgagggtcgagtcctcctggacacgtgctatgtcatcaagcccgggaatacaaaggagaaggtggccttctttgtggcccaccagtgtggtgggggcagccgggcccagctccatgaaggtcaaggggcactgggcagcgatagctccaaggccaagcggcgaggcgctgtcttgacccaccaaggtcctcctgacccagggccggagggccccttctgctgag

SEQ ID NO: 720311 - DNA, 732 bp, Homo sapiens
tgagcgcgaccgatccttaatagagtgtgggagcaaagggaggacagagccttttaaaacgaggcgggtggtgcctgcccctttaaggagcgggagcgatccggacagagtgtatctgagccccagactgccccgagtttctgtcgcaggctgcgaggacaggcccctaggctgggtctgggtgcttggcggcggcggcttcctccccgctcgtcctccccggtggcccacgaggcgacctcgggcttcaggtcgatgctgagcagagctgtggaagcacctgactacgaagtgctatccgtgcgagaacagcgtattccactgagaggagtccgcgagtgtataatatcatgcacttcgtgtttgcaacacgtgtgtacatcctctgccacatcgttccttgacccgcttcaatgaagcctgctgagttcatccatcagtggtgtgatgaagatgccaccgtgaacgagattgcgctcgagctgtgcagctttaccctggctagtgccctgggtgctgtcctgctcctgccgcttctccatcatcagcccatgagggtgtcgtgctctcgctgtgctcggaactatctatcatccagttggctcaacgggctccctccattccactgtgctctgggggaccttggtttggtcttctccaactgtcctcatcgttcctcatgccccttgggagtattcccttcacctgggtctaagggttgtggacccgaag

SEQ ID NO: 720312 - DNA, 107 bp, Homo sapiens
tggtgtgaggtgactgtggagggaataggggatctggggacagtgtgggacgtaccatggggacaggaggtcacagaacacacacacacacacacacacacacacat

SEQ ID NO: 720313 - DNA, 206 bp, Homo sapiens
ctcttgagtatccccgctgatccgcttaagtggttaccttccctgaccactgctgcctccctccctgcatttgccaggtactgtcattgccttagtttattattttctgttttgttttttttttgtcgtttttgttattccttttggtttttacttttttttttctttttttttttcttgcatcttctcctcttttttttttaatt

SEQ ID NO: 720314 - DNA, 1101 bp, Homo sapiens
  misc_feature (220)..(221): n is a, c, g, or t
  misc_feature (242)..(242): n is a, c, g, or t
  misc_feature (259)..(259): n is a, c, g, or t
  misc_feature (310)..(310): n is a, c, g, or t
  misc_feature (334)..(334): n is a, c, g, or t
  misc_feature (397)..(397): n is a, c, g, or t
  misc_feature (831)..(831): n is a, c, g, or t
  misc_feature (960)..(960): n is a, c, g, or t
  misc_feature (974)..(974): n is a, c, g, or t
cagataaatccagcctccaccctttattcagaccatctttcatacttctgtttcattggtccttttattgtcctggcactatttcatggaaagtttatcgatactggtttctctttacccttctaccagcctatcttaagtaaaaaacttactattaaggatttggaatctattgatactgaatgttattactcccctatctggataagagataaccacnntgaagaatgtggcttagaaangtacttttctgttgacntggagattttgggaaaagttacttcacatgacctgaagttgggaggttccnatattctggtgactgaggagaacnaagatgaatatattggtttaatgacagaatggcgtttttctcgaggagtacaagaacagaccnaagctttccttgatggttttaatgaagttgttcctcttcagtggctacagtacttcgatgaaaaagaattagaggttatgttgtgtggcatgcaggaggttgacttggcagattggcagagaaatactgtttatcgacattatacaagaaacagcaagcaaatcatttggttttggcagtttgtgaaagagacagacaatgaagtaagaatgcgactattgcagttcgtcactggaacctgccgtttacctctaggaggatttgctgagctcatggtaatgggcctcaaaagttttgcattgaaaaagttggcaaagacacttggttaccaagaagccatacatgttttaatcgcttggatctaccaccatataagagttatgaacaactaaaggaaaaacttctttttggcaatagaagagacagagggattnggacaagaatgacatgtggcttcttattttggaggagctcttgcatttaaataccccagccaagaaaaattgcacagatagtgtatataagctgttcattctgtacagtgaattttccgaacctctcanagtatgtttccgtncttccacagaaatatgcaaaacagttcatcctttctactttattgtatgtcccttgaatgtgtgccaggaaaatcttcttaatttggagcaggggaatttataaaagaatttttttttactttttag

SEQ ID NO: 720315 - DNA, 388 bp, Homo sapiens
tgctgttccattctgtttaccagccttctgtatcataactttcagaatccattctctcacctatgtctttgcccagagtcatcaagtcatgccagcacctcctcctggctcagtgccttctgtagagatgtgtaggcaggcagggctgtttgtgtccaccatgcacactacgactcctgcaggtggagttctgtgagcaacactgagcttcttgaagtccttgagcttctctgcttccttctagactcacaataagaaagatacaagatttcaggttggaatttccagctgatgctaggtctgcaactgaaaggagaaactaggatctagaaagttaacctttgagaaggtcgacgcggccgcgaatttagtagtagtaggcggccgc

SEQ ID NO: 720316 - DNA, 277 bp, Homo sapiens
  misc_feature (23)..(23): n is a, c, g, or t
gccaaacaaggctctgggctctncctactggctactctcaaacctgggccttccctcttagcactagcctcctcctaagggggcagcccccaaagcctttcccaccaggcctgttctccatagagagttcctaaagggttactggctcatgttgtaagaaattatgaaacataactttcttgttttttcttttcattaaaaaaataaaatattcaagactatcagcttctcttttgctttgcttttcttttttatataaaatatcagcaagctgcaa

SEQ ID NO: 720317 - DNA, 190 bp, Homo sapiens
tatctatacgatccccttagagacacaggcgatgtctgtctccctccttccctctccttttctgtcacctttccccctagctggctcctttggacctacccctgatcttgcttgacttgtgctgcatacagactgtccatttctttgtggccagagctcctgtcctctgcacctgtcgggctagtcgggg

SEQ ID NO: 720318 - DNA, 221 bp, Homo sapiens
catcatcggggtgctggagaaaggagaccggctgcccaagcctgagtctctgtccaccggtcctttataccgctcatgtagccgctgctgggactactgaccccctgtgatccggccccgctttcaccgaagctgcgtgtgcagccgtcggtgatcgtttatcgagatggaggaaggacaattgccatgtgagcgggattaggagatgctcgcgtaccgag

SEQ ID NO: 720319 - DNA, 379 bp, Homo sapiens
ctaggatccatcctctctctcattatatagtgctagtctcgggacttttttattatctatatactatttacttttttttttggcttaaaaacaagtgtgatgccatatcaagtccatgtaatcctctcacagtgtactctcataagaggtgtgggtgtctgttgggtcaggatgttagaaagtgctgataagtagcatgatcggtgtatgcgaaaaggttttacggacagtactggcaaaaagtgtggtatggggctatgatggtgcacttgatatagtcagcgtgcctttaaagaggtctaatctgtccagtgtcaagtgatttaaaaaaaataataccctgttttctgactagttcaaagatggatttgaaaatggt

SEQ ID NO: 720320 - DNA, 143 bp, Homo sapiens
acgtatgtgtcgtggaaaacagagttatcctacacctaaagaaagaccaaactgagtactttgagcaacgaagaaataaatgtagattgtgaagaaacattctcagtttattggatatcccattactcactgtggtggacggg

SEQ ID NO: 720321 - DNA, 696 bp, Homo sapiens
  misc_feature (260)..(260): n is a, c, g, or t
  misc_feature (696)..(696): n is a, c, g, or t
tggagggcgaaaaccgggtagtgttaattggccaggaggacacccgcacagcctccggaccccaaagggttttggacacaaatgatcttaaaggcacgtggctttcgtgctccagcttccagccctgtgccgcggcagggcgttggggcgcggaaaccccattcacacacgcagccttcaacccgtcccccttccttccagggctgcagcttcgcgcccagttggcttgaaagatacgcaaacgctctttgcagggcaanagtgttcccaggagattcgcagtagactgtgggtgtgtgtgcccccaggatctgcacgtagacgtggggtgtgtggccccaaggcttggctgggaacggtgcggatctacaggggcgcatcatttccaggagagacaggcgtagatgggagacctattcgagacaacgcatagagagtggtgaccagtgcgtgtgagacaccgcctgggagagatctgttcaatcacacgcaagagatagcgcctgtaggctatatataccttcacatctcttacaaagtgttccgcgcagagaacactctgagacattgagctccaaggtcccccccatacaaagcacagaataaaagggcccaagaggcggctttcgcaaggcctcatgtgcccctttcaaaagatccgtgggggttaggagtggtacaaccggggaaccccan

SEQ ID NO: 720322 - DNA, 352 bp, Homo sapiens
  misc_feature (47)..(47): n is a, c, g, or t
  misc_feature (125)..(125): n is a, c, g, or t
  misc_feature (235)..(235): n is a, c, g, or t
  misc_feature (289)..(289): n is a, c, g, or t
aagtagttgggattacagttgcctgccaccatgcctggttaattttngtatttttagtagagaggggatttcaccatgttggccaggctggccttgaagtcctgacttcagataatctgcctgtntcagcttcccaaagtgctgggattacaggcgtgacaactgtgcccagctgagatctgatggttttaaaaagaggagctcccctgcatgaggatctcactttttgcctgcnaccatttatgtaaagatgtgacttgctccttcttgccttccatcatgactgtgnaagctttccccagccatatgggaattgtaagttcaatttaaacttcttttcctttgtaaattt

SEQ ID NO: 720323 - DNA, 359 bp, Homo sapiens
ccttgggggttccaaatagggacccaagattgcagggtgtccctttttgggggggaatgttgaataattattttttttccacccttgttgccgcgggccagccccccggggggccctttatttgagatgtttttcccacccagatggtggtaccctatttcctttccccttggggggttttgtttgggaagttttttggccccatgtcagttttttttgctttgagggcccaaaggcccctggtcagtcgggtttccttttggcagggggtttgcagggtttccccctgttgtggcatgggtcagattttttttccttttttggggtgaataaatttcctttgtttgaatttcccccca

SEQ ID NO: 720324 - DNA, 131 bp, Homo sapiens
ttacggcatcgagtcatcggatagagcacttcggtgtgtccacaaaggacagtgcactgcggcatgcaatcacagcttcagcagacagcaggggagtacatcatgcccagtcaggcgctcaaacagacggt

SEQ ID NO: 720325 - DNA, 394 bp, Homo sapiens
cacacagccatggctccaaagccgcagccctgggtacagactgagggccctgagaagaacaagggccgcccggcaggaagggaggaggaccccttccgctccaccgctgaggccctcaaggccatacccgcagagaagcgcataatccgcgaggatccaacatgtccactcaacagcgaccccgggacccaagcgtatgaggactacaactgtaccctgaaccagaccaacatcgagaacaaccacggcaagttgtacatgatccaactgcttcaagacagcaaccggtttttcacctgctggaaccgttggggccgtgtgggagaggtcctgcagtcgatcaaccgacttacaaggcttgaagatgcctagaaggactctgaggactttcggc

SEQ ID NO: 720326 - DNA, 178 bp, Homo sapiens
taggagttgtgaggctctgggaactggctagtggcaatggtcagtggtgaaactcttccaatcccagcagcttgtgtccctcaagatcccatggggagaatcgccgtgaaccttggctggccaaagaacaagcatcagcaccacctagtggtgtctggagggggtttgtgtggtgagt

SEQ ID NO: 720327 - DNA, 567 bp, Homo sapiens
aggacacccctggtatctagtgaggagttgaaatgatgaaaggatcgtacaacacattgatgtcactaatagtcacaagagagaaaaaatagaagagacatgccaagttggaatgaagcctcctgtccctggtggttatactttacaaggaacatggataaacaacattttgcaaccaggttcagttagacacaattaagataaatggctgtttgaaaggcaaactcatttacctcctgggagactctacactacgtcagtggatctactacttccccaaagttgtaaaaacactgaagttttttgatcttcatgaaactggaatctttacgaaacatttgcttctggatgcagaaagacacactcagattcaatggaaaaaacatagctatcccttcgtcactttccagctctactctctgatagatcatgattatatccctcgggaaattgaccggctatcaggtgacaaaaacacagccatcgtcatcacctttggccagcaattaagaccacttcccatagacattatattcgcagggccatcggtgtcacaaggcattgcag

SEQ ID NO: 720328 - DNA, 351 bp, Homo sapiens
gccggggtttttttttccccggccgcgggtttttgcggcggggggggccccttggtttcaggtttcccccttccggccacaagggggcggggtccgggccgccgcccaccggcccttccgccaggtcctcagcctgttccctggggggcaggctcccgaagccccccgacggggggcctttttaagtgggggaagcctttccagggggttttccccgtgtgtcctcatttgcggccggccggggggggggggcaaaccgggaattccccagttgcctccgggaacattaaccccccctctttagtcttactggtattttttgtttcctttataaagcccccgtttccctca

SEQ ID NO: 720329 - DNA, 261 bp, Homo sapiens
gtggtggtctgtctgggcaggtcccggtggtccccacagggtgcacaggcggggctgggtgtaacagctggtcactgtggcatttggtggctgtgcttgtccagccactggcaagggtggttgccagtccttggcactggcggcaggccagtggctttggcaactggtggctgtgggtgtggtggccgtgctggtccagcactttgggcagggggcagctgcgtctggggcatcctctcagcgtcgcacctgccaggccat

SEQ ID NO: 720330 - DNA, 218 bp, Homo sapiens
gttgatcctctaaagtccaccaggctcatcttaacgaatattctggaggtcacgcacggtgctcacgtgctcgacggaacttgtacagcgtaggcatgcaccgcagtggtgaatacacgtcgaccaggctccatctttgcgatatttggaggtcatcacggtgctcacgtgtcgacggaacttgtctagggaggcatgcaccgcagtggtgaatacac

SEQ ID NO: 720331 - DNA, 189 bp, Homo sapiens
tgtggagacggggttcagcaccggccgggggtgcaggtcacaggcaggggtccggggcatcatgggctctcaccaccgctagcacttgtacctcctatctccggtctctccttgaggtctggggattttcaaacggtcttttcctccctcctggtcttctcttttctggtcctgtgtccatatgccaca

SEQ ID NO: 720332 - DNA, 158 bp, Homo sapiens
tagcttaagtatttcgttctgtgcttgatccacaagtatttagcctgggcacctgatgtgtaccaggcgctatgctgctcactgcagaagagaggctaccaaaacggccatggtctgccccaagctggagggcctgattattcttctctctcttccca

SEQ ID NO: 720333 - DNA, 156 bp, Homo sapiens
cgacactgtattaagcaggcagtgaatcacaagctccgggtggataaggcagctgctgcagcagctggtgactacaagcgccaatcagatgagaaggcgtgcggatgcagtgcaagaatgcctgtgtgtagtgtaatgaaatgtgaacagaacgtg

SEQ ID NO: 720334 - DNA, 320 bp, Homo sapiens
  misc_feature (76)..(77): n is a, c, g, or t
gcgacggtgaggtcgacgccggccaagacagcacagacagattgacctattggggtgtttcgcgagtgtgagaagnnagcgccgcggcctgtatttctagaccctgcccttcgcctggttcgtggcgccttttgacccccggccccttccgcctgcaagtcggaaattgcgctcctgtggctggacttccttctgctgcccaacttgcttgcaagatgaagctctcccttgttgccgcgatgcttcttcttctcaacgcggcgcgggccgaaggaggaggacaagaaggaggacgttggcacggttggtcggcatctacc

SEQ ID NO: 720335 - DNA, 451 bp, Homo sapiens
  misc_feature (154)..(154): n is a, c, g, or t
  misc_feature (339)..(340): n is a, c, g, or t
  misc_feature (380)..(380): n is a, c, g, or t
  misc_feature (390)..(390): n is a, c, g, or t
  misc_feature (415)..(415): n is a, c, g, or t
acgagggctcttgtgctcagaatggcgctgtgctgtgttcttacaggcctgagcctcctacctctgctgtaagcccagatcccatatgtgtgccaacctagtaccgcggcccatataccaacgccaccctggaccggatcacatggcaagtggntttatatcgcataggcctttcgcgaggagtacaataagtcggttcaagagatacaagcaaccttcttttactttacccccaacaagacacgaggacacgaactttctcagagagtgccacacccggcagaaccagtgcttctataacttcaggtacctgaatgtccaccgggagaatgggaccgnnttcagataccagggaggccgagaacatgttgctcacctgntgtgccttanggacaccaagaccttgatggttggntcctacctggaccatgagagctgtgggctgtctttt

SEQ ID NO: 720336 - DNA, 425 bp, Homo sapiens
  misc_feature (154)..(154): n is a, c, g, or t
acgagggctcttgtgctcagaatggcgctgtgctgtgttcttacaggcctgagcctcctacctctgctgtaagcccagatcccatatgtgtgccaacctagtaccgcggcccatataccaacgccaccctggaccggatcacatggcaagtggntttatatcgcataggcctttcgcgaggagtacaataagtcggttcaagagatacaagcaaccttcttttactttacccccaacaagacacgaggacacgaactttctcagagagtgccacacccggcagaaccagtgcttctattgcaccacctacctgaatgtgcagcggggtgagactcaaggacaccaagagctacatgcctgcttttgacgtgaacgatgagaagaactgtgggctgtgtgtgtatgctggcagtcagagacgacgg

SEQ ID NO: 720337 - DNA, 264 bp, Homo sapiens
ggtggattaacggttcctgtggttaatgtgtgggtgagtaaccccattgtgtagtagatacatatctagagtgagtatagggctgtgactagtatgttgcgtcctgtaagtaggagagtgatattagatacaggagaacgtgatatactagcacagagagttctcccagtaaggttaatagtcggggggtaagacgagtttcagcgaggctatgctaggaagtcatcacaaaagctatatagtgggagtaagagtatcgaagtc

SEQ ID NO: 720338 - DNA, 327 bp, Homo sapiens
tgccgctgttctcaccgtggcacgaagtggacacccagcctggtctctgtccgcaaaccctgtctttgtgcagcgacaccttttgtgaacccgttcgatgactcactgctggaggaggacttcccgtgacacccagtaggatcctcacacgtcaagtgaccgaggctggcggctgaagagcagacagcatgcacaggggacggagacccacttttatttgcttgtcttgggtggactggggcagtgaggggctgatggtgcctgtcccatgacaactaaaggtgcccctcagctggatgtggtgccattgtcaccaacaaaaaaaaa

SEQ ID NO: 720339 - DNA, 427 bp, Homo sapiens
gttatgtagtaggcctttgagtattctttttttcttgagacggagtcttgatctgtcacccaggctgagtgctatggggcgatcttgcgtcactgcaacctccgcctcccgggttcaagtgattctcctgcctcagcctcccgtgtagctgggattacaggcgcgtaccaccaggcctggctaatgtttggtatttttagtagagacgaggttcaacatatgggccaggctggtctcgaaccccttaccttgtgttctgcccgcatcagcctcctaaagtgctgggattacaggtgtgagccagtgcgcccagccccggccagactttttaaagtaaaggaactcttctattcatcactgaccaactttttatttttttttcggaaactccatctcaaaaaaaacaaacacagttccagcactgggg

SEQ ID NO: 720340 - DNA, 193 bp, Homo sapiens
tatttaatatggcttacctcctatgggtggtcaccaaggctaggtgctatgggttatctgctcttgtccacaccagagacccaggctacaagagaaaaagcagaggccaggagttggagggagaaatagtcggtgaaaaaccggtatccataaagacccgatcccaccaaatggtgcggggtacggagctcag

SEQ ID NO: 720341 - DNA, 310 bp, Homo sapiens
  misc_feature (6)..(6): n is a, c, g, or t
tggcangagtagggctgtaactcagctcataccaaccaatcaggtagtaaagagggctcactaaaatacaaattattctaaagcaggaggtaaagaaatagtcaaatcgtatattgcctgagagcacagtgggagggacaatgattgggatataaacccaggcattagagcagggagcggcaaccccctttgggtcccctcccttgtatgggagccctgttttcactctattaaatcttgccactgcacactcttctggtccgtgtttgttacttctcgagctgagctttcgctcgccaagccccagctg

SEQ ID NO: 720342 - DNA, 322 bp, Homo sapiens
ggtcgactccaggttggaaaggaggaagtcaaatgacctcaaaaatagcaaaataattaggaataaacctaacaaaaagaattgcaagacttgtaaactgaccaccataaaaacatcactgaaagaagttaaacaagacctattaatgtaaagacataccatgctcatggatcagaagacttaatattattaagatggcaacatggccgggcgcagtggctcatgcctgtaatcccagcactttgggaggccgaggcgggtggatcacgaggtcaggagatcgagaccatcctggctaacatggtgaaaccccgtctctact

SEQ ID NO: 720343 - DNA, 837 bp, Homo sapiens
tccggtttgcccgcccccctcgttggggcatcgctccccatcttgggacggctggtggtctctactgggtcatcgagctcccttttagagggacctccctttacccccgggccccccccgctccacatgttgccagattaagacccatggatgaccgcgagctccatattaggggggagccacaccccctatgagaaaggtgtttttaagctaggaagttatcattcctgaggaggtgacccattggacctcctcagatgccggtggtctcccccgattttatcatcccagccttgattctgctggaaggattttctggatgttctccgattgccccccaaaggtgcttggagaccctccctcacatcgccgctgtgttgacctctattcagctgctcatgtccgagaccccaccctgatgacccgctcctggctgacatatcctccggattttaatattattagcccgccttcctccagaatgcccgaccgtggacagagaagcatgccagaccagaaaccaaaggctgatgaggaagagatgcttgataatctacccgaggctggtgactcccgagtaccaccactccacaccagaaaaggagaggcccagtcagctagtaggcatagaaaagaaatttcatcctgatgtttaggggacttgtcctggttcatcttagttaaagtgttctttgcccaggtgatttaagttgcctaccctgaatttttttttaaatatatttgatgacataaatttttgtgtagtttatttatcttggacataagtattttggaatcttttaaacctggaaaataaatagtccttttaatgttgga

SEQ ID NO: 720344 - DNA, 457 bp, Homo sapiens
tgctctagaggatcctatgctaactactggaaatatttctagccgtgaatgtagacatggagaaattctaagcaacatggacaacaacggattctaaaatcacagatcatttcatgagactgccccaagtagaggacagaagaaaagaacagtgggaaacccaaacctcaaagaaccgaaaggaagatccctaaatacgttccacctcacctttctccagataagaagtggcttggaactcccattgaggagatgagaagaatgcctcggtgtgggatcccggctgcctctcttgaggaccatctgccaatcacacaagtaactattcgggtagatcttttgcgcgcaggagaagttcctaaacacttattccaacacacttataaagatatgtgggataacaagcatgttaaacatgcttgttcagaacaacaatttgtaacccgtggaagactga

SEQ ID NO: 720345 - DNA, 214 bp, Homo sapiens
tgatggtggattgggtaaagcatagtacatcactgtgtcctaaaataaccacccagtgaaaactccagccagtgaactggagggtgtcttttgggcacggtaactgagggattattgatgaaagctgaagttcaggatgactgagaaaattgttgaacttcaaaagccatctcagaaagttgcaataggagaggacgctgggctacagcacatg

SEQ ID NO: 720346 - DNA, 271 bp, Homo sapiens
aatattgcagaaacatgggtaagaactggcgcctgtggaatggtcttcagacactccgagatttaccccacgtctgttcgttacttgcgaatagagcacaaattttcatatagaattcaaagcaaaaatgagctgttatgttttaaaaaagagtctcatcaatatgcaaatgtttgactgttttattttatttttttatagagacagggttttgccacgttgcccaggctggtcacgaactcctggactcaaatcatccacccgcctcggc

SEQ ID NO: 720347 - DNA, 213 bp, Homo sapiens
  misc_feature (210)..(210): n is a, c, g, or t
  misc_feature (212)..(213): n is a, c, g, or t
actatcggggaatgtggcggaccctattggtatttccaaatattcaatatgttcggcatagaaatacctgtaatgtataaatgaaaggaagatagttgtcagtggggaatacatagggaaggactgttgttccaacagtatatatagaatagggagatatagcatcaacgatctacatgatatattgtatgtgcgatttatagatttggncnn

SEQ ID NO: 720348 - DNA, 442 bp, Homo sapiens
cattaagcaaatgtctgtgtaacaaaaggtgtcatcaataaagttttaacaagttttttaaaaaagcaaaagctgtatctcagaagaaaatacctgcaacaaagcttagggacaaaggattacagacgaagtattcatgtttatattattatttttatttgagacatggtcttgctttgtcgcccaggctggcgtgcagtggcacaatcacagctcactgcatcctcaaacatcggggctcaagcgatccaccccacctgagcctcccatgtattaaaactgcaatacttttgcaccagctaatagctggggattacaggtgcatgccaccatgccagtctccttttaaaattttttgtagagacagatctcactgtgttgcccaggttggtttcaaacttctggccatcttcctgccccagccttctgaagtgctgggatt

SEQ ID NO: 720349 - DNA, 108 bp, Homo sapiens
  misc_feature (54)..(54): n is a, c, g, or t
atgacacgagacctgaagcagtgacatcgacagactgtcatctgtgagaaaaanatttcgcctaataagtaactgatgcacactgatgtgctttggtctggaatcatt

SEQ ID NO: 720350 - DNA, 392 bp, Homo sapiens
  misc_feature (35)..(35): n is a, c, g, or t
  misc_feature (126)..(126): n is a, c, g, or t
  misc_feature (389)..(389): n is a, c, g, or t
agacccccgggttgagtacagggccctattgttgnactgaatttggtctccggcagaaagagcgagcagatttccctttacaacactattcccagttaaagagtagtggccgggagtgatgggtgnatgtcacgcctgtaatcccaacactttgggaggccgaggagggtggatcacttaaggtcaggagtttgagaccagcctagccactatggtgaaaccctgtctctactaaaatacaaaaattagccaggcgtggtggtgggtgcctgtaaactcagctacctgaaggctgaagcaggagaatcacttgaaccccggaggtggaggttgcattgagccgagattgctctactgcactccagggcaacagagcaaaactctgtctnatt

SEQ ID NO: 720351 - DNA, 297 bp, Homo sapiens
ctaaaaaaaattggggggtcctaggggggtttttttgggtttttttccaaaacaaagggtgggcttttgaaccaggggttttttatccaaggtggcttttttggggggggttaatgtttccccccctttttttaaaaaattagggggggggggtttttgttttaataggcccccttttggggagtttttagccttttgggaaaaatgggccccttttggccacccaaaatggttggggaggggttttccgttgttaaaaaaaaaatttttttccattaactttggttccccccccca

SEQ ID NO: 720352 - DNA, 360 bp, Homo sapiens
tgaatctgcaatcgtcaatactcgacgctgatggagttgtgggaatccctccaaggactgaatccatttcaataactagacttatctttctgctccacaagatgcctccaagaaataatcaccagacaggcagggaggcccatcttcatgatctcttacagctctaccatggggccaactcaaagacctagagagggaacattcaaagcaaccactaggttttttattccccgtgaaaccaaagataaattggaagatagaggtgaaggacactcgggaactagggcaaagacagggctagagataagaggaactggtactgtctctgagaattttaatcacaataaaatttggcaagga

SEQ ID NO: 720353 - DNA, 101 bp, Homo sapiens
gagctcgcccggttatgcgtagggatgggagggcgctgaggactagatgatggcggactaatcttcaactcctgccataccccctggcttcccccccgccc

SEQ ID NO: 720354 - DNA, 201 bp, Homo sapiens
gtcgagctgggaatgattcgaacatcgactcgtcccgtccctgcagtccggatactcacgccagaagtgcggctggtgatcccggcgggcagctgcacctgctgtatctctcgtggccgcccttcctgagcgggctcccccgaggcctccctgccttcaccggggctctgttccaggctgtccccgtacggcgtccaggtc

SEQ ID NO: 720355 - DNA, 974 bp, Homo sapiens
aactgaggaggaaaaaaaaaaaaaaagaaaagacccaacaagcctcaagctggcctatctccaaagaggtgggtacagttgtaattgttaaaggggaaaaatttccagggtagtggccagtggaggtgtccaagatatgctgggcagacttttcagcaaagcatcatttctcccagcgtgttataaggaggtcaggggattatacgtgccatatcactctcatagatctccacgatacggcactccagtgtgactcctttaccgaagttatagaaaaacattaattctttctgtgccttctcatgtgactccaaccttaatgtgccctatactctttcttgtgaacatttagaacccaatgtgatctacttttccaggggtgccctgtgcaatatagtgtgtgctccagtgttaagcattacacgacagataccctctcgagtgtgcccttctcgcgtggtcttttatcaccaattttatccgcatttttccccaaaatctacgcggactcataaacattcgagacgaaacttccggccatatagagggtcctacaaggcacgccactctccgctggaaagaaccacaaagaatgatctaaagaacatctatttcacaattggacccattaagttttgttctcacatgtggcgtgtgtatatacccgtgaaccctccgtggaagactcttaaagagagcgtctcgtcgggtgaaaagcactccaacacttgcgtggggcccgtctaccaatcctgagggcacaaaacccattcataaatacactccccgaaaaagcgcggggcgaactaggtgggcctgcgacaaaactataagccaccccaaaggcaaaactgggacaaattgtacgacaggtgtgaaccccacaacaatagggggcccgtgaaaccatcccatagagggcggagaccgccgggggacaagatcccccgtaggggcaacgaaaccacacagac

SEQ ID NO: 720356 - DNA, 113 bp, Homo sapiens
gtttatgggcatatgtcgaccgcgcgctcggaccgcttgtgctggcgtcggagttgtaacgctccactgactgatagagcgaccggtcgagcatggcgcccggagtggcccgc

SEQ ID NO: 720357 - DNA, 357 bp, Homo sapiens
tttggggtttttttgggaaggggaaagggacccccttaaaaaccctttttttttttccaacctaaaaaatttcccccaaatttttgggggggcatggattttgggggggcaatttcccccggggtttttttttttaaccccccctttaaaatgggccccctggttaggggggacctttcccaaaaaaaaaaaaaggttctttgggatttttgggggaaaaaagccccccccttaaaaaaggggaaggtttgggaaaaccgggtttttgggaaaaattttgggaggggggccaaagggttttttaaaaaattttaaaaaaagccctttggttttccccccaaaaaaggttttttttta

SEQ ID NO: 720358 - DNA, 162 bp, Homo sapiens
gggaacaaacgatgaaagagcatggctgggccccgaacctgcggcgccccagcagcccacgagcggaggaggaaggccctgatcgagttccaccagctcctaccagagaggtcttacgagttcttactagcaagcaacacccaccataccaacggacgccat

SEQ ID NO: 720359 - DNA, 122 bp, Homo sapiens
tataccaacaaatttacctggttgggtatgcaaatggttatttcctttttataagttgttcattgggactttctgttcatgcaaaagcactattcccacgattaatagtgttcgttccattt

SEQ ID NO: 720360 - DNA, 193 bp, Homo sapiens
ccagtcatagtgtcaccccaggagcatagattatagccagcatgttcacttcatgctgttgcaaaacatagtctttctttcacacattatgtagtcattgtcttttctaggtgtcagaagtagaccttcatgtggttgagtggcatataaatcctccaacttgttataaacagtcgtgtgggtagaaacagca

SEQ ID NO: 720361 - DNA, 175 bp, Homo sapiens
cggcacaccattgattggcctagcgtcgtccgggtttggccatcattgtaaataagaatgtcttaacggacttgcctagttcaatatataaataaaataaagcagtgcccgacctcactaattcttgtggctgaatggaagcaagtccccatggcaatgttccaacatggagtgg

SEQ ID NO: 720362 - DNA, 274 bp, Homo sapiens
tacctttgccccaagcccccccaaacttttatggtcatgttttattaaagcaggggctccctggaatctctggggcctttttgaggcctttgaagcagaatatagagtggtctcatctccctccttaattttcctggggggtgggatgttccccttggatcatagatttttttattacagatatggtcccctggttttaaatgtgaacttgggggcaaatgggcagattcaatggtcttgttacagattgaataaattttttttttgaagatga

SEQ ID NO: 720363 - DNA, 243 bp, Homo sapiens
tatgatgctcacaaaatagtatttgtgcatcttcagggcaaccatggtacagagagcatggaacaccagcacaggatacaagagcacaaaacaccatcacaggacaccagcacaggcaccaccagcacggacccacgattgtcattcacaaccccaccaccaccagccatggaaacgtcacagttcatccaacaagcaatagcactgccaccagccagggaccctcaactggcacttgctcag

SEQ ID NO: 720364 - DNA, 202 bp, Homo sapiens
acactaccatgcagagaggtcggaccaaggagtcagctctactgatcctcgcggctcagtcatgggtacccgcacagaagtctccgaggtcacgtagaagtgttgctccttgggtcgtcttgtgttaagcgttgtctcccacttagctttaaagaagatgttattcaccatgatcacgaccgctttggaacacggtctctca

SEQ ID NO: 720365 - DNA, 143 bp, Homo sapiens
ggccttttccccccccatttttcttttcccccgggattaggccaagaaggcaaaaaaaggcccccccctgggggccccccccccggggtaaaattttttaaaggtttcctttttaaaaaaaaaacccaaaggggggtttttta

SEQ ID NO: 720366 - DNA, 229 bp, Homo sapiens
tttggtccccaaaacccatttttattttcttttttaaataaaaagtgttagaggccaaaaccccccctaatttaacccaggcccgataaaggaaataaaaattagaacccgggtttgtgtgggggtatatgggggggggtatatgtgggcctccccatagggatagttgtgtgtgaattttagtgaaccccctttctaatttaattaaaacccgtaagggtttgtttta

SEQ ID NO: 720367 - DNA, 519 bp, Homo sapiens
  misc_feature (127)..(128): n is a, c, g, or t
  misc_feature (184)..(184): n is a, c, g, or t
  misc_feature (195)..(195): n is a, c, g, or t
  misc_feature (233)..(233): n is a, c, g, or t
  misc_feature (235)..(235): n is a, c, g, or t
  misc_feature (237)..(237): n is a, c, g, or t
  misc_feature (319)..(319): n is a, c, g, or t
  misc_feature (351)..(351): n is a, c, g, or t
gccgaaggacctgtgctgcctgtgactttgctcctaagtacctactgccgagatgtcctgccagcagagccagcagcagtgccagccccctcccaagtgcactcccaagtgccctcccaagtgtccnnccccaaatgccctccaaagtgtcccctaagtgccctccagtctcttcctgctgcantgtcagctccngaggctgctgtggctccagctctgggggcagctgtggntncnagctctgggggctgctgcagctctgggggaggtggctgctgcctgagccaccacaggcaccacaggtcccaccgtcacagancccagagctctgactgctgcagcagccctcgnggggctccagactgctgtggagggggcagcggacagcactctggaggctgcttgctgaagtggaccttgacttcctcttccttcatgattctgactgaatagctgagaggtaccagcaaaagcttgaagtcttgcctggagaatccctctgactctggtgtcaggaac

SEQ ID NO: 720368 - DNA, 113 bp, Homo sapiens
gaagagaaacacgctgaatgctggccaggatcctctgagagagaagagggacagatcagattatggagcctgtccaggtcactgtaggtactcggtaataatatttccacccc

SEQ ID NO: 720369 - DNA, 1715 bp, Homo sapiens
ggcactgggtggcaaatacatagaagaatgatatttggcccctaatctcaaggaagcaaagtaaagcttatagtattataatatcagtgttatatgtgttgcagtaagctaagagagtaatattggaaaagaagattaacactaatttatagataattatgaatgtctacttagaaaattcatgagaattaaaagtattagcactaataggagttcattgtagtatccagattgacacctatataaattccatttaattttatataaacaataaaaatatttaggaaaaaacctagtaagaacatatataacaaggccaggtacagtggctcacacctgtaattccaggactttgggcaggccgagacaggtggattacttgagtccaggagttcgagcccagctagacaatgtagtgaaacctatccctacaaaacatacaaaaattaccaaactattggtaatgtgcatgcctgtaatcacagtactcaggaggctgaggcccgagaatggttgagctgcgagtggaggttgcagtgagctgagatcacaccattgacccagtctggtcacgattgagatcggccaacacaaaaaaaaaaaacaagaaaacggcgatttcaactattcccattgggagcccgggagacatcaggatcagcatcacaaccggcgcttcacagacaagacaaaagatgtgcgccgccaaagtcaaacgggcgccaagagagtcgtcaacggacagtgcaacgggccactgacaacgaacccgacggatgtcgcatcatccgcgccacgaccacacgacgccacacgacagcacgacagacacgcacgacgcgcacgagccgcagcacacaacgccacgagcacgagagacggaagcagaggacggaaaaaacgaaaaagagacggagcagacgagatcaggcaaccagacgacggggcgcacggcgggcgggcgcgggagatgagcgatcaggagagggagaccggcacagcagagcgacgacaggaaggggcaaagaggagaagcgcaagccagtgaggagggcgagaacacgcgagcagaagcgacaagacgccggcagccagtacaagacagcgcaagcaggcaggaagacaacagaaggacgcaagagagcaggcggaccggaagcgaagggagagcgggaatgggggagagaagaaggaaatgcggagaagaacgggcagagacgaaggacgcagcgagggagagggcggtggcgggagggggaacgagacagccgcaggaggcgaggaggggaggaggagaggaagcgatgcgcggcaaggcggagacgcggagagaagcaagaggggaagggggggaagcaaggaggaaagaggaggagcgtgccgagcggagaggagagcagggcgcgggcgggcggggggaagagaggacggcacgggcagacagacagcacggcggaggcgagagcaggaccgcacggaacgcgacagaggacgacaggcgacacggacaggaacgagcgaggaggaacgagagaaagcgggagccacagcgggggccggaacgcaacacaaggaggaggaggagcagcagaggcgagagacacggcgggaggaggggagcagggaggagagaggagagcgagcgcagcagcggcgcgagaagcggcgcgaacggcgaaccacgacacgaacaggacgcacggacagacagcacc

SEQ ID NO: 720370 - DNA, 226 bp, Homo sapiens; identical to SEQ ID NO: 500189

SEQ ID NO: 720371 - DNA, 1015 bp, Homo sapiens
gctgaacagacagcatggaggctgcgtctacgtaacacgacgaccttagctgagatgggctcgcccctgagggctgcaagaaaaactcggtcgatcgagtctctcgtcaagtaaagcaccttggtgaatgtattagttgcacaatgaccatccgttcgcttatgttaccagttagtactgataactcacttgtgaatggacggctcgctcctccagagatgccgatgcgcaatactaggagtagcctatgctgcatgagttgcgtacaacaggggtcgctcgtgatgtagaaaagcaggagttcttgtactagatcttggcggaaactggagtggactgccctagcactaagcaaacagtgtcaggctcggatttcctggaaagcagtgatacaaggagctgaatgatgggtgcaccgtgccactagaacgttacactggagcggtgattattcctcttgccctgtgatttggatatgctgatatgcaaggggttctttaaaaacactggaagtcctgatgtatcccaatggtgtgcacgagtcggatttccaatacgtgacccgaaattggtctacttggacgttgggtctgcatgacatcgtgctggtggtggtttcttcatctattccaagaagtgatcgaagagtacacgaattgcgtgcaccactatccctcctgtaatgttcccctagcccactgaaatagggaaccggcctgaattccgagttggaagatggaatgtggctgttgcatgacctctgggtagtcgtcgaagagatttacttcgaatttggataaagactgtggttcgaagtataggtttgggtttgctaaaaatgcggaatttgggacaaaaggacgtttctaagaaaaggatttgacgaggccttaatttagtacttttttccagtgtagtgtctttgcggtaaggaaaaaagttaaataatgttaggaagataggcttcaagatgtgaatttgggggaaaagcttattgggagcaacattgggttga

SEQ ID NO: 720372 - DNA, 119 bp, Homo sapiens
aacagcaacggaatccagagagcaatgaaaaagctaatccactacacgcaagtaggcttgatgccttgtgcatgcagaggttgattcagacacatgcaacatacaatacactatgatcc

SEQ ID NO: 720373 - DNA, 217 bp, Homo sapiens
cgctactatacgcctatggcgcactgcgatgggtgaccattatatctcttctcatgctctctagcacgccttatattcacaggcgtgagtcggcctgatgcgcacctgagagagggcgcgtgttgggttgagttgctagacgaatttgaaggttatggccaattggcgcaaggagtatctgagattggctgaacatgcggtgctggagacacctgtt

SEQ ID NO: 720374 - DNA, 701 bp, Homo sapiens
acccttgaggattaaaacgacaataacttagaggttttcaaccctgaaattaccttaggagtgtggtgtattacaggggctacacatgatttagttaagatcatgtattaagttttgtttgtataaaatgctgggttgcacctgaggtgtatactacttgcacctcaggtggcagtccttcagaatccacacccacccagcacaaacatacattatttatcgttgggcggatgttgcactgggcagccaaagcactcaagttgcttggccacctgaggtgtatactacttgcaagtagtatacacctcaggtggcaacctggcatttggatcaaatgttattattgtactaacattgtttaggttagacactcaggtctcccgttctggaacacagactaaggttaaggagagatcagatcaacttcctgatcacaagagaggtgggtggcgtccctgacatggtttgacgtcatctgtttgtggagtccaccgtttgtaaggcacctgaggtgtaaacattgggatcgggcacgtacaataataggacatcaaaacaagagaagaaacccttttttctcttaattctattttcttactttattttcttaacaaccctcattccatcccccacctccccttcatcattctcactatcatgattctatcttctcctccccaccttcctacctctaatcccca

SEQ ID NO: 720375 - DNA, 338 bp, Homo sapiens
  misc_feature (20)..(20): n is a, c, g, or t
  misc_feature (65)..(65): n is a, c, g, or t
ccagtacaaggcagtatttntgtgtgtttgaccaaagcgctttacttcatgtaagagaaaaaatnaagcaaaacaaggccaggttccagtgtcacgcctgtaatcccagcaccctggaaggccaagacaggcggattcccagaggagttgagaccagcctggtcaacatgcgaagccctgtctctactaaaaatacaaaaataagccgggtgtggtggcacatgcctgtaatccctgctacttgggaggctgaggcaaaagaatcacttgaacccaggaggcggaggttgtagtgagccaagattgcgccactgcacttcagcctgggtgacagtaca

SEQ ID NO: 720376 - DNA, 258 bp, Homo sapiens
aaatagccaaaggttgaaatagcacaaggtgagtggtgatatagtcagagagtttcagagcatcatagagagcaccatgattagggcaatactagaatatgagcgttcaaaagaagaggcaaacgatagggcaactagcaaacgcacaaacaagcaaggtctctgaagctctcagacgcagtctctctctcgtctctctgtctgcatctgtctctctctcactctctctcactctctctctctctctctagctctctg

SEQ ID NO: 720377 - DNA, 392 bp, Homo sapiens
gcactgatgatgcaattcgttctaaggctctttctcatccagacaggctccctgctgagcctggcaaaaagtacgtgaacagtcaagaatgaagccagggggaatcagaaaccacacagccccagactagatttcatggactaacataacggaactgtctcaacacgaacacggacagatccattagtgaggtaatgaattctcgccttttatgtcgggatagaacagggccaggtagagacagaatgaaagcagcaacagatagggagagggagcagcagcagagagagcagagcagaggaaaaagtgcgctcagcgcaatgggccggcgtgacacactgtatcaaggggtccaaggacactctagagttagtgcccgtcgggacacacta

SEQ ID NO: 720378 - DNA, 189 bp, Homo sapiens
caggcacagagaggtgtctatttgtaactccaacacttgacaaaaaacaaaactgaagctgtgatgggtttaggcagcaaggggccaggtgcaattggttggtttttaattttggtttcccccaacagtactgaggtcactggcacttttcctcatttcttaagaaaattccagtatgctcggggcggg

SEQ ID NO: 720379 - DNA, 254 bp, Homo sapiens
acagacagaactataaaatactacataaggggcataacaaatgtgaacaaataagtataccatgtgacattaagaagtgtgcgcaaacttacgtgaatgtattaatttactgtgatcttggtcgggtgctaagattacaggcatgaaccacggtgcctggccgaaccatgtataaagcacgcaagcaaaggcagagagagagaagaaagaaaagaaaaaaagttcatgcccatccagagagagattggtgtaca

SEQ ID NO: 720380 - DNA, 853 bp, Homo sapiens
gttggctgctgtcatggcgggtgtactgaagaagaccactggaccttgtgggattggctgtgtgcaatactcctcagcgagaggctaccgaatattgtccaccaagattcttgatgtgcttgaggaaatccctaagaaaagtgcagcattatagaaagtatagcagagacacggattacaagatgagaacgctcgcgcatagtggatctaaacgcaggagacccaggatgatctaaacaagattacaagaccaactttcatacgtgacggtcaccattagaacgatgcgtgagtatcgttcagggctgatacatgagactaaatctggtccagaataatgagtggtaatggcatacctagtgggagtcctattatatgtggtaatgaagtccttccctgaccgcactcacgtggcgtagaattgggccaaactaataaaatctattaaaggtgaactgttgggtgtgtgtgcatgggtaaaactgatgataaattaagatactgtctgataattacttaacgagcgtgctacttagttactgacagtgtttgtagtcaaggagaacaggtgagtagtaggacaagactagtgctaggggagactggctttcacaattccgcgtgacttactggtttaactatgtgtccatgttgcaaagtcgaaaggtgacggtgagttgtattgaaacgtacctccacacacagatcgtcttctcgaacagtgatgcatcatcgtctgttgaaaactgtagaagggcccatgggggaaaggattgtggacaacatctacttgaaagtataggacattcctaacagcaatctatcaaatggggagaagcacccatagagtcat

SEQ ID NO: 720381 - DNA, 369 bp, Homo sapiens
tgtttcatgcactaccagctgttttcacctgcacgatggggctggtgtactgtgggctgccaccggagctgcccttgtcaagtgttctggcgcccacggtgcgctatgaggtggacactgtgcttcgctaccggtgccgggacggactggtccagcgcaatctgtcgctgatccgatgccaagagaacggtcgttgggaggacccccagatctcctgtgtgcccagaagagctgtccgagctctagacccagaggaggacccagaacgacgtcagggaaggctactgggacgctggaaggggctgttgatccccccttccagccccatgccaggtccctaggaggcaaggcctttgaagacaccacgga

SEQ ID NO: 720382 - DNA, 220 bp, Homo sapiens
aggatccccaatctttatttctatttcgcttttgtacgagacggggttgtcgctatggtcgcccaagtcactattgaaactgctgggctcaagtgatccaccaacttcaggctctcaaaatgctgggattacaggtgtgagctgccatgcctggcccttcttagagcggtcttgctttgttgccccacctggagtgcagtagagtgatcatagctcagat

SEQ ID NO: 720383 - DNA, 965 bp, Homo sapiens
gaaaagaaggatggtgacaatgaagaagaagaagaagattagggcaaaatgtacatcgatcaagaagagctcaacgaaaacaaagcccatctggaccaggaaatcccgatgatattactaatgaggagtcacggcagaattctataagagcgttgacaatgactgggaagatcatcttggcagtgaagcatattatcatgtttgaagggacagtgtggcaattcatgagcccttctatttgtcccacgacgtgctccttttagatctgttttgaaaacagaaagaaacgagaacaacatcaaatttgtatgtacgccagagtttacatcatggataactgtgaggagctaatccctgaatatcttgaacttcattagaggggtggtagactcggaggatctccctctaagacatatcccgtgaggatgtagcaacaaagcaaaatttggaacagttatcaggaagaattaggtcaaaaaatgcttagaactctttactgaactggcggccgataattgagaagcatacaagaaattctatgagcacaatctctaaaatccataaagctaggaatacacgaagactctcaaaatcggaagcaagctttcagagctgtacaggtactacacatctgactcttgtgatgccactggttactcttccaggcctactggccagaactgcacgggaaccaggaacatatctatactatcacagggtgaagaccgacgggaacaagaaacgtaacactacgacctagggggccacgagctcccgaaacaataggggtacacaccagagcaaaaagaggagaggccccaatgagcgaacacaggggccaacaaagagaaggagaatgaaggcgcaacacacagagtgacacaacaccaagagaagccatagagaccagcaagcgcaaccacaagaagcagagcgcacacgacaacaccagcgaacacacgcac

SEQ ID NO: 720384 - DNA, 389 bp, Homo sapiens
agctcgggccggcatactggacttctacaataccttctcacattctctctttgaacccagacaacaaccccacaaagcaggtggtattaaaaggtaagactcccgaccaggcacggtgactcacacctgtaatcccagcactttgggaggccaaggtgggcggatcacttgaggccaggagttcaagaccagcatggccaacatgacaaaaccccatctctattaaaaatacaaagaaatttagctgagtgtgatggcaggtgcctgtgataccagcaacttgggagtctgagtagtgagaatggcttgaacccgggaggcagaggttgcattgagctgagatcgtgccactgcactctagccttggcgatagagcgagacttcatctc

SEQ ID NO: 720385 - DNA, 157 bp, Homo sapiens
ttgctaatatatgtaatcacattccttaggaggacttggtaatggttttatgcatgatggttttttttttctttttggccaaatggactgtcacgcggcagcttcagggagctcgcattctctggtgtcgtgtggccctcgtgcccatcaagtgcag

SEQ ID NO: 720386 - DNA, 178 bp, Homo sapiens
gcaccgcagatatcattttattcggcttccgtaccagtgttgggagtcagctcatactctcacgccgcgctcgggatcgcgatgattatagtagcggaggtgaaatatgctcgtgtgtctacgtctatccctacggtgcgttggcccaggatatccgagctcgatatcgtgatcgttg

SEQ ID NO: 720387 - DNA, 159 bp, Homo sapiens
tgagcccgacctttcaaagcggaatgctgcccagaagacagatacatcccagcatgatcaggatcacccaagcttcaacaagatcaccccaaccatggctgaggttcgccttcagcgctataccggcatgctggctacactcagtcgcaagcagcatct

SEQ ID NO: 720388 - DNA, 265 bp, Homo sapiens
ctagcaggatcctccaggaagccccatcctctcgggcaccagcaaagcatgcatgggggcagggcagccacaggtccagcgtgggcaagcagggtccagtggtgccactgcagcgtgtcaacattcgttccgttcccttcattcaaacattcagcacacctggcagtcatgcaatttcactttatctccaacattcgtgtgcccaggcagcaggttggcatgcagtttcaattcacacaggggtaacctgcagactccgcacata

SEQ ID NO: 720389 - DNA, 388 bp, Homo sapiens
ttacttcgcgataaatacatacttcggaaaagtcctcccctacaaagcaatttgaaaaattagaaacagcaaatatcacatcagatgcacagatatcaacttcaggatgcaggaaacgtgaaaaaacaagaaaatatgataccaccaaaggaacacaataattctccagcaacagatcccaatcaaaagtaaacttacaaaattctgggaaaagaattcaaagttgtgatattaaaaaagctcagggaggtgagatacaaactttaaaatttgttttaaaaaaatacaaagaaatcagaaaaacaattcaggatattaatgagatgtttatcaaaaaaagatacatataaaagaaccaaacaacttctggaaataatttattgatgaa

SEQ ID NO: 720390 - DNA, 231 bp, Homo sapiens
tatcaggaagacacattactagggtgttaagaatgaagtaaaaatggtatttttatttcatatttatgtgtaattccaactcaaatgactaataagttgttaggacataaatactatcagctgtttaaacccaactaattaaaaagaactgctgagtgtgttttttggctcagggggtactatgaaaacattactgagacaaaattactgggaaacgcccgaacggtgggg

SEQ ID NO: 720391 - DNA, 360 bp, Homo sapiens
  misc_feature (26)..(26): n is a, c, g, or t
  misc_feature (31)..(32): n is a, c, g, or t
  misc_feature (35)..(35): n is a, c, g, or t
  misc_feature (49)..(49): n is a, c, g, or t
  misc_feature (62)..(62): n is a, c, g, or t
  misc_feature (65)..(65): n is a, c, g, or t
  misc_feature (276)..(276): n is a, c, g, or t
  misc_feature (332)..(332): n is a, c, g, or t
tatatgttctcgatccgttaaaatantacanncanaaaaagataaagtnctcagtaattccnaantgctatccaataaacagcaggaaagtgatctgctataagcagctgtaactcacaactctcaaatcaaatgtactaaaatgtactaaatgctcatcttaaaggtagactgaatttttagggacaactaaagatctgaagctgcctattatgaataaggttaagtattcaaactgctcttgattcaaaacaaactatgactacaacagaaatnggatcttaatgtagtttacctcctttcccacctcccaatcacctaatctaaacatngtatcacaatgtctagtctaacttagtc

SEQ ID NO: 720392 - DNA, 1025 bp, Homo sapiens
gatatcccgggatattttttactaatgaatatttaatattccttattgaataaatgctgtaacttgtttgctatggaacttattcttaaagttctagttaaaaataatttttccacatgcatgaaaatatgtattaatcagaggtggcttaattacattgaaattgcttttttgttgtgttagccactgatgtaactcatgtttgtgtatgacataatgcctgttactcagagtttatattgtccttcagtctatagttttaagatcaaaaggtcggggtaatgtgatacttttggatcttacttagttatacttttttataaatgacactagaaaaactacatgtattggttatatagctagaagatgtgccacactttccaagtgtcatgatacacatcatgtcaccattcaggttcacacagcaatgtgtgtttcataatgcaccttctaacctggtcatgacgatattacttgcacgatgtgtacctttgactcgtctcgcgttcactcctgtacctctttctgccagtctccgcgtcgtcgttcttgtgttctcccactctacgctctcgttcttacgtccggtccctctcctcacatcacttctctccctcctcgaccaatctgtcccctccttcgccccttctggcccctctctcttctccgcgggataaccacttcgtccgcggcgccgacgcgcggtctcgctcgccaccctcctctgcccccgattcgagtctcgcgctcgtcgttccagcgagcgcccttcaccccatccctcgcgaaacctctgtcgttcttctttcgcgcggtccccttgaccgatgtccgcctccaccgacacagtcgacgctgccctctgctcatcgcctttctcctcttgtgcgtccggatgcgccttccatgctacctttcgcagtcttttcctcgcccgcccgctccctctgatggcctcacttcccccgcctctcccttcgtctcttccgcgcccctgtcgtcaccactcccgactgcctcgtctg

SEQ ID NO: 720393 - DNA, 621 bp, Homo sapiens
  misc_feature (68)..(68): n is a, c, g, or t
gcccggtgagggggattattccatccatttatcattaatcgtggaattatcattcaatttaaaggaancctgcactcctgaagaggggaaaaattattaacatcaagttaatccaagttccccagatgcagccaggagttaaggagttaaagaaaaaagattatgtggagggcacaatgagaaggctgaaacataaatgtcatcagtatttgagaagaaaaagtgcagaacataggggggcggatagaggagaaaaacaaattgtgggggtcacagcagaaataatagaagctaaaagactggataataacaccttcaaagtgctaagaaaaaaacaactggcaactcgtaactatatacctgctgtgcctcctgggttcaagcgattctcttgcctcagcctcccaaggtgccagccaccacatctggcacatttttgtattttaagtagagacagaatttcaccatgttgggcaggctggtctcaaactccttgtctcaagtgatcctcccacctcggcctcccaaagtgctgggattacagacgtgagccaccgcacccagcctgaaaaaatttttgtatagaaaattaaaatatttaaattgtgaaattaaaaaaaa

SEQ ID NO: 720394 - DNA, 162 bp, Homo sapiens
  misc_feature (162)..(162): n is a, c, g, or t
ggttggttttcttaggcgcagacgggggaagcgggagcaaacaattccaggtgccccggagcttgggtttttctgcaaaacttatgttaaccccgcggagggaccccttcgaggaaattctcgttctcgtaccaggagcggatggcggattcgtcgagaatn

SEQ ID NO: 720395 - DNA, 175 bp, Homo sapiens
tgtgggagggcttctgagctctcttctttttggggtcctcggaggctaggttcttgccttggtggcgcctaagctgctctgaaggctcagactgagatgaggtagttgaagtgcaccgcggcggctgctgcccatcttctcccaactgggcatgctcagtgccacacatgccttc

SEQ ID NO: 720396 - DNA, 410 bp, Homo sapiens
ccagaagtgagaagatgtctatttgtctttctgtacctggattatttcacttaacataataagtctccaattctgcccatgttattgcaaatgataagatctcattctttttttctttttttaatttttaatttttattttttttttgagacagtcatgctctcgtcaccccagctgaagtgcaatggcatgatatcggctcattgcaacctccacctcccgggttcaagtgatttctgcctcagcctcccgagtagctggtataacaggagcccgccagaatgcccagctaattttggtatttccagtaaagacgaggttccaccatgttggccaggctggtcttgaactcctgaccttgtgatccaccctcctcggcctcccaaagtgctgggataataggcgtgagc

SEQ ID NO: 720397 - DNA, 944 bp, Homo sapiens
  misc_feature (71)..(71): n is a, c, g, or t
  misc_feature (83)..(83): n is a, c, g, or t
  misc_feature (270)..(270): n is a, c, g, or t
  misc_feature (278)..(278): n is a, c, g, or t
  misc_feature (408)..(408): n is a, c, g, or t
  misc_feature (422)..(422): n is a, c, g, or t
  misc_feature (483)..(485): n is a, c, g, or t
  misc_feature (569)..(569): n is a, c, g, or t
  misc_feature (582)..(582): n is a, c, g, or t
  misc_feature (588)..(588): n is a, c, g, or t
  misc_feature (595)..(595): n is a, c, g, or t
  misc_feature (603)..(603): n is a, c, g, or t
  misc_feature (635)..(635): n is a, c, g, or t
  misc_feature (653)..(653): n is a, c, g, or t
  misc_feature (715)..(715): n is a, c, g, or t
  misc_feature (760)..(760): n is a, c, g, or t
  misc_feature (788)..(788): n is a, c, g, or t
  misc_feature (915)..(915): n is a, c, g, or t
taaagtttatttattgtacagaagtaatttcaattcaggttttaagtctgaaccttcaaacttgggaagtntttttccaagtnatcagcaagcgccttatcaacttcacgtaggattttaataaaatcttccaccacagggctatagaaaggaagaaggttttgaaatgcagaggaacacttctgtttgctcaactggccttcctttactccctgagccaccgtctcctttgttaatgcctgaaaaatattagaaagaaattcacattanatatcctntaagaattgtcaagtggaaatcatcttgggttaaatcagtccttttagtttcctctgtgttagactctgccgagttctctggttttttctgaaactgttccatattttgtaagacccgaatgaggctgtnaattagaggaaganctactttttctatctttagatactcttgctcagtctgtgagggatagatggcagaaaacannnaaaaaacagaggctagcactgttttctgttcttgaagaatgatgggtggatcatcagactggcagaattcatggcagaacaggncaaaaagtaaatnccaaangtctttnccagtgtnaggacaatgtacaattgcttgaattccatcanccactgtagtgagcagtngtgaaatgtgcatgttaacatcaagccattttggattttcagaacgtacttgtttggcagcntcaagtatacagggcacaagccgaaacactggctgctcttcagantcttcctggggttggtccagaggctgancagccccatttctgacccattctaacattagtttctcatccaaattaaagagcttgttcacaacctcccccaccttcaccagccagttaacatttgttgaacttgaaataatgaagcaaattctatnataaatagctggatgtcctgggatccttt

SEQ ID NO: 720398 - DNA, 206 bp, Homo sapiens
caggtcacatataatcacggctatcattcctgtaggtatgtactatgatcttctgattaagtcactcagaatatcttctggctattttggccaggaatcacaaagattattaagagtggttggaatcaagaagatctatgatggaacattgaatgaactgggattatagagccatggagaagagaacaccgagggtcaacccatgg

SEQ ID NO: 720399 - DNA, 491 bp, Homo sapiens
  misc_feature (71)..(71): n is a, c, g, or t
  misc_feature (83)..(83): n is a, c, g, or t
  misc_feature (270)..(270): n is a, c, g, or t
  misc_feature (278)..(278): n is a, c, g, or t
taaagtttatttattgtacagaagtaatttcaattcaggttttaagtctgaaccttcaaacttgggaagtntttttccaagtnatcagcaagcgccttatcaacttcacgtaggattttaataaaatcttccaccacagggctatagaaaggaagaaggttttgaaatgcagaggaacacttctgtttgctcaactggccttcctttactccctgagccaccgtctcctttgttaatgcctgaaaaatattagaaagaaattcacattanatatcctntaagaattgtcaagtggaaatcatcttgggttaaatcagtccttttagtttcctcttcgtcgcaacccctcgccgccgccaccgagtcgcgacaaggaggaggaggaggaggtggccggtggagaacatgcatagggagcacggtgtacagcaaacacatggctattcggcgtcctaagcggactcatccagattgattagcgcgtgctgctg

SEQ ID NO: 720400 - DNA, 414 bp, Homo sapiens
cggcttcacggaacttttctcttctttacttgcttaatgttgctaatggtcaatcaattttgtttgtgtttacagaaaactggctttttgatttatcttttgtggtatttttttgtttattttgtttgaatttcatttagttctgctctgatgctcgttattacttttcttctgtatgggtttgggtttgattcgttcttgtttctctggttacttcaggtgtgactttagattgtctgtttgtgctctttcagtctttttgatgtggccatttaatgctgtgaacattcctttaaacatcactttcgctgtgtccttgaggttttgatatgtagtagtcactattactgtccagttgtaggaattaatttccatctagatttcattgttgacccaaagttccgttgaagccgt

SEQ ID NO: 720401 - DNA, 204 bp, Homo sapiens
  misc_feature (106)..(106): n is a, c, g, or t
  misc_feature (194)..(194): n is a, c, g, or t
  misc_feature (196)..(196): n is a, c, g, or t
cctccgccgcccgactcacacacaccctcccccgggaacggcaagtctcctcgggttccaaggacagggtcaaaagacagggtcaaaagacaagaggcccgaggcntcccgccgtgatttgcagccagataccgttgggagcgcagcccagagagcgttgggagcgtgtgtacctccagcccaacgatttgtcngnagcggtcc

SEQ ID NO: 720402 - DNA, 149 bp, Homo sapiens
atccaagatgttctcttcccattagcacggttaattttggtcacgacttcggcaatgataatctttgcttcaatggcatctttgagtttcttatacgttggggttcttgtagatctccaggtgagccccttgaaatggtcgccaatccg

SEQ ID NO: 720403 - DNA, 314 bp, Homo sapiens
tgactgagtctgctgtgcgcactggctgacgcttcttggcctggcacgtatagagctccgctgtacttctcagtgatgttggagcataacgagctcttgtgtgtgttgctgcctgttcccatcaatcagccaagaatactgtgcacgtgggtcagcggctgcatggcaggagaggctgaggttcacccctggacggtactaggtgtctgaggggtaaatggtgggctctctgcagtctccacctcccgggtccaagcgattctcctgcctcagccctcccgagtaactgggactacaggtgcgcgccaccaagc

SEQ ID NO: 720404 - DNA, 665 bp, Homo sapiens
  misc_feature (36)..(36): n is a, c, g, or t
  misc_feature (100)..(101): n is a, c, g, or t
  misc_feature (106)..(106): n is a, c, g, or t
  misc_feature (151)..(151): n is a, c, g, or t
  misc_feature (325)..(326): n is a, c, g, or t
  misc_feature (329)..(330): n is a, c, g, or t
  misc_feature (345)..(346): n is a, c, g, or t
  misc_feature (392)..(392): n is a, c, g, or t
  misc_feature (427)..(427): n is a, c, g, or t
  misc_feature (488)..(488): n is a, c, g, or t
  misc_feature (493)..(493): n is a, c, g, or t
  misc_feature (553)..(553): n is a, c, g, or t
acgcgttctcctcacagctcttatgaagcaagaagnaagagagaaacagtattacaggaacttgataggggattatattgggatggaagagcacccaganntccgncagttcgtgggcaagaggtgagaagattgatttcgcagacacagncaccaagtatgacaggaggttcaaggtgtgtaaagcgagaactgctccttaccccaaagtgcttgtactatatcggacgagaaaaacgtcaaacagggtcccaggggagggcctggtgaaagacgtctgaatcggaataatcgagatcagaacggatcttgtttgtgttcgttnntgnnaggcaggatgacatnnttattctccatgagcaagagtatgacagtttgcttgaatctgtctncaaaactgaattcctaagcctcttagcaaagcgtnacgaggagaagacccagaagcaactacctctgaaattcagcaatacgcttgaactgaagtngaaanaggaaaactggggcccctggagtgcagggggctcccggcaagtgcagtccaccaagggtnaggggacctggctgtcctcaagcccagtaacaaagtgctgcaggtcagcatcggacctggaatggccaagaactaccgtccttacagaaagaacactacccaaaatacaggt

SEQ ID NO: 720405 - DNA, 380 bp, Homo sapiens
agggtggccggctttcccaaaaagggggccgggcccatgggctttttttgggatccgagaggggggaacaattcccggaggtccctccaggccaaagtgaaggggttaaagggggcccgccccaaatttttctttttccccaggaagccctgggcccccaaaaagggaaacatttttgttaaaaaattaaaattggccccccagtttcccggccggttaatccccttcgggaagttttttaaaaaggaaaaggctcggttcttccttggggaaaaaaaaatttttaaacccttcgttattttccgtatggcccgtcccaacccccggttttttggcaaaggggcaaaaaaacccaaggaaccccccaaccgggattttta

SEQ ID NO: 720406 - DNA, 288 bp, Homo sapiens
  misc_feature (71)..(71): n is a, c, g, or t
  misc_feature (90)..(90): n is a, c, g, or t
  misc_feature (159)..(159): n is a, c, g, or t
  misc_feature (232)..(232): n is a, c, g, or t
  misc_feature (255)..(255): n is a, c, g, or t
gggaagctgaggcgggcagatcacgaggttgggatatcaagaccatcctggccaacatggtgaaccctgtntctactaaaaatgcaaaanttagctgggcatggtggtgcgtgcctgtaatcccagctactcgggaggctgaggtgggagaatcgcttnaacccaggaggtggaggttgcagtgagctgagatttcgccactgcactccagcctggtgacatagtgagactncgtctcaataaaaaagccatgtntgcatttagtcattacacttttaaagggtctgt

SEQ ID NO: 720407 - DNA, 1285 bp, Homo sapiens
tgactggccaatttacatttacaatgaccctggcgttggatgttggtttaattcaggaaagtatttaatccaaacaagaccataggaagaaaaaaaagaaaaaaaaaaaactcatttatcccagcgttaaaagctttataaaaccattttgccagtctcatgtcactatttaaatatcggaagtggtgacccaaagagtctttctacaatatctcttgtactggctactgaattacagccaggattcatactattggacaaacgtgtgcctgggctgtggacctcctggatttggggctttaaacaaccatgtcaaagaaaaaaaacggctttacaaacgaaacactacaaacccaaacacaaggccggattgttgtgcatagtgggccccttcaccaattaccccatatcccccttttaaaaagtgcatattttatagagacaacgggtggcgactataaaagaggggtatatcaccccctattagtgcaacctccttgtgagtaccccccacggttgtggaggccctaaacacacatagtcccttttttatcacaaggcccaaacacaagacgagtggagcatgtgttagctgtgtggctacaaggaaaccagtggtgtgtgcatcagacaccgcgggccttcacaatgtgtcgcagcccgcatacgacacatctgttatgacatccttaaaattactaattatagacgagagaacaccaattattcaccaaaaaaacatgtactttaaaagcgaattgatatatccgagaaaaaatgactttattacccacaacaaatgtacttatcctatatgacccccttaagattatacacaccataaccttaaattatacacgattgaaacagattcccgcctatttatttacgacgtggttaactacaccaaggtgggatatgtgcaaatacaatcagaccgacgaggggccaattatgccgcgatatggttccacagaagtagaatagaatatggtcagctagctgggataatgatcacataacaatgatgggggatcacccacaataacaaccactgtaacaagtaggattgataccacagcccacaggtcgctacctcatttccatcttaatattaaaacaattgttaaaacccccctcatagtttgtagaaaaaaaatacttcttatcctatataggccccgcacataattatattatccctactaaaactaggatccatggtgaattcttgtggatgtccactcatcattattgtgtgagccaaccacaactaatacaaccc

SEQ ID NO: 720408 - DNA, 908 bp, Homo sapiens
gggggccgcgcgtgtgtgcgctcgcttcgtggaggtgtgctgtggcggagcagcccctgtcactatgaatctactgccacacgccattttctggggaccttacagaaattgcctcttcaggcaggtgtcagaaatttccatactgctcctgtccgatccttgttcctgctgcgccctgtgcccatcctgttggcaacaggtggagggtatgccgggtaccggcagtatgagaagtacagggaacggaagcttgagaagctgggcttggagatcccgcccaaacttgctagtcactgggaggtgtccctgtataaatctgtgccaacgcgtttgctgtcacgtgcctgtggtcgcctcaaccaagtagaacttccttactggctccggaggccagtctacagcctgtatatctggacctttggggtgaacatgactgaggctgcagtggaggacctgcaccactaccgcaacctcagcgagttcttccggcgtaagctgaagcctcaggcacggccgtatgtggcttgcactgtgtgaccagcccatcagatggcaagatcctcacctttgggcaggtgaagaactctgaggtggagcaggtaaagggcgtaacctacttccttggagtccttccctgggccctcgagcccagtacagaggactgccttcccttccagtttcctccagtgactccttccagaaaccagctggttcacccgggaagggaatgagcgtgtaccctgtgttcatcttactggccccagggacttcactgtttcctctcccccatgatggacctctcacattggggccttcccagttcctgtgttctggacccggctggccgatggtgcagagcctttgggcagggcgtgtccacgcgacggaacagggttctcaccggggcc

SEQ ID NO: 720409 - DNA, 236 bp, Homo sapiens
tctgcgttggttctggtcaatagatagagaagatgcagcatgacagaacgacaagatcttgtatactataggacatcaagcccatcacatgccagccagtgaaggaaggattccagacctatgccctcaatcacaataagaccaccagactaccaacatcttcctactgcaaactacattgcatttctcgacctttacgatccacactcagacattcctcgcaaacagaggggaat

SEQ ID NO: 720410 - DNA, 864 bp, Homo sapiens
  misc_feature (1)..(1): n is a, c, g, or t
nctccgcctatggtgcttcccgtctggtggtgggggtcgcttatcgtctcgcgcgacaaaagaggtgttggtgtatattggggcgcgccgaacaacctctcccggtgcgtgtggtggctgtggggtggtacgaaaaaacaaatcgggcgggtttgtggccggcactcatgcgtgctgcgttagaaaatatgctgggtgcgccggatataaatactactacttgggtggtttgaccgacccaatgtctttagagaatattttttttcttgtgcgagaatagtggatggggtcttgtttatgtgatttctttgtctcttttctttcaggaagaagagcgactcccccctgtgtctgtgttcacacgacttcagggatggggcgtgcgtcacacattgtcagctaatttgtttgggcttactcatgtgtcgtaaagactggctcgcccctcctcccacgtggacggcccaaaccgcaatcctgtttgtgtcgtccccttggtcggccctcgcaccagctaaagcaccgtggagtatatatcttatgcgccacccccgcccgcacacgccccctggtgctaggaattcagtgggtcttcaacatattctcttacaatgattttcataactccccaacattgttcaatttttagcatcgccttttcccacagtgatttatgaactgtgtgcgattaatacgaaattacacacacaattgatagattctacttattctttggatactcatgtaacagtattttatctagcactgctgctaacccttgtggacaaccctttaatacagaacaagacaacaacttcttccccatcccgcatccaccaccggctttcccccccagcctagaca

SEQ ID NO: 720411 - DNA, 751 bp, Homo sapiens
  misc_feature (40)..(40): n is a, c, g, or t
  misc_feature (81)..(82): n is a, c, g, or t
  misc_feature (111)..(111): n is a, c, g, or t
  misc_feature (118)..(118): n is a, c, g, or t
  misc_feature (167)..(167): n is a, c, g, or t
  misc_feature (177)..(177): n is a, c, g, or t
  misc_feature (188)..(188): n is a, c, g, or t
  misc_feature (206)..(206): n is a, c, g, or t
  misc_feature (217)..(217): n is a, c, g, or t
  misc_feature (222)..(222): n is a, c, g, or t
  misc_feature (229)..(229): n is a, c, g, or t
  misc_feature (234)..(234): n is a, c, g, or t
  misc_feature (329)..(329): n is a, c, g, or t
  misc_feature (443)..(443): n is a, c, g, or t
  misc_feature (523)..(523): n is a, c, g, or t
  misc_feature (534)..(534): n is a, c, g, or t
  misc_feature (613)..(613): n is a, c, g, or t
  misc_feature (631)..(631): n is a, c, g, or t
  misc_feature (678)..(678): n is a, c, g, or t
  misc_feature (685)..(685): n is a, c, g, or t
  misc_feature (716)..(716): n is a, c, g, or t
atggagctcgaaaaaatagtagaagaaaacggtgctaatnaaggcacgggaaggtggcggtggaaatagcaaaggcaaaannaaaaaatggcggcaaatgctccagttccntcacatnagccagtgcgaagagctgcggctcagcctcgagcgtgaatataacagcntgtgcgagcngcagcccattnggcgcttgctgtttcganagttctgtgcnacgangccgganctganccgctgcgtcgccttcctggatggggtggccgagtatgaagtgaccccggatgaaaagcggaaggcatgtgggcggcagctaaagcagaattttntgagcaaaacgggtactgaactaatcactaaagtcccccggaagctggtgacgaactgcacccagcggctggagcagggtccctgcaaaaaaattttcaaggaaataaaacggntgaaccacgagtacctgagcgtggccccttttgccgactacctcgacagcatctacttcaaccgtttcctgcagtggaantggctggaaangcagccagtgaccaaaaacaccttcaggcaataccgagtcctgggcaaaggtggctttggggaggtgtgcgcctgccangtgcgggccacaggtaanatgtatgcctgcaagaagctagagaaaaaagcggatcaagaagcggncaggggnggccatggggctgaacgagaagcagatcctngagaaagtgaacagtaggtttgtagtgagcttggc

SEQ ID NO: 720412 - DNA, 203 bp, Homo sapiens
tggggggggttttttttttcaaaaaaattttataaaggggggggagggggaaagggccccgcgggggcccccccccaaaaaaaacccgcgggggggggtaccccccccgaagaaaaagcccgctagtaaggcggcacgtctgtgccataatagtacaagatggcagtgagtgaaacacgaaactgagggtgcttctcctctta

SEQ ID NO: 720413 - DNA, 639 bp, Homo sapiens
gtaaaagctgtaaatggacataaggagcgcttagaggtctactgtggaaagaggaaatatcttcacatagaaaactagacagaagaattctgagaaacttcttggtgatgtatgtgttcatctcacagatttgaaactttcttttgattgagcagtttggagacactctttttgtagaatctgcaagtggacatttcgagtgcttggtggcctgtggtagaaaacgaaatatcttcacataaaatctagacagaagcaatctgagaaacttctttgtgatgtgcgcattcatctcccagagttgaacctttcttttgttggaccagctttaaatactcttttggtagaatctgcaagtggacatttcgagcgtcttgagtctatggtggaaaatgaaatatcttcacataaaaactagacagaagcattctgagaaacttgtttgtgatgtgtttgttcatctcacagatttgaacctttcctttgatggagcagtttagaaacactctatttgtagaatctgcaagtggatatttggagcacgttgtggcctacagtagaaagggaaatatcttcacataaaatctacacagaagcaatctgagaaacttctttgggatgtgtgcttcatctcacaga

SEQ ID NO: 720414 - DNA, 244 bp, Homo sapiens
aactccattggagatgctacactccttcacatttattcaaaactaaagtaatcctttatatgtattttatggctgtattttcaaaataatcctgagaaaagacacagcagataatcgctatcttacaaaagaaaaaagctgaggcataaacattaggagcagtgtttaaactagattctcactctgtatataatagcccttcatttaaccacacctgcacatactaaatgcagaatttaaattt

SEQ ID NO: 720415 - DNA, 257 bp, Homo sapiens
  misc_feature (227)..(227): n is a, c, g, or t
atttacctttgtttcatgatagttaagataatctaactggaatttctctcacacagcactccattacttcatgataatatccgcttggttatgtcctttaccccattatttattacttctttaagtgtttctgtagtaactttttgacttttttttaacttataaaagatgctcattaaaagagtttgaaaaacttggatatgtattaaatgtggaaatagaaattncttgtgagtccaccattcaaagaaagtttt

SEQ ID NO: 720416 - DNA, 192 bp, Homo sapiens
ccatgaatatggatgggcaacttttcctatccttaagttccacagggccaacttgtactgtgggacttcattatgttcagatttggggatctggaggagttctgcaaccagtctcccatggataacacaggatggctttttattcaaaactgcagtgactagaagtccttgccattgcaacacggtctctca

SEQ ID NO: 720417 - DNA, 514 bp, Homo sapiens
  misc_feature (495)..(495): n is a, c, g, or t
tagaataggatagaatagaatagaatagaacacagtagaatatattagaacagattagaatatattagaatagaacagaacagaacagaatataacagaatagacagaacagaataggacagaataaaatagaatagaatagaatagaacagaatagaacacaacactacacaacactatacgacagaatataatagaatagaacagaaccggatagaaaagaacagaacgtaagacataaccgcggccgcggttatgtcttacgctgcccttgctcagtgggttaacgatccggcgttgccgtgagctgtggtgtaggttgcagacgcggctcggatcccgcgttgctgtggctctggcgtaggccggtggctacagctccgatttaacctgaactctaacacgtagcagtgtcaacaactgctgctttaagatgtgtctacctacagagtgccagccaggtgcccaaagtcaggtcctgactaagctccgtangacataaccgcgggtccgc

SEQ ID NO: 720418 - DNA, 207 bp, Homo sapiens
ggtgaatgcatttatatattagttatataattaaaagttaaggaaggagttcccgtcgtggcgcagtggttaacgaatccgactaggaaccatgaggttgcgggttcggtccctgcccttgctcagtgggttaacgatccggcgttgccgtgagctgtggtgtaggttgcagacgcggctcggatcccgtgtggctgacattatctc

SEQ ID NO: 720419 - DNA, 323 bp, Homo sapiens
  misc_feature (46)..(46): n is a, c, g, or t
  misc_feature (111)..(111): n is a, c, g, or t
  misc_feature (282)..(282): n is a, c, g, or t
  misc_feature (287)..(288): n is a, c, g, or t
ggtatttctgttgttgttattttcattgtgctttgatgatatattntgaaggtgtgctttccaaagcttcaagctgcagtttaaaatgactggaccaacatatgaaggctntcccagctgggctgtggagtagctatgtatgtcgcaacttttgggggctcagtcttttcactataaagatggtggagtggagttcccgtcgtggcgcagtggttaacgaatccgactaggaaccatgaggttgcgggttcggtcctccaattcaatcccgggccgctcagngggtnnacgatccggcgtgagttcacgaagcggtccgagct

SEQ ID NO: 720420 - DNA, 210 bp, Homo sapiens
cgaataccaggcaaggacccaggtcaactgtatcctgtctggtaccttgatttagaattactgatgctggagttcccgtcgtggcgcagtggttaacgaatccgactaggaaccatgaggttgcgggttcggtcccccctgtcctcgctcagtgggttaactttccggcgttgcttgagctgagtgtataccacacgggcagtgtcatgg

SEQ ID NO: 720421 - DNA, 291 bp, Homo sapiens
  misc_feature (21)..(21): n is a, c, g, or t
  misc_feature (100)..(100): n is a, c, g, or t
  misc_feature (133)..(133): n is a, c, g, or t
  misc_feature (253)..(253): n is a, c, g, or t
  misc_feature (255)..(255): n is a, c, g, or t
  misc_feature (259)..(260): n is a, c, g, or t
  misc_feature (262)..(262): n is a, c, g, or t
cgagctccgtacccccagcgnacatgcggcctaggagtatgattgctgtgttgtggtaagacatgcttagctttgtaagaacatgacagactgtcttccnaagtggttgtactattttccattcacaccatcnatgaatgagagttctttttttttttttaacttttaaaattacagtgtaggagttcccatcgtggcgcagtggttaacgaatccgactaggaaccatgaggttgcgggttcgtcccccgcntnatcnntnggataaggatctggcattgttatgagctg

SEQ ID NO: 720422 - DNA, 204 bp, Homo sapiens
cccagaaagatcttattcctgggactgtgggatttaggccattggggattacaatccaggctcatcatattttatttcatgtgaatgtgttctgaagaaatagaaaaagagggagttcccgtcgtggcgcagtggttaacgaatccgactaggaaccatgaggttgcgggttcggtccatccagtaattcgtacgaggggatcc

SEQ ID NO: 720423 - DNA, 406 bp, Homo sapiens
aagtccacttggtgatggtgtatatatggactggatgcagtttgctagtattctcttgatgacttttctattatttgaaaggaatactgctctatagttttgtgtgtgtgtgtgatgcttttggctttggtgtcatgatagccttgagttcatagaatgagttaagaactgtttcctggagttcccgtcgtggcgcagtggttaacgaatccgactaggaaccatgaggttgcgggttcggtcctccctgcccttgctcagtgggttaaggatccggcgttgccgtgagctgtggtgtaggttgcagacgcggctcggatcccgcgttagctgttgctctggcataggtctggtagactatcagttactgagtttcggagcattatcaggatacatcaagagtcag

SEQ ID NO: 720424 - DNA, 418 bp, Homo sapiens
ggcaatttttacttccccaatttaaaaaaaaaaaaaaaaaaatcccaactcaacatcagtcttctgccattccagacccagccaaagatagtcaaaggacaaaactgaatgaaaatcatcctcaggagttcccgtcgtggcgcagtggttaacgaatccgactaggaaccatgaggttgcgggttcggtccagaccgctcttactaagagcggtctccagctcttggttttattaattttctctattgttttttgagtctctattttattgatttcttctttgatctttacaatttccttccttctgctgactttaggacttctttgttcttctttttctaattatttaggtggagggttaagttgtcaatttgggatctttcttcttttttgagaaagccgctcctaccagacctac

SEQ ID NO: 720425 - DNA, 227 bp, Homo sapiens
cgtacaaggccccgccatcctatataaagaatgctagtacattatgaggaagataaagactttgaaaccttcagcaaagctctaacggcccttaaatataggaacaggagttcccgtcgtggcgcagtggttaacgaatccgactaggaaccatgaggttgcgggttcggtccatacctgcccttgctcagtgggtcaaggttcccatgtgccacgggccttgtacg

SEQ ID NO: 720426 - DNA, 348 bp, Homo sapiens
ctgttgtgttgtctgtctgttcattggtgttgactgtatgtgttgtctttcagttgttgggtgttgactgtgtgtgttgtctttcagttggtgggtgttgactgtatgtgttgtctttcagttggtgggtgttgactgtatgtgttgtctttcagttggtgggtgttgactgtatgtgttgtctttcagttggtgggtgttgactgtatgtgttgtctttcagttggtgggtgttgactgtatgtgttgtctttcagttggtgggtgttgactgtatgtgttgtctttcagttggtgggtgttgactgtatgtgttgtctttcagttggtgggtgttgacgtcgacgc

SEQ ID NO: 720427 - DNA, 182 bp, Homo sapiens
  misc_feature (144)..(144): n is a, c, g, or t
  misc_feature (146)..(146): n is a, c, g, or t
  misc_feature (150)..(151): n is a, c, g, or t
  misc_feature (153)..(153): n is a, c, g, or t
cacacacacacactcactcataccccttttaaaagccttcaggccccctagtcgtgtttagaaataatatcaggagttcccatcgtggcgcagtggttaacgaatccgactaggaaccatgaggttgcgggttcgtcccccgcntnatcnntnggataaggatctggcattgttatgagctg

SEQ ID NO: 720428 - DNA, 454 bp, Homo sapiens
ttctttgcgtcgccagccgagccacatcgctgagacaccatggggaaggtgaaggtcggagtcaacggacttttggtccgttaaatttgggtgcccgtccctgtgggttccaaccccaaggggggcccattggccccttttttttaaaaaccttaccaattggggctttacaaccaagggcgattggggggcaacttttaactttttctggggcattttacatgtgggggggcccccccccccaaaaagtttttcccccaaaaaaattttgggtaaaacgcccccccctttgtcccaacttttttgggaaaacccccctttccgaaaaaggcctttaaccccaaatttgggcgttttttaacccaagttggtttccaagataattgaatttcccacgccatgggcaagatttcccatggcacccggtcagaggcttgagaactgggacagcttg

SEQ ID NO: 720429 - DNA, 478 bp, Homo sapiens
gaggaaaagagcatcagactctacacacctgttttggatcctggttccacctcttccatgctgtgtgatcttgggcaggtcacttaacctctctgagcctcaggtcccatatctatagaatgagagtaattgtagtacctaccttacacagctattgtgagtattaaatgagctatttcatgtgtagcacttagcacacataagcacttactaattattagctttaattaggaattattagcttcaattaagaattattaacaactagcttggacaagctttgaacctctctaggactcattttcatctgtgagatgggattaaagtgccaaccttgtcagtgttgtcatgagaattaaattagatcatgtatgtgaattgtctggcccagagctggttctcagcaaatgctggtttgcccctttcctgctttctcgctcctttccaacacactggcttaagacctcgcttggaaaaa

SEQ ID NO: 720430 - DNA, 1713 bp, Homo sapiens
ctttgtcaactcctgtggtcaagccacctcgtgacgtccggaggaggcaggaaaagtttggaacgggaggagcagctgtccctgagaaaatcaagatcaatgccagcccctgtaccccatgggaagcatgccatgcttcctgccagtagcatcatgctttaaccccatgccctgatggagccgtgctatgatggcccaagcgaccagacagtgaccacttggcaccagctggtcacgcacgcactgtttcctatgatcctagtgaaacccactgtgaagaacaattgccccactgatggccaacgaccaattacacgctcttcaagcaacagattctcccgacgatacaactgagtgactctgccctctgcgcaatggcatctggcgagcgcaggacatacaacggaccgtggcgggtcgggcgacctggactcctacaacgagacttgcagtctatgctcaccgtggacaccaatatggtactccgaagatcatgcagtctagcaggtgcctgcacctggggaaacctgctgtgccacagccccgcacctacccatgcctggagccacacttccacgaactcactgaccacactgcacgcctcctgcacacacatgaccgcataccaacggcgcaacaccacaccaccagcccgcccccccaaccactacctgccaccccataagaacgcagcacgcactcaaccaatattgcccccaacacggccccacacacatcccccacctaggccacagacccccgcaccatacacaacaaacgccccaacacacccgcaccacaacacccacgacccataacacccaacgaccaaagccccggagccctggccccccgcccgacccaactcaccctgcgaagcccccagtcccaccgccacccaccactcacaccaaccaccgaaagacgcaaccatatccgccaactctctaaatcacatccatcccacgccccaccccagccacccacacacgcgcacaacacctcaccccgaccacccacaccacgccaacccacaccccccgcagcaccgccgcgcggacaagcagctgaatggcagcacgaggaactcggagccggcacaccatctgccaccgagggccccccacctgacgcgagcccccgccccagtaccaacagccgcgaccaccaacagacccccaccccagccacacacaacgcaccacacagcaacgcgcccactcacaaccaccgcaacaagacacacgcgcgcttccaaccccgccactctcaaatccgcattccacagcaacaccacacgacaccaaaacgcacacacaccccccaactcacaacccacaccacctccccaatcccaaccccaaccaccacactacacaacaacccacaccacatacacgacataccaaccatccatcacacataatctaacaactccatctcgtcactactacagactcaacactactccccccccaccccacacacgcacaccaaactcataaccaccccacccgcgcacgcaacataatcatcccaccacgtgatactcgcacctcctctcgacgactccctccttcgtcacacaccacgcccaccctccaccacacacctccgcccaccccccccactctacccatcaccacaaataaccagctccaccacactcctacttcatattgatcctcatcctcttgcttacaatctaacaca

SEQ ID NO: 720431 - DNA, 742 bp, Homo sapiens
tggaaacaggctggagtgcaggggtgcaacctcggtccgttgcaacctctgtctccccaggttcaagtgatcctcctgcctcagcccccccaaatagtctggtatattacaggcccccccccccacgcctcggcttaatttttggttttttaagataagagacagggtttcacttattgttgtgcgccaggctgtgctcctttgaacctcctgtgaccctcaggttgactcccgcccacctttggccctcccaaagttgcgtgggaattcagcgcattgagattaccccagcctgtggccaatgtggagatttttgagacgcgccacttctcctgaggtagaaggccgctttgtcgcattgggagattgtgagaaagaagccaccccacaaccttctctatagtctccggctctccaggagacagggccttgagacgcattgtgtgaagacattgggcttagtgtaaaatagcggcaaaccctgtgaaagttgaaagcgcccgagggggctttctctccaacgagacagaaaaacagcacttgtggctttggggttcccatgtgctgaggagacgggggcatagcgccttggtgtgggggcgccccatttcacaagagaggcccggccactcggatggctaaagcgcctgtctctcccaagcactttgtgggcagcacccacggtggggcagcgatagctttgaggccatagatttgcaagaccacccttgttcaactttgt

SEQ ID NO: 720432 - DNA, 178 bp, Homo sapiens
ggctcggacctgttcgctgggctgctgtggaaggttgtcgattgttgacaagggatgaggctgtggtactgccagggacagtgttgcctctgttgagcctccctgccagctccacaaccccctgccataatgagtaatacggatgtgtttaggagtgggacttctaggggatttagcg

SEQ ID NO: 720433 - DNA, 416 bp, Homo sapiens
  misc_feature (93)..(93): n is a, c, g, or t
ctagctacttaaggatccataggcgtaggagccaggaacgtgcagtccgcgctgcggtgggtgtgcttgacttgcaggactgggctgcggacngggtgcaggagctcagtgtgctgtcatctctcctctagctggtgctgagtgtctgtctgctgctgcgactccgaggaagcaggagatctgaagggtcagtgatgcgataggatgtgtgttgtactatagtagccaggataagttcatggccttggcagtgattctcattgaatgtacctgtatgtttccatcacatttatgttggccaaatagccaatagtcttgcatggggaaaccaccgtatagccgatccagtccaggagctgggcgaacactgtccatgcggtactcacacgctgtggccgaccctatcgtatcatggg

SEQ ID NO: 720434 - DNA, 1694 bp, Homo sapiens
gactgtacgcttgagaatgctgcgggcaggcgctgtgttcaggcgagacttgacgccctaatgaggaccggagaagaagtggcagttggactgaggacaagcgtccagtagtaactggactgagggatacagaaacccgtgcaatggtaaaatctacctggaacgccatgtcttaatgtcatatccatatgcctcggacaggatatacaagatgggcttcatgacaccatctgactgtatcatcaataagggacctaaggcacgtataagaaggcttcgccgcgaggtgtattggttctgttggaagcaagctctcttggcacgcttgagtcgacgatgcggggagcctgtgcggaatcgaagcgtagttgctggactctaattttaggcagcttaaggttagacgcacctgtgtgagcccttttgtgtggaacataacccccgagaattgaccaatatagccacctagagccaaggagagaaggtcgctagggcacagacagactaggaagggctggccagacatcctagtcgaggacatctacaggcgtgcacaggtccattcttttcacccaattcggtgcagtcctttgtggaccggtaccagagggaaaactgaaccagattgtagttcgcacaccattaacgtctctgagtgtgtagaccatgaaggacggatgcgtgtcgacggaattgggtggaaacatcgtcacggtggaaagcttatggaacaggcaccatatcattcatcttgacggacgttgatcgtagagcggtgaacaaatcaattccaagggggaccgaaaggcatgggaagggcaggccaggaaaatgcaagggcctgccatgggtacaagatgagatataccatgacgtttctgggcgcggatgcaacaagtacgcagaagaacgtaaagagggaattaatctagagtcacacttgtttgatgcgaagggaagcaccatgaggagttgaatgtggaggtcgctggaatgggtgtaggtagacaaggcacgtttacgtaccatggtggctaatacgcaaggcaagaggagacaggtatttagaaggaagagaaaatacaccgctagataaagaaaggaaagcaacaagccctgtagaatataaaggaagatgaggggtaaaacaaccaggcaagggtgtgggcagacgacgtctcggcaaagcagccacgacaaaaaggagccactcgggagaatacgtacctatcgcggcatcaacagggagcaacggggaacgccacggcgacgcagtggcatgcaacaacagcaggaagatgttgcccccccatcaaacagctggtgacacagcaaggcgcaggacccaacacacacaggaaaaggcaagctccaacgacgcggggcaaacaggtacgatggtggtcccaaatcgcgaccacagtgaagacgcgctgtgggaggtcacaacgggtgagacagcaccccaggaacgtgaggaccaggtgggggacaggagaacaacctagaggacacaagttcatgccgcatcaactaaccgaagaatgagattgccggaaacggggcagcatgccgtgcagacagaagacgtcaccgccagagagaaccagatcacaagaagaggcagaccgtcaccgagaccgagcgacccccgatggtcaccagaacaaggggacagcgagagcagccaaaca

SEQ ID NO: 720435 - DNA, 488 bp, Homo sapiens
cttagatgggtcagctggactccctggtacagtaggcatctggctgagctggtgggacaaaactctacaaaaagaaggacaaatgatctgagtcccatgagctgaccagagttgctagggagctgcaaaatcacatcctggcctggcacatcagaaaggaatgggggcctcttcaaattagaagacatttatactctttaaaacatggacactttgaaatgtgttactgtataaagcctgtattctcaaacacagttacacttgtgcaacctctatcccaatcggcagcctgggtttctagcccatgaacttcacatacgctcagaatccaagtgaacactagccagacactctggtctgcccttgtaccctaggggcacacttccctctgtttctctttccttggctcccattcacttcttccagaatcctaagtatcccgggtccaggcaaatcagttactacgcagaaaattgctgtgcctccca

SEQ ID NO: 720436 - DNA, 380 bp, Homo sapiens
ccaagaattcggcacgaggagaaggacgtggtcgaaaccctggctggccgcgtgcccgctgaaggctggaatccggccgagctgtcgaaggaattcggcgagctggaataccgcaccatgcgtgactcggtgctggacaccaaggtccgtatcgacggccgtgcgctggacaccgtccgcccgatcgcggtgaagaccggcgtgctgccgcgtacccacggttcctcgctgttcacccgcggcgaaacccaggccatcgtgaccatcaccctgggcaccgcccgtgacggccaggtcatcgacgccgttgccggtgagtacaaggaaaacttcctgttccactacaacttccctccgttctcggtgggtgagtgcggccg

SEQ ID NO: 720437 - DNA, 170 bp, Homo sapiens
agatagctggcaatctcagcacttctgtacagctgcgcgcatcgttgctcgatgtggagtcaggaagaaggacagattcctgggttccgccaccagcatgttgtaccaaaggatggaggcccaaccgctcgggagctggctgacgttggagatcaccacaacgggcagag

SEQ ID NO: 720438 - DNA, 158 bp, Homo sapiens
tttatataattgctcatatccaggacttaacgaatactcatcttatgtgttgctgaaggttctctgttccacagattttcttgctgtcatttcttatttctagtcctcaagtctataggtttcactgtttgcctcagaggagttttactccattaggg

SEQ ID NO: 720439 - DNA, 237 bp, Homo sapiens
  misc_feature (6)..(6): n is a, c, g, or t
  misc_feature (135)..(135): n is a, c, g, or t
  misc_feature (156)..(156): n is a, c, g, or t
  misc_feature (159)..(159): n is a, c, g, or t
  misc_feature (234)..(234): n is a, c, g, or t
acaatntgcttcacaactcatctgacatcccatcagttgttttatgactccacttccagtttgccacgagcgggatggagcagatgagcaccaccagggaggtggcaatgagtaagatgaccatctggatctcgngcgcccgatgcggcggaagcntcngcggcgccgaaagtcgctgaggcgcggcaaggctggggaggcagcggggtggccccgggaggcaaccgaggcggncgc

SEQ ID NO: 720440 - DNA, 455 bp, Homo sapiens
cgttagaaatcctctttagtagttgctcctgtactggaagttgtagagcgagggtcctctctggctccattcagcaattggacccgtgtcgttctccatctatctcagtcagtagtttcaagtgtgcctgataactcctctccttctgttccatcatctgctcattctttcttagcatttcctgcaacatttttgctgaagcatgtgcagactctgctttcacacgttccactgaggaggaaaaggaagaagaaaaattcgtgtggcggttatcttgtcgcctcattcttccttatacacttacctgtcgtagctgtggcctgcatatgccctaaatacagagatgacctcggcaagtaagacacacctttgtgggatcttgctctaagttcacgggtcccatgtacatccaatccaagttatctcactgacgggagctcctgaggcccatctaa

SEQ ID NO: 720441 - DNA, 295 bp, Homo sapiens
  misc_feature (198)..(198): n is a, c, g, or t
cttccttgcccaaacagtgcattacggaggtggttactatttgggcagtaagtgcagcttttagggagggaagtttttgaactggtgcgtgaatagtaagtagcagttcagctggtggaagagagagggtagatttgagaagaagtttaggcagaatgacaagtcagggatttggcaatttactagtgcgaggtagtnctgtagcgaattcgagggtgcagacccagtttcccagcttgggcctactgggttggggtttggtttaatgggctctttactggaaataggagaatac

SEQ ID NO: 720442 - DNA, 302 bp, Homo sapiens
ggtaacttaaggtcagtgctcttctaataggagaaatagcaggcctggagccatggagttatcccagatcctaattaccggcacacactccttcccagcaacatgaacgggggtccttggggtggcgggtcctctatgccaaggtatgctggggccaggtacagagaggggtgggtcaagattccggtccttaaggagtgcgttcctggtcctcaaggagggcatggttaatctggaacatcggggcagaacaaccaaagcgagaatgagggggtcctggtggagtaatcggggtggcctgg

SEQ ID NO: 720443 - DNA, 507 bp, Homo sapiens
catcatcaccgcacccgagtggagtcgacacgtcaataacaaatcatctggcccgtcatcatctaaaggaaaaaagggttcatcttacacagcaagacaacacaaagacagaggcattgacttctacttctccaagaacaaacatttttgaggaggagatgaggtgaaattgcacttttactcaagtgacactgcagcatctgctcaggccacagtttacattgctgaatgaggaagaggaaaatcaaaaaccagtgtggttttatgttgctctttctgaatctgttttcatacacatacagaaatggctacttgctttctttttttgttcttacaaaaactgttactctatttttcatgtatttatttgtattgcattaagttcagtatgacagttttagtggtagtatcccttaagatgtccttgtttagtaaaaaagtaagatcatttataatcatttttcattatgctctacctaaaaataaaaccgttgggcctttgttgga

SEQ ID NO: 720444 - DNA, 160 bp, Homo sapiens
tgtatagtgcaaggtgtaagctaatgtttaatacggtggatatgatccgcaaagttagcttatagtgcgacaaggccatgactgatccagctaaaatctccgctaaatacaggccaatgattagcgttagtagatatggccagctgactataacgctgtt

SEQ ID NO: 720445 - DNA, 149 bp, Homo sapiens
gcgttcctgtgctggtgtgtctgtctcattccttcaggttatgttgccttttggtgagatctcatcctctcttacttgcctcgtgtcgtcctgcttgctcttcttcctgccgtcggtcgctggtcctgttggggggtggcctgcttgct

SEQ ID NO: 720446 - DNA, 258 bp, Homo sapiens
  misc_feature (215)..(215): n is a, c, g, or t
gtcgccatgggccagccagccacagcccagtttgttaccaggtatttgtaagcacacgccagtacccaaagtcttcgctttctgccagaggtgttcattgattgccaagacttcgcattttttgaccataggggcggaaaaaaggaaaaagtcgattgagttttcagctttattggcacataggtctaagatgatattaagagctgtcctatgangcctgagggctgcccgatttttagcacaaagacatagaaaaaa

SEQ ID NO: 720447 - DNA, 147 bp, Homo sapiens
cagaccactgttcgatatcggaataaccagacaatcgctgttgaagtcagaggagaccacctggtgctcagatgtagcccaggatgcccttgagtgggccctccgacgcctgttcaccaccttcttgaatagtcaatcatatttggc

SEQ ID NO: 720448 - DNA, 274 bp, Homo sapiens
  misc_feature (81)..(81): n is a, c, g, or t
  misc_feature (110)..(110): n is a, c, g, or t
  misc_feature (168)..(168): n is a, c, g, or t
  misc_feature (197)..(197): n is a, c, g, or t
  misc_feature (223)..(223): n is a, c, g, or t
  misc_feature (228)..(228): n is a, c, g, or t
aaacgtttagcatcagtgactcacaaaatcagcaacacagaatttctgcaagtaattgaaatccataaccatcagccttgntcaaaactttttagtttttatgactacgnagcaagtgaatgaagagagtttggacaggattcttaaagatcggagaaagaaagtcantggggtggtcagattccggcgcaatacgnagcagaagatgtcctacagagagcanggtcntcacaagcagcttacccgcatccttggcgtgccgacctcggccttc

SEQ ID NO: 720449 - DNA, 971 bp, Homo sapiens
ggcaggtggcgcgctatggccgccgggacctgccccgcagcgccaggagagccacgcggaggtccagaggcggcggtacggacggggagcccgagtacgggcggggacccggccccaggggggaaacccgatagccgatcccgggggtccccaggttgactacaaggtctcccgaaagccgaatccttcgctaataggggggttcctccgccataataggcgggttctcaccataacaggccagtattcttcctttaacgaggccgggtcgcgccatacagggcgcgctttctccccttacaggaagaattcttccgctaacggggaaaaattcatcggcatagggagagggaattcttccactttacagcttcattctggtacacaaggtaactctcttcggtgaaaggcagaattcatccaccaggcaggcgtggtcttcaatacgaaaagtctggggttccctccaaattaattacttcggttctggattcaactctcacagaatcgagttcctggcggagaaggaatcccgagttccttccatcggaacctcacagggttctggcacggcgggacacaaggtcctacctatctatgaaaccagggtagtcccctcccccgggtatattaccaaagaagcaaatcccaaagttcacagggtcgacgaatccaagagggcccccaaggtctcctggaacagcacaggaaccggtgttcctcttcacgaaacctgcttgcttccaggcaccaccgttgtgcgaggactgggggaacagggaccaatactcaggtctggcgaagcacgtcctggaagaggaggctggctatgaaaagggccggttggtagccactgagtatgcgggcagccatacggtggccggtcacggcgatgcagcgatccgtactgcgatgatcgtgggaaccagcttgctggaaaaatgtgcccttttaaccgcaggctcaaccag

SEQ ID NO: 720450 - DNA, 360 bp, Homo sapiens
gggccaagggggggggcccccccaagggcccccttttccaaaaaagggaaattttgcctaaaacctttgaaaccaggttttcccccctttaaaggttttccataaagggaaccccgagccaggatgggggggcgccttaaaaatttttttggttaagccccctttttttatttgggccccctttaagccctaaccggggaaccaaagccctaaggggttttttcccaaaaaaaccaaaaaaagggccggccccggttaaattttttagcccaaaaaccaggttttggtgggctttaagggccctaaattaaggccaaaatttaaaaaaattttttccccctggggtgggtttttttttta

SEQ ID NO: 720451 - DNA, 294 bp, Homo sapiens
accacccagtgcatcaagactgtgaggcagaacctggagccgttgtactgagcagtacatcaacaacctcagtgaggcagctggacagcatcgtgggggaacggggcctgcctggactcagagctgagaaacatgcaggacccggtggaagacctcacgaacaagtatgaggatgaaatcaacaagcctaaccactagctgagaatagagttatgtagatagctgaagaaggatgtagatagctagcctacatgaacaaggtggagctaggaggccacggttgatagccctggg

SEQ ID NO: 720452 - DNA, 171 bp, Homo sapiens
tggaacttctgtccacgatgacttatttcgccctctgtctttttaaactttttcacaataggtctctaaggaacaccagcagaacattagcctgtgcagaaccatctgtctggggcgcacactcttcattatgcttggcacatagatctccctgtggtagagatctttttc

SEQ ID NO: 720453 - DNA, 697 bp, Homo sapiens
  misc_feature (184)..(184): n is a, c, g, or t
tgctccttccctactggtcacccctttctaggaggcgccaattaggtcaatttttgtggaccttccgttgtttgcgacgtcatgggttcccattggctcccccctgcccagctctctcccctgtttccctaagagctccgcatctgtcccggtgtccttacatgtccttgagtaggtgggtacncctgatgggggtccctctgtctggagcataaccccccggcgttttttctgcccccccatccctgcatgcctgatcccccaggtcctataccctacccctgaccttttggagccgcctctgaagagccctagggccccccccctgtactcaccccctggagaattttgggagctagtctgccctgcccggagtcactggacatgttcatcctagatcctgtcaccctaccgtcatttcttttcctctctctggcccttgggtcctgggagatgctgctgtgttcaacccccgagcctaagcatggcacccctttcttcaccatgttgagagatgattcttttttggccctggccctctcgggaagcttgatggccatcctcggaagggtttaatctccttttgtgagtttggtggggaagggaagggtatatagattgtattaaaaaaaaaaaaggtatatatgcatatatctatatataatatgacgcagaaataaatctcatgagaaatcta

SEQ ID NO: 720454 - DNA, 121 bp, Homo sapiens
tcgagctcggtaccggagtgtcgtcgattagtgttcttgatgtgggtggctaaggatacagatgatgcggataacctggtccaggcttccgcacacggtccgggatgtagctggggtcaca

SEQ ID NO: 720455 - DNA, 182 bp, Homo sapiens
aacaggcagatacacaaatatatatgggaatatcattcatattaataccaagattatattctcaaatagtataggcgggtttcttatacatgctatattatattatgattttatttatagacggtaggagtcttactatgttgctctggctggtctcacactcctggcctccagcgatgttc

SEQ ID NO: 720456 - DNA, 239 bp, Homo sapiens
ggggggacccccttccccccccccccagcccagttcaaggaagccgccggggtaaagccatgtctccggggtccccgaagccgggcccgcctttaaaaagaggggctgccccgccggggccgctgcctttttttaagaagggtttcctgatttttcttcccgggcgggccctttaataagaaattggttttttcttccgccaggggggccgccccttaaggggttttagaaatttgcca

SEQ ID NO: 720457 - DNA, 233 bp, Homo sapiens
atcctaaccagccctcaaagtcgtaagttaagcatcaagcttcctaagtggtcaggataaaattcaaatgattttggctgaatacacaagtctctttatgaaagaggtgtggtcgggccgggcgcagtggctcacgcctgtaaccccagcacttggggaggccgaggcaggcagatcacgagctcaggagatcgagaccatcctggctaacacggtgaaaccccgtctctact

SEQ ID NO: 720458 - DNA, 354 bp, Homo sapiens
aagcgccatttgcaagaaaaaacaacaatctgggcactgaggtcttgtcatctgaggccaagtaaataattattagcgctacgctaattgtatgtatttttaagggccttcatagcactggaaaaaaattaagtgtggagcacgtcaaaaccctatacattcataacataaaaaatagtcctttatcggttggcagtcaaaagttaccttccaaaacctataatgcatgtcataggcggaaacccaactcgaagtcctaggtgctggcaggaaggaaccttccccgtgccagcaatgtgaggcataaagaaaacaccttgatgtcagaggtctagatatacatgtttaaagcca

SEQ ID NO: 720459 - DNA, 493 bp, Homo sapiens
ggtccccaatcctactggtcccctaccctgggccccattttgtttccttttcctacacgcatggtgagtcagattcatcatgaatgtaaagatgcttaacttcaggggccctcctttgtatggagcccttccagggtccagagaaagtctgatcatagtgttaacagggcaggtgttttgaaaattttgcctaaaaaaggtattttaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcccgccactgcactccagcctgggcgacagagcaagactccgtctcaaaca

SEQ ID NO: 720460 - DNA, 1067 bp, Homo sapiens
  misc_feature (835)..(835): n is a, c, g, or t
  misc_feature (839)..(839): n is a, c, g, or t
  misc_feature (848)..(848): n is a, c, g, or t
  misc_feature (851)..(851): n is a, c, g, or t
  misc_feature (866)..(866): n is a, c, g, or t
  misc_feature (959)..(959): n is a, c, g, or t
tttctgtaacactttttcttttttcttttgatctctgttttgtatttactcttctttttgatatctttcatgttgcctctttctttctccttttgttttcactacatcttttgtctcatcttctgtccgaagggtcatctttcgcttctttccagttttcggatctccatgccggtttcccgtggtgctctggattcctctgtcattcccgcattcttccatcgtatttggggggtttttccgacacatccaaccatagcgtcaatgtgaacctgggatattgacatttggttgcaccatgtgggacttggagcccgtccagattcgcttcttgtcggcacttcttcccggacactcaaggcctcatctttttggtcacactatatgacccggatcgggtccaagaatcttctgatgatctcccgaagatgcttcagtgaggacgatcttcgggatccagttcttctggtatttgcccactcagccggacatgctccctactgccatgcccctgatcgatctgttctgaccagctcggggctacagcacttatcgcactcgcacctggtatttccaggccccctgtgccaacccacaggcacaggtctttacgatggtctggactggctttcccacgagctgtccaagcgctaacccaccaggggcaggcccctgatgccccggaagctcctgcgtgcataccccgggatgacccagactccccggacatcctcaggccagtgccctttcccgcccaccttttcctcccccactagccccacggcctctgctcctgctcctgcctgcatgttctctctgttgttggagcctggangccntgctctctnggncacagaggggtccanctctcctgcctgctgggacctatggaaggggcttcctggcccaggccccctcttccacgaggaggaccacgggatctgggtttcctttttttnttctgttttgggtgtactctaggggcccggttgggagggggaaggtgagggcttcgggtggtgctataatgtggcactggatcttgagtaataaatttgctgtggttt

SEQ ID NO: 720461 - DNA, 219 bp, Homo sapiens
atgcacctgatgcctgtggtcgaatctagagttatccccattcaatctgcggtagccatccagcagagccgcattcagtcagctctgcaggctcatcttacacagaataatccctttgccagctacactctccatacatggggtttcttctggcagctcttcctcgggaggaacaccagtccagagttctgtttctgggagcctggtccctggcataca

SEQ ID NO: 720462 - DNA, 1442 bp, Homo sapiens
  misc_feature (835)..(835): n is a, c, g, or t
  misc_feature (839)..(839): n is a, c, g, or t
  misc_feature (848)..(848): n is a, c, g, or t
  misc_feature (851)..(851): n is a, c, g, or t
  misc_feature (866)..(866): n is a, c, g, or t
  misc_feature (959)..(959): n is a, c, g, or t
  misc_feature (1068)..(1068): n is a, c, g, or t
tttctgtaacactttttcttttttcttttgatctctgttttgtatttactcttctttttgatatctttcatgttgcctctttctttctccttttgttttcactacatcttttgtctcatcttctgtccgaagggtcatctttcgcttctttccagttttcggatctccatgccggtttcccgtggtgctctggattcctctgtcattcccgcattcttccatcgtatttggggggtttttccgacacatccaaccatagcgtcaatgtgaacctgggatattgacatttggttgcaccatgtgggacttggagcccgtccagattcgcttcttgtcggcacttcttcccggacactcaaggcctcatctttttggtcacactatatgacccggatcgggtccaagaatcttctgatgatctcccgaagatgcttcagtgaggacgatcttcgggatccagttcttctggtatttgcccactcagccggacatgctccctactgccatgcccctgatcgatctgttctgaccagctcggggctacagcacttatcgcactcgcacctggtatttccaggccccctgtgccaacccacaggcacaggtctttacgatggtctggactggctttcccacgagctgtccaagcgctaacccaccaggggcaggcccctgatgccccggaagctcctgcgtgcataccccgggatgacccagactccccggacatcctcaggccagtgccctttcccgcccaccttttcctcccccactagccccacggcctctgctcctgctcctgcctgcatgttctctctgttgttggagcctggangccntgctctctnggncacagaggggtccanctctcctgcctgctgggacctatggaaggggcttcctggcccaggccccctcttccacgaggaggaccacgggatctgggtttcctttttttnttctgttttgggtgtactctaggggcccggttgggagggggaaggtgagggcttcgggtggtgctataatgtggcactggatcttgagtaataaatttgctgtggtttncaaaaaaaaaaaaaaaaaaaaaaaaaaaaaattgtgtgtgcggcgcggcttggggccttgggagaaagagttttttaagaaccatatggtgttggggcggcggggggcgccacagtgtggtgttaatgtggaaatgtgtgggatatagggtggtgccaaaaacagaaaaccgcggggcgaaagacaacaagagggggaaaaggtttacacacaaaaaaataaaaaacaccgccgggggggagaaaagcagaacgtgtttaaaacaaaccccaaggggggaccacaagaaggcgaaataaggggcgaccatatcaaaaggggaggccaaggggaggcccggattccaaattaacccccggccggggggggagaac

SEQ ID NO: 720463 - DNA, 225 bp, Homo sapiens
cccgtctctcagcagctcgtggcaacacatacactgttgctacgatatattaatgccacctgcaataaattgcagagatccacccaggacctgcaccacctgcaatttcactgcccactgctcctccttcaatgataagggcacaggctgtgcctgccagtgcccctactgctgtcagtagttgcagacgcatcgcctgctttttgctgcagccagactggacca

SEQ ID NO: 720464 - DNA, 381 bp, Homo sapiens
ggctcctataaaaaaggtagaagataaaaaattttggagaggatgtggagaaaacagaatcctgtgcattgccggtataatcgtgaaaaagtaaaactgtgatggcaaacagtatggagcttcctcaaaaaaattaaaactggaactaccatataatctagccatcccatttctggatatatattcaaaagaattgaaaacaagattttgaaaagatacggttacacttgtgttcatttcggtgtgattcacaacaaccaagaggtagaggcagtgtaatatccacggacagatgaatggataaagaaaatggggtatatatataaaatggaatattattcagccttaaagaggaaaattgtgccaaatgctacaacatag

SEQ ID NO: 720465 - DNA, 427 bp, Homo sapiens
  misc_feature (13)..(13): n is a, c, g, or t
gcttgattgtacntgctatttttgtagttttaacagaaatggggtttcaccatgttagccaggctggtctcgaactcctgaccttgtgatctgcttgtctctgcctcccaaagtgttgggattacaggtgtgagccaccacgcccagccgaggttttcttttcacacaattctttgtttattatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttgggggctttgttgttgctttagatttgtgggtctttaaaaataattttaacttattttagattcacagggtacatgt

SEQ ID NO: 720466 - DNA, 144 bp, Homo sapiens
gagattgcgccccaacatggtcttgattccaaacttgttgttcataaaagctttcaagggcacaggctgtgcctgccagtgcccctactgctgtcagtagttgcagacgcatcgcctgctttttgctgcagccagactggacca

SEQ ID NO: 720467 - DNA, 98 bp, Homo sapiens
aggtttgtgtggacactgtcttcagttctcttggatctatactgaggactggaattgcgggatctgccagatcgacaataccgtcagattacgacgtg

SEQ ID NO: 720468 - DNA, 361 bp, Homo sapiens
aacccagtgggcctcaaagaactcaaatgaaaggaagacttgcaagtctctcactttaagtccagagctagaaatgattaagcttagtgaagatgcagaattttcatagctagagagaagtcaacgcttggcttcaaaacttcaaaggatgggctgactctctttgaggagcactgcagctggtgactttaagttacagccagtgctcattgaccactctgaaaatctcagggcccttaagaattatgcaaaatctattctttctgtgctctagaaatggaacatcactgtctgggtgacagcacatctgttaatagcatggtttactgaatattttaatcccactattgagaactgctca

SEQ ID NO: 720469 - DNA, 280 bp, Homo sapiens
atctcgctcatcctgatgacacttgagagtagcattacctccttgtgctgggagaatggagcgctttctacttgggctcaacattgagacaggtctgttgagcgaccgtaagaaggtgactttgggcacccagcccacgtatgaggaactttcgtctcttcacacagtctttgcttgtcctgacgccatgtcatctaaagcagcacaaaatgtctctcaatgtcaacctcaaggaagtgaactacatgtgtcccctcatcaatggtatcctgaagctggg

SEQ ID NO: 720470 - DNA, 186 bp, Homo sapiens
tcttatcgtgttgcacggatcaagaatgaatgagcccttacatgtcctgtccttctctatgtatagactacctaattagcaccattggactccccaagggaacctggaaatagaatattcctttctaatgctctgaaagaaaaaaggtttctcagaatttctgagatgttaacactgagaaatgtc

SEQ ID NO: 720471 - DNA, 673 bp, Homo sapiens
agcggagtggaccgggaccggtaggggtgctggtgccatcatggctgaccccgacccccggtaccctcgctcctcgatgcgaggacgacttcaactatgggcagcagcgatggcctccgccaccgtgcacatccgaatggcgctattctgagaagagtctacagcgagttctttctctgcaggttctcttaactacagtgacttcaacagtttttttatactttgagtctgtacggacatttgtacatgagagtccggccttaattttgctgttgccctcggatctctgggttggattcttggcgttgactttaaacagacataagtatccccttaacctgtacctactttgtggatttacgctgtaggaagctctgactgtggcagttgtggttgagtttctatgatggtatattttaattctggaaagttttcttatggattattagagtatgtgtgggtgagagtgtgtatactctacaatctaagaaggatttcagcaaatttggagcagggctgttgtgatcttatgtggatattgtgccgtgtcaggattcttgaagttgttttttattgatagtgagataactggaggtgggacttagcggttgcaggagcccttcatttacgggggattcagtcatctatgagacagaatcactgatgcttaaaa

SEQ ID NO: 720472 - DNA, 206 bp, Homo sapiens
gcatggagttctggcagttctgtgggcagctggctcagcatgtgtccagccatcgtccaggcgggggctggtgcccacggtgccggaaactgctgggagctgagcacgtggctagggatgggcaacccgagttcatgctagtagcaggacattgcactccacgaattgaatacatagactgaagtaacggacattccaaacgcctc

SEQ ID NO: 720473 - DNA, 386 bp, Homo sapiens
gtctacttgctcttgctctaccttgctctcgctctaccttgtctctctgctctaccttgtctctcggctctaccttgtctctcggtctaccttgtctctctgctctaccttgtctccagtcttgatcagctgcacatcaccactaaaatctccagtggcaccattgaaatcctgagtgattgttgcagctgatcaaacacttgtgacaaagtgtggagccaacgaagccaacgctgttgaacattctcaaaatttccccctttctcctttgtgctggtcatccagcaggtattcgacaatggcagcatctacaaccctgaagtgcttgatatcacagaggaaactctgcattctcgcttccgtagagggtgtccggcaatgtttgc

SEQ ID NO: 720474 - DNA, 308 bp, Homo sapiens
ttctcctcctccttcgagccgtatcatgactatcttgttgatctccctgaaaaaaaactcgaatatgttcctcttctttccatttagaaaactacccccacctggctcaaatcaccatcttctctgcctccccgcttccagcctggcccccgacactcccttctccagacagcagccagagagctcttcaagactgagtcaggctgggcgtggtggctcacacctgtaatcccagcccttggggaggccaaggcaggtggatcacctgaggtcaggggttcaagaccagcctgcccaacatggtgaaa

SEQ ID NO: 720475 - DNA, 336 bp, Homo sapiens
  misc_feature (1)..(1): n is a, c, g, or t
ngtattcttatccttcccgtggaaaaggttgcttacacataggcttctcaatcaaagcttctggcttgtctggttccaggctcaagagtagggatcccacactgttcatcacactttcaactatcttaatcatcttccttcagacacacttcacaggcttcaataatttgagttaactcaccatagagtccaccttccaagttctcttctgaatatctcagctcctttagatttcagataagcacgaagctcacacagcgtgatcttcctcactgatgtctataaagcccggcgcgctcatggcacaggcgcgggcacagcgcacactacactcgc

SEQ ID NO: 720476 - DNA, 168 bp, Homo sapiens
acggactactcagctgtttcctcgacctcagaacctgaagattattttataaagagaaaggtaaattcatctggcaggatttttttatgttttttttgtggggattaaaaattgactttaatcccttaaatccccaataaaaatttttgaggcctgagcaatcccact

SEQ ID NO: 720477 - DNA, 1769 bp, Homo sapiens
  misc_feature (1196)..(1196): n is a, c, g, or t
  misc_feature (1484)..(1484): n is a, c, g, or t
tcagggggaaaataatcttttattggaaaccccaccaacggcaaaatctggtcccgggctataaagctctcttcttctcttggcaattgggttcttttcttccagtgggtcccatggaatggcttttctttctcctcccatgggttctgggaagcgggccagggccaaatctgggagggtgggtggtcaatgagaatcttaagggtacaattctttctcacagagcccgccggcttccggtctctggacgaccacaagacaaggagatctttggcgggagggtgtggacgcaccccgcgtcttttctgggtgttccccacaacacaacacacaaagctcttatacaggactctgagaacaaaagtgtccatgtggtgtcacatctatacacaccaatatgtggagacacaaacagagccacacccacagagagaggggcgtgcgagagtgcgctctgtgtgtgtcagagacaatgagggcgtcacactaagtctcagagggtgggagagcgacaatagtggggtactctgtgagagactcacagactgtgtggcccggacatcctgtggggatatacagagggggtgactccccgctggggggcccaaaaacctctcttttactaacaaactctctctctgtgaggggtgagagaactcctcttcagaaggagtaggcgagagggtggaaagtggtgtgttgaaggccccttctttctcttgtggcgacccagagagagtggtggggtggccccacaacagagagaagaaaagaagggcgtctcaccaaagaggaaagtccgcaagggagtagtggccccagaggtggcgccgcccaaaaattaaacagagggcgcaaaccctgtgtggaaaaagataatgtgccctgacaacagaggggcaaacgagacaagaggtgcccccagggggggtggccacaaccacgcaagaaggggggtgggccctccagcgggaggcacctcccagaaagagttacggcctcctggtttggaaaacaaacaacaagcaggaggggaggaggggccattaaacaccaaaaaagagggtggggggtggaaaaaaattccccttctcgggggtgctcggtggaaggaaacaacaggggggcgtcctcaaagaaacacttctgggcgggacctacttgtgggcaccacagaggcaaccactccacagganccccaaaaaagaagagaaaaacctctcacacacccggggtttctgggtgtggccaacagcgggggccccccccgcgataaatatcaaaccacaggggttgtgacgcagggcgcgacacacaaaagaaaagacccaacatcccatccgtataaaaaaagaagcgagggggagaaagaaaggggtggcaccaccctggtggagacataaaaacccacgggtcgtccacccccacaggaggacccctgtgggaaagccggagcccaaatagcgagaggaaccacccacaancggagtctaacaaaaagcgatggggtcacccacaaagagttacacacggacccccgtagcagcactagaccacgacgaaccaacacacaaccgacacacacttgcgtgtcgatcaccccgatgcgacgagcaaaacaaaacagggagcgtgggtcaacatgagtggggaggcacccacagagagaagagagcaatcccaggtgaatctacagagaagaggaagacaataacgcgcgcaacccactcgtggtgtgaaccaacacgacacgcacggcgagacaatac

SEQ ID NO: 720478 - DNA, 174 bp, Homo sapiens
  misc_feature (4)..(4): n is a, c, g, or t
ctancaggcagagagactgtgcacgactgttgtgagaaaggaaacagaccacgaaatcctgagacctgccactgaactgtggaggtgtgggactaggccactgaccaacgtgccacctacaaaaagcagcagttggctccagtggcttggaaacacacaggtcttggagcttgg

SEQ ID NO: 720479 - DNA, 103 bp, Homo sapiens
  misc_feature (87)..(87): n is a, c, g, or t
gatcctggagctggcgggcaacggggctcggaacaacaagaagacgcgcatcatccctcgtaacctccagctggccatccgcaacgncggaggaactgaacaa

SEQ ID NO: 720480 - DNA, 959 bp, Homo sapiens
tcccgccgccatgtctctggcccgctcggtttttctcctgggggcaaaacccgtctattttttttttgatgctgtccggtggcccgggcgtccccttcccgattactgggccctccccctctcgcgtgggagtcttccccggcgagggccccaattgcagacttcaccccaattgggctgtgatttccaacgtgggtgttcccgcatatatttctgcggccatttcacacttcctattggtgagactttagtgagcacgttccggaagcgggtggtacccacaacacgcgttcccaccgaggtggtgtccctgcgcaaatctctcgtcttggggaggaccctttctttctttctggtcgtcccccaagtgtcttcctaactattggcctcccagcgataattgattaccccagtttcttccgatgagatgttttttctaattgccccgcccccatgcacggatagacaggtgaaatacttctttgaggcgcccaccgcccagttaggtgtttgttgttatacaacgagatagctcctgtgcccaaatacacgcacatcatcggggtttgcccttctgcgctctggtgcccaagtgggcgcggcggcgcccaccccgcgtttctgtctgcgggcagaccccccttcccctccccgggcgttgctagaataccagggcgtatcacgggtcgcttcgagtatactagcaaagccccggtatgttacgtagattggcttgttatacactcgtatgccccccatccccttgttggaataaccaacggaactttgtcatatagtaggacgtaaccactagtatgaatttgggggggctatacaaggtacaccatgcttgtcatgatagagattatccgttgtggggaattctcttttgcaaaaaaatttcgaaggcaaagccctcttttgccacaaaaattttttttttttctgcccacaaaaca

SEQ ID NO: 720481 - DNA, 117 bp, Homo sapiens
ctaggtgaccctcggtgctgcagggatctgcaggactgcagccatgggggcgcacctggtccggcgctacctgggcgatgcttcggtggagcccgaccccctgcagatgccaacctt

SEQ ID NO: 720482 - DNA, 1031 bp, Homo sapiens
agcgggggcggcggtgagcacggtgcgcggcctagtacaatgaggcagccagcggatcttggagcctgagcccttgtgaagccggctaatgacaagtctgtatggtcgcatgccgagaaaagccacgtgacatgccgagaaactatcagcccctaaagtgcacgtgcatgagtgtccgttgtccctgatgataccaatcgccattcattgtctcggcgaatccgggccgaggaggaggaggaacgaggcaggaggcagttccaggggagtaccttgcgggaggggcttggcattgaccaagagcattggtacaccacgcggctggaaagccaacggacagaacctcctatcattgaagcccccaagtttggacccatgcaccccctgacggcacctgcctatgcacatcgcacaatggtccctggccacgactggacactgtcacgtagtacacaggcccccgtggcgcaagttttggacacgaaactccaaacgaaacaacttggtacaaacgctggtatggaagttcgccatactttccaaggcagcaacacacgtatcgacacgtaacaagtggccactatgggctggtgtcagcccaaggggtccagtacgtaccgctcagaagggccctttacggcatacgcctcttcacaaggagggtggatagatgcccacatttgtcaattgagacccaggcaacacaccacagaggtactaccgcgtccgcccaatgtgataccattccattcccgttatgctaaacagggatcataccgccaatgtgccagtagcatcctagtgtgcagaggatggcgcattcacaacaccatacacaaggcaccatgatgcgcaaggatagggcgaagcagacgccctgtgtaccaatggcaagaccccttgtgtggtgacaacggtgcccctgtgttccgaacgccgacagaggtgagaaaacaccgaagagaggaacatcccacacgaagaccacacgggcaaagggtgcacacacggcacaccatgtgacgcgcaca

SEQ ID NO: 720483 - DNA, 511 bp, Homo sapiens
  misc_feature (445)..(445): n is a, c, g, or t
ccaggaagggaaattaatttgttgagtacttaccagcactccaatagtgggcattttaatatatgtctgtcaaataagtggaagttgataatagatttgtggagagtttggtagtattggagcatagtgtttaaagcagagggtggcagaagattcgaagagtaaatggcagatgctgtgagagcctaacacgttaagactttgttctggaggctttgtagattcagtaaaaggctttcatcaggtagtgatgcagtcacatttgtgttagcaatgatagtagcaggtggtcattgcctactatacagccttgtactgattgctgtacatgcatgatctcatttaatcttgacaacaattgttactaatttccattttacagttgaggaaatggaggttgagatagattgcacaggtcatagtggagctgtgattctcatctagngagtctgaccagagcacgcacaggacacctgtacagttgggatgagagggaagaattgaaggatgt

SEQ ID NO: 720484 - DNA, 558 bp, Homo sapiens
taagctaggtacgaggctgggttgtactctactaaaaatacaaaaattggccgttgtgttggtgcacgcctgtaatcacagctaacttgggaggctgagacacgagaatcacttgaacccaggaggcggaggttgccgtgagcagagatcataccactacactccagcctgggcgacagagtgagactgtctcaaaaaaaaaaacaaaaaaaaaacaggggattgggactctctagaagtggtccatgtgtaaatgtccgcaccaaccttatgggctggtcctaggaagcatttggcagctaggattgctggctcgccttgagagccacatcctggtgacctggagccggatgccggcctccacctcccagctggctccgggagtcacagtgggcccacccgttatacatttggactgggcagttctcccgagcccgccccaacagccatgacccacaggggtagattttttttttaccacgggagttctattaaggcaccttttaacttgaaggtttttaaaagaggaacaggggtctatctatgtggcccagggcg

SEQ ID NO: 720485 - DNA, 105 bp, Homo sapiens
cacacgagacccctagcaactctgcacagctgacacacactgcacgagtgagcccagccacgtgtttctgctcagcatgtggggacctgaagccagccacctccg

SEQ ID NO: 720486 - DNA, 413 bp, Homo sapiens
cttctctgtggggtgacggtggggatagctggagccggagagaacggggcagagccaagtatgtccgcagggagtgggtacaataggacctggtgatacgggcagttacttggaggtcaaaggagaagatgtccaatataccgctcaggtttctgactggggaaaccgggtggggcccgttactgagattggaaaacccacagagagaggcgtcatgggcttggaagcctaccccagaggtgtggcaggtgctgaagacccagcccggagaaccccgcttccagtgcagtctctgggatctctattcccacagagagagcgtcgacgctctctctgtggggggtgtgggctctggggactggccggtgagtacgaaaagggagagggaggacaatatccaggctcctggattg

SEQ ID NO: 720487 - DNA, 248 bp, Homo sapiens
ctgcatttattgtagaccttgcgtgtcctcaaatctttctgatccatcttattctcaatggccatgatgtcacttattcgtggggtaatctatcacttccccttaactctcattaaccgacattctctattttgcaaagaagatgtgatcttcaggcaaagagttctctcactccgtacacagtccttcaaatcttgtttgtgtccacaccaatcctcttctccattcctctcctctgaaaaaaaaaa

SEQ ID NO: 720488 - DNA, 258 bp, Homo sapiens
gctctggcggagaataactggcaaacatacaacatacagggggcagatgaagaagggactgagtacacacatggacagcaggcttcagaaggacgccagcagaatgaatgtggagtggatagtactcactctgcatatgctccagaggacagggtaagaccccaggctgcaagtcatgcagaagcaagataaggccacacacaagctccgcacagggagaaacttcttagcaactcagcgggctgggtaacttcatta

SEQ ID NO: 720489 - DNA, 122 bp, Homo sapiens
aagctcgagagcagcagctgtaatcaggtacgatctgatcaagaagatgaccaggcgggcatcctgatccagagcaagttccgaagctactatgaacagcaagcgatttcatgcagagccgc

SEQ ID NO: 720490 - DNA, 424 bp, Homo sapiens
aaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcaatgccacctgcgcagtggtgtgttgcatccagggaacaatgtccacatgatcagtgtcaggcacagagtgggcatggggcatcctcaccattctgtctccagtcccatccgtgggacaaaatgccccctgggaaagttgaacagagattgcttcaaatggggccaaatatggcattagtgaggaactaaactgctttgacagctcctgtgtctcctgggatgggaagttggggagggagtcatgggagtt

SEQ ID NO: 720491 - DNA, 166 bp, Homo sapiens
tatgtgaagatgactcggacattatacatgctctgaagatggatgtggtagatatctatcatctaccggttacaaggagagacaaagacgaacaaacattataagagaccatggattaatcaaccttagacagttacaattaatggaacggcggaatcccaaggag

SEQ ID NO: 720492 - DNA, 244 bp, Homo sapiens
ggctccgggacggctggagtggtaaaaggctcagaacaactatcctgcgacgaatcaaatacttctgaggtaataaataggcatgatcccgcatcagccaacagccctctgccgacagaagctgaatgaagagcagtcacactgcacaatgctacactattcacctgcacctccactaaccgcacgatcaataacatctcgctattcactaaaccaccccccaacacctcaccacactctcacc

SEQ ID NO: 720493 - DNA, 319 bp, Homo sapiens
gagatctctggatccatgaccatccttttcctttgttcttcttttttctttttaacttccggcaagttatcatagattctcttagatcgcatatgaatctcctgctcgtgaaactgatccggaacttccgcgatctatcgattgagaccatcgcgattacggaatactactctgtgatcaccctaagccactgccgtatcggccgtaaggacttctgtacgtacgcactcgtacgtgtgactacttcctcggacgaagggtcccagtcactatgaatatcttgcttaagagtacagcatactcggcacagtattcacag

SEQ ID NO: 720494 - DNA, 310 bp, Homo sapiens
attcagaggtcagcctgaggtgagtttgggactcgaggattgtccgggtgtaaaagagaaggcccattcaggatcccacagcggaggtggtctagaggccaaggcaaggcccttttcaacacgctggaaggcacacgcaagtgcaaaggcaggcaaaggggctagggtgggtccatctctcgggacaggaccttgcaccgagtttacctgcccaggagcagagtagagctgcacccaccagagtggatctaggccggggcaggccagtggaaatccaaggaaagccccagtagacacagctccactacac

SEQ ID NO: 720495 - DNA, 1313 bp, Homo sapiens
  misc_feature (784)..(784): n is a, c, g, or t
  misc_feature (1313)..(1313): n is a, c, g, or t
tgggaaatggatttggtggcccaggcgggattgagtggcacagtctcggcttcacgtgcaaccctccacttctcccggggttcaagcagtttctgcggtgccgcagccctcccaagttagcgtgggactacgggcattgcgccaccacgccaaggctaattttggtattttatagatagagagtggggtttcaccagtttctcaaacctccgtgaaccctcggggcgattccacccaccttcgaggcgtctcccaagaggtgcgtgggaatatattagggcgtgtaagcccacgcgcaccgtggcctagtaagtgtggctctttatataattatagggaaacaatttctagtgtggaaagaaggagaagttgtgaacgtgaaaagttgtgcgccccaacagggatgttggtgaccgctgtggggcagggtcgcctttcagtgtgaacgggcttgtgccacctatgtgggagacgcgcccaggttttaccgggggggagtgatctatgcgcgagacggtgcaaaaagggctatatacagtggacaggatgtgcccgtggggtatttggcgccaagacctctgagctctacacctcatacacccggcgcggggcaaaaacccctcttaatgtaccccctttactgtgtgttctaccccattgatgcggctatacaccagggggtgtaagcgcatgagaatgtgacactgagagagacactatttaaagacctctggggagcaacaagacacaacgcatgggggaggtccccacctagtgggggaanatataagcgagagcagggagcaggcaaatacataatttgccgtgaggaaaccattactgacggggatatagtccccaagaagagtatagtaaaataggaacacccccccacatatattatatttacccgcccaccgtgtggtgacgagcacaattatttgcagaccggatggtctacaattaagagaggcaataggttatacacctttaaggaaattcagcccctaatgaggatgtggacacgttagaagaagagaaggctcggtacgttcttcacaccgaggaaggaagctgggcagggtcaagaggtagacgccccctgatgggacacacaggtgtggccccccatttggacatattagggcggcactgcgggtgttatcagagagtatatggtacctgaggatgcaaaatatcaaccgttttgggtatcaaaggaaaacaaaaaaatattttttttagcccgcgagtattgggaggagtcaccagcgggaaaaagtatattcttttgagaaggagagtccccccan

SEQ ID NO: 720496 - DNA, 120 bp, Homo sapiens
ggtttagtagaagagaatgtacacggatgtcatgcaggcttaatacgaccctctgtgctgctgagtcgtgactagacatgaaccctggcagggacagccaagcgaggggcgaggtgacag

SEQ ID NO: 720497 - DNA, 244 bp, Homo sapiens
cccccccccctggggggggggttattttttctttccttttttggttttttagggaggcccggctttggttttaaagggcggggtttcccccagggtttttttggccccctttagggggggccccccccttttgggggggcccttttttttggggggcccccccttttaagaagttgggttaagttgggcccctttttcctttccccgggtttgggtccccccattaaatttgtggggcccttta

SEQ ID NO: 720498 - DNA, 189 bp, Homo sapiens
ctgcccgtccattacaccacccagacgtatagtgatcacattctgtgcacttgacttagccacatgaggcggctcacgcctgtaatcccagcactgtgggaggctgaggcagacaagatcacctgaggtcaggagttcgagaccagcctgaccaatatggtgaaacactgtctcttatttgaaaaaaaa

SEQ ID NO: 720499 - DNA, 547 bp, Homo sapiens
  misc_feature (78)..(78): n is a, c, g, or t
ctactttccacaggccacaggtgaaagacatacccacagaatgggagaaaatatttacaaactatctatttgaccagngcttaataacaagaagatataagagatcaaacgactataggaaagaagctaataatccaatcaaaacacgggcaaaagatttggacagacatttctcaaaagaagaaacacaaatggcaatcaggcatatgaaaaggtgctcaacaccactgaccaatagagaaatgcaaattaaaactacattgagatatcatcacaccccagtaaaaataccttatatgcagaagagaggcaataaaaaatgctggcaagtatgcagagaaaagggaacttttgtaccccacagggtgaagagacatgcccacagaatgggagaaaatatttacaaactatctatttgaccagggcttaataacaagaagatataaagagatcaaacgactataggaaaaaagctaataatccaatcaaagcacgggcaaaagatttggacagacatttctcaaaagaagaaacacaaatggcaatc

SEQ ID NO: 720500 - DNA, 271 bp, Homo sapiens
ttgggcccccgggggggggggggccttttttttgggaagggcttggttgggaagggcccgtttttggtttggggccaattggggggtccagggttcccaaagggtttcggggggcctgggccccccccggggttgtgggcccggttcctgcccttttttttggggtttctggggggggcttggggtgggggtggttttggcccccccccccccttttgtgggtttttttggggggtttttaacctttcccccccccccccccccaaaccca

SEQ ID NO: 720501 - DNA, 932 bp, Homo sapiens
ataagctgactgatgggacatggaaaacatcatagctggatcagagatgcgagaggatgttgattctgaagtcactatcgcatagggccaagattgaaggattcgatgtactgaagaaagtgaagactctctgcctccgctcaaaatttaattaagtgcagtagataatctggaggagctaccgagtcttcgacagctgaatctttacgacaaccagatcaagaagattgagaatctggaggctgctaacagagctggagattctagatatttcttttaatctgctgagaaactatcgataggggttgacgaagttgagcatcgactgtagataaaagcgtctatcttaggctggcaacagatagcacattcagtacacatattgaggaacttacagcgaacttacatcaactacagatgctagagctgggatctaaccgtatccgcgcaatcgaatagatatcgacaccttaaccaacctggagagtttgtttttggggaaaaacaaaattactaaacttcagaacctggatgcgctcaccaaactgacagtcctcagtatgcagagcaaccggtgaccaagatcgagggtctgcagaacctggtgaacctgcgggagctgtatcttagccacaatggcatcgaggtcatcgagggctggagaaccatgtgcacgacaggctcacgtaactgagggaagtgtgctcacagagcccaaccttcctagtggctccaagtcaacctggtctgcccagtgcgtgtcccgaaccattaagattttcctccaacaaaaaaaggcgcgggctaaatatcccagggccagtacgacacctgaacaggccgcccagagggtaaaaggacggggaaccgggaagactgtttgaccctttcggtagcaccacaccgacaaaatgtacccgggttgtaaaaag

SEQ ID NO: 720502 - DNA, 119 bp, Homo sapiens
caggagccatccggggcagggacgctctggagagtctgtggaagaggtcccgctgtatgggaacctgcattatctacagacaggacggctgtctcaagacccagagccagaccagcagg

SEQ ID NO: 720503 - DNA, 270 bp, Homo sapiens
  misc_feature (133)..(133): n is a, c, g, or t
  misc_feature (166)..(166): n is a, c, g, or t
  misc_feature (211)..(211): n is a, c, g, or t
  misc_feature (248)..(248): n is a, c, g, or t
  misc_feature (254)..(254): n is a, c, g, or t
ctctgtccggccgccaccccctctgggaagtgcggagcgtctctgcctggccgcccattgtctgggatgtgaggagcccctctgcccggctgcccagtctgggaagtgaggagcgccttttcctggccgcatnccatttaggaagagaggagtgtctgtgcccggntgcccatcatctgagatgaggggagcaccttagccccgccgcccngtttgggatgtgaggagcgcctctgcccggccgtganccagantgggaggtgaggagcg

SEQ ID NO: 720504 - DNA, 195 bp, Homo sapiens
cctataatcgaagtttatcctagtgaggcgtacagaatgctattgttatacatttaagtatcataacataatgtagctataaagctttttaaaattatggtaaagtgtatgtcaaatttaccattagtgacattgagtaccttcaccatgttgtgcaatcatccccatataagtagttccagaacattttcatca

SEQ ID NO: 720505 - DNA, 122 bp, Homo sapiens
ccggtccttcaaccaacagccctgggctgtacgcctacgctaacattactgcaggccacctactcatgcaccgtattggaagcgccaccctagcaatatcaaccaactagccctgtccgtac

SEQ ID NO: 720506 - DNA, 1065 bp, Homo sapiens
gagtccgagtggagagagcgagctgagtggttgtgtgttctcgtcgtcggaaaccggtagcgcttgcagcatggctgaccaattgactgaccgagcagattgctgaattcagttgaagctttttcactatttgacaagagatggtgatggaactataatcaacacaatggaattagggaactgtatatgagatctcttgggcagaagtcccagcatgaagcatgacgttatcacggacatgacttaactgaagtatgatgctgtagtggtaagtggtagcaagttgacttccctgaattgtctggacaatgactggcagatgagaaagagtgacaagacagttagaccagtgaaggaagaagagttatgagaagcattcctgtgtgatttagatcatagggagtggcaagtggctactatttaggtgcatgcagaacttcgccacaatgttgatgtagcgaaacctttgtgagtaggaaggttaatcagactgaatgagaggttggatgaccattgattcgagggcacagcaggataatacgatggtggcatcgtgtccatgtaacactattgcagagaggtatgttaacaatttgattgacatgcagaagtgagagaccttgtaccatgaattgtgtcaaaaatgttctttgtagcaaaacattggttgtattgtgcctttgtctttagtctcgtaaacctatatcttggtaaagaaggttaactccctaacttgtcgacacaacagaattattgcattgtgatagtaacttaagggacttcaatttccttccatgtttttgctttccctttactctttacctgttccatttggtaccttaaaagacactgtaatatgttaaggaaacaactgtggatcccagggttaacacatggtttgcacatttgttgggatttaacttctctggaagtaataattactaaagccccttttctggaacagttctaaaacctttacacttggaagtttggatcaacactggaggggcaaacattctaggggtttatggccgcttggctaaacggtaagttaccttatagaaa

SEQ ID NO: 720507 - DNA, 708 bp, Homo sapiens
gaggttttttgtttctttgattttctgagtgggagaggatttgtgagaatcttttccagggaaatgggttccttcacgaggtaaggatgtgttccctgtatcgatctgcagaccaccccgaaggtgggtgccaccctgcatgcttgggggtgcccagggattcgagacctcccacagtactctgtctgaaggtggtgattctggccctggcccctctgcccagcctgtgtgcgatgcccctggtgctttagtgccagaagcctaggctcagaagcaccgccgcgccatctttccgtttcaggggttgtgatgaaggcccaggaaacaccgtttaatctgttactattttacctacgtataaagttttagttcaacttgggtgtgcgaaacaccccttttatcactctttaaatttgcacctttattttttttcttccaacagcttgttctctggacactttggggaatgtgagtgttagagctggtgagagaggagtcacggtggccctcccacccgatggtcctggcctccaccctgccctctcttccctgcctgatcacccgctttcccatttgcccttcagagaacttaagtcacaggagagttgaaattcacaggcccgggcacatcttttatttatttcattatgttggcccacagaacttgattgtaaataataataaagaaatctgttatatacttttcca

SEQ ID NO: 720508 - DNA, 1053 bp, Homo sapiens
ggagagaactagtcttgaggttttttttttttatttgtaaagttgagtcggctctttaatggacaccgcccatttgtctgcacctgaactgaggcggaaacaggaggggtctggaaaatggtgccattgggcctgggtgctcgcaaagtctgctccctggggacagaaacccatggggtcgagcccttgtaggcctctccgttccaggaggggccacaattagtcagccgccgtgccttccgtcagtgcccatgggagggcacccgatggcttggtgtgtgcgcccagtgggccaggcgcccttagcttgggccgcaggtgagcaattgagccgcctttggaggtccgaggtccggtgaaggtgggggaggcgggttccaatgtgcatgggaggccagggttcaccctcaaagtgttgtgcgtccatcccggggaatggttgtagagatgaaagttcatgacttccccaagtggtcccttctgtgagagggggaggacatgtgacaatgagaatctgagtttgaaggacacaaagtattgccgacaattcatcagtggaccgttggacgcggcagcctggaattctcctttgccccgtgtagacgaagagatcactcacaaaagggtggtcgtgctgcgctgatccaacatcccagggcgaaaaggactaattgctggtgtgagtcaacacgagcctttgtttagccccccaggataaggggagtcagaacgatcctcaagggggccacgggggatatgaaggggccggcaaccaatggaaagtcgctgaacacgtagggctgtacacacagtgtgcaggcacggctgtcaactgggtgataagccgcaaggcggcaaaaagttcgagaacagtgccttattccacaagatttggaaacgagcgctgtacgaaatgcctgacctctttcctggcccacacaacataaatattgcccaagtagaccacgaaatcacaaacaaacacattgaaataatatcaaacgcagtactctatcaccacaaagtggatctcgacgtacactctacgatccc

SEQ ID NO: 720509 - DNA, 351 bp, Homo sapiens
  misc_feature (149)..(149): n is a, c, g, or t
caattgtgatctttttttttcttttgagatggagtctcgttctgtcacccaggctggagtgcagtgggtcgatcttcgctcgctacagcctccacctcccaggttcaagtgattctcgtgtctcagcctcccgagtagctgggactacnagcgcccgccaccatgcctgattaatttttgtatttttagtagagacggggtttcaccatgttggccaggctggtctttaactcctgacctcaagtgatccgcccacctcaccctcccaaaatgttggattacagtgtgaaccactgtgcctgctttagcgttgtgtctaatagtctcatgtctattgtttttgtaatagat

SEQ ID NO: 720510 - DNA, 935 bp, Homo sapiens
  misc_feature (11)..(11): n is a, c, g, or t
  misc_feature (63)..(63): n is a, c, g, or t
  misc_feature (82)..(82): n is a, c, g, or t
  misc_feature (84)..(84): n is a, c, g, or t
  misc_feature (93)..(95): n is a, c, g, or t
  misc_feature (100)..(100): n is a, c, g, or t
  misc_feature (132)..(132): n is a, c, g, or t
  misc_feature (156)..(156): n is a, c, g, or t
  misc_feature (170)..(170): n is a, c, g, or t
  misc_feature (172)..(172): n is a, c, g, or t
  misc_feature (190)..(190): n is a, c, g, or t
  misc_feature (192)..(192): n is a, c, g, or t
  misc_feature (197)..(197): n is a, c, g, or t
  misc_feature (200)..(200): n is a, c, g, or t
  misc_feature (202)..(202): n is a, c, g, or t
  misc_feature (209)..(209): n is a, c, g, or t
  misc_feature (257)..(257): n is a, c, g, or t
  misc_feature (264)..(264): n is a, c, g, or t
  misc_feature (277)..(277): n is a, c, g, or t
  misc_feature (319)..(319): n is a, c, g, or t
  misc_feature (333)..(333): n is a, c, g, or t
  misc_feature (350)..(350): n is a, c, g, or t
  misc_feature (354)..(354): n is a, c, g, or t
  misc_feature (433)..(433): n is a, c, g, or t
  misc_feature (695)..(695): n is a, c, g, or t
  misc_feature (842)..(842): n is a, c, g, or t
  misc_feature (870)..(871): n is a, c, g, or t
  misc_feature (916)..(916): n is a, c, g, or t
ttatcccagtnacaggatttgagaatggaaaggacaatctttggatgacatagcttaggacanttgctcatttatttaaaanantcccttcannnttttncagataaaagaaggcaagatcataggattgtngcatgttctgggtagctgttagangttactcatgaaantnggtagcctagtaaattantngtaanttntntgaaggnaatcagcctccctttccatttcattcccttccccctcctttttttttnattttgnttgatttgttganccaccatccctatgaatacaccttacatctctttcaaatgtngagatggttttttnatcttacagtgtgtggnaccngagtcagtaatcaaagctccctgtcccaagccatagacagacaggacaacaatttgatttcctgtactcttggtctggnacccatggggttctgagaaaaaagctgaggtcttagagcactggctttaaaaaatattttcaccagttcagagtaaatgaaaacccgattccttagaaataatattgtgtctatttctacccccaccctccaagcatggtgttttttaaaaaattaatttttcccttacactttaaaaactctcacctatgtataaaagaaactgccacactacaataacactgctgttgttccaagtattcctctgagcccctcaccagcnctccctcaccatcctcaccctgaccacccttcccctctgcccagcacctaagagcagggatcacgccgcggggtgatgagcagtttcgcagtatcgcctggccttctgatactaggatgtggctctggagaaggctgcgaggatgcntgcgaacacgacatcgggggtctgggannatcgatggcggagtggatccccgtgtcctgtagtctctatgagtngggtggttgagtttggaag

SEQ ID NO: 720511 - DNA, 249 bp, Homo sapiens
ggtatgtggtgatgacagtgatgataatggtgatgatggtggtgatgatgtatggtggtgatgatggtgatggtgatggtggtggcagtgatggtaggtgataggaatggtagtggcaattggtggtgatgatggtgatgataatggtgattattgttgtgatgatgatgtggtggtggtgacttatggtgatggtgatgatggtggtgagtgatggtggtgatgagtcattctacattagcgaggatg

SEQ ID NO: 720512 - DNA, 530 bp, Homo sapiens
  misc_feature (18)..(18): n is a, c, g, or t
  misc_feature (31)..(31): n is a, c, g, or t
  misc_feature (135)..(136): n is a, c, g, or t
  misc_feature (165)..(166): n is a, c, g, or t
  misc_feature (227)..(227): n is a, c, g, or t
  misc_feature (312)..(312): n is a, c, g, or t
  misc_feature (316)..(316): n is a, c, g, or t
  misc_feature (320)..(320): n is a, c, g, or t
  misc_feature (322)..(322): n is a, c, g, or t
  misc_feature (332)..(332): n is a, c, g, or t
  misc_feature (336)..(336): n is a, c, g, or t
  misc_feature (338)..(338): n is a, c, g, or t
acgggcttccatcacctnttagctcctgaancaggcccgatatggtcaggccctaaattgtaaaattttttccacctccccgatcttggatttgagaggcagaagaagtgacccaactcagctctggaactgacnnggatgatattaagaagtggcattgttccnntcgttatgttagtttcagaatgttaacgtgtaactatatttgttcagtcgaatcaggtgantggaaacaacagatttcatattttacttttattggtactccgtccggcaacaatatgatgacttcaaacgagtagttggcaaaangganaagncnctaaggtacnaaananactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttc

SEQ ID NO: 720513 - DNA, 192 bp, Homo sapiens
ctagtccgagtaggcgagcacgccgtagcatgctgcgcattgggacccacgcgttctgcatagccctgtatttatgtgctctgggtaaatcatccacaaccttaacaatgaacaagatattcgaaaaataggaggactactcaaaaccatacctctcacttcaacctccctcaccattggccccttatcgag

SEQ ID NO: 720514 - DNA, 406 bp, Homo sapiens
cccccaggtgcccttaaaagaaatcttttaccagaagttgggggacctgctcttccgagacttctgggggaaccacttgcaggagttcagcgcccttgctcttaattctatgaggagatcaagaagtacgagaagctggagacgaaggaggaccgtgtgccccgcacccgggagatcttcgactcatacatcatgaaggagctgctgtcctgctcgcatacgttcttgaagagcgccactgagcatgtccaaggccacctgaggaagaagcagttgcctccggatctcttgcagccatacatcgaagagatttgtcagaacctccgaggggacgtgttccagaaattcattgagagcgattagcacacacggattggccagtggaagaatgcgcagcttagcatcc

SEQ ID NO: 720515 - DNA, 283 bp, Homo sapiens
  misc_feature (38)..(38): n is a, c, g, or t
  misc_feature (44)..(44): n is a, c, g, or t
  misc_feature (53)..(53): n is a, c, g, or t
  misc_feature (65)..(65): n is a, c, g, or t
  misc_feature (69)..(69): n is a, c, g, or t
  misc_feature (73)..(73): n is a, c, g, or t
  misc_feature (75)..(75): n is a, c, g, or t
  misc_feature (85)..(85): n is a, c, g, or t
  misc_feature (89)..(89): n is a, c, g, or t
  misc_feature (91)..(91): n is a, c, g, or t
aggagcgccgcccctggcccgccgggttccgttttttnccggcngtggcggtngattggcaaaangganaagncnctaaggtacnaaananactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttc

SEQ ID NO: 720516 - DNA, 366 bp, Homo sapiens
aggtcgctctagagcctcccccgctatttacaactatctacaaataaaataaaatatctaggagttaactaaaataaatagagtgaaatgatctctacaatgaaaactataaaacactgatgcaagacattaaagaagagtaatctcatttacaatagtgataactaaaataaaatgcctaggaattaactcaaccaaaggagtgaaagatctctacgatgaaaactataaaacactgatgcaagaaattaaagatgagtaatctcatttacgacagtgataactaaaataaaattaccaaggaattaactcaaccaaaggagtgaaagatctctatgatgaaaactataaaacactgatgcaaga

SEQ ID NO: 720517 - DNA, 244 bp, Homo sapiens
aacgacagacctggctctcagctattactgcgcatctgataccttgagaggggtgtggaaggaagtctgacgtgggatgtggaaggaggtgagtgtgagaggtgggtgtggaggtgtccggtggatgtggaaggtgagagtgaaagatgggtgtggaaggtgaaaggtgggtgtggaaggaggtatgaagtgggtgtggaaggaggccagggtgcatcggttggaggccagggtgcttcggttg

SEQ ID NO: 720518 - DNA, 502 bp, Homo sapiens
  misc_feature (15)..(15): n is a, c, g, or t
  misc_feature (88)..(88): n is a, c, g, or t
  misc_feature (227)..(227): n is a, c, g, or t
  misc_feature (266)..(266): n is a, c, g, or t
  misc_feature (349)..(349): n is a, c, g, or t
  misc_feature (393)..(393): n is a, c, g, or t
  misc_feature (458)..(458): n is a, c, g, or t
  misc_feature (494)..(494): n is a, c, g, or t
  misc_feature (496)..(497): n is a, c, g, or t
attttggaaaaaccnatatcattgcctgtaaatgtattatattttaaaaatttttttgaccctaagttttattgtttgtatttcaaanccattttcaaaataactatcttggggttaaaagaagaaggagggaggaaaaaggggtcaggcacactggacagggtcctctaagcagtgaggctggtgtgtatgattgtccttaaaattttttaatagatatggccgancgtgatggctcacccctgtaatcccagcactttgtgagnccagggtgggcggatcacttgaggccaggaatttgaaaccagcctgggcaaaaccctgtctctactaaaaatataaaaattanccaggcatgatggcacatgctggtaatagcagctactgaggtgntgaggcacaagaattcttggccctggaggtagaggctgcagtgagccaggattgtaccactgtanctcgcctggggctggacagtgagacttttgacaggnannctgtc

SEQ ID NO: 720519 - DNA, 843 bp, Homo sapiens
cacggtggctcacgcctgttatcccagcactttgggaggccgaggtgggtggatcatgaggtcaggagatcgagactgtcctggccaacatggtgaaatcccgtctctaccaaaaaatacaaaaaaaattagccgggcgtggtggcgggcgcctgcagtcccagctactcgggaggctgaggcaggagaatggcgtgaacccgggaggcagagcttgcagtgagccgagttcgcgccactgcactccagcctgggcgacagagcgagactccgtctcaaaaaataaataaattacttaaactaaaatacataatacagaagagagatatagtgaaactacctcaaggaaagtatatagggatgtcaaagagcccaaggagaggaagagagtactgcctcgcctcatgctatcccgagctgggattgcagtgtagtggctcttcctgtcttccagagccaaatgacatctgttcattctccctttcatgatcaggcaatttgactcattttttttcttttttttctttgcagagatgggatctccctgtgttgcccaagcgggtctccaaacttcctgggccttaaggggatcctatctcctacaaaaaaaacaaacaaaaaagcaaaaaaatgttgggggcctgacctgaaaattttcaaacctcggcttggggcgggccagtggttagaaactggccacgtgtgcagggaacccggcggagtgtgtggtccccaaaaagccgccacggttggacctgcaggtcggctggctaaggccagactacccgcggcggggaaaagagtacacgacacaggatacagcaacaacagtgaggcaggaac

SEQ ID NO: 720520 - DNA, 123 bp, Homo sapiens
tggactcagtcggctcatgatcgtgctccacatagttcatcacgatgtagatcttgtccatgttgctgcccaccacaatctctctaacggtgacgatgttgggatgctgggccttgaggatgg

SEQ ID NO: 720521 - DNA, 681 bp, Homo sapiens
  misc_feature (30)..(30): n is a, c, g, or t
  misc_feature (32)..(32): n is a, c, g, or t
  misc_feature (50)..(50): n is a, c, g, or t
  misc_feature (63)..(64): n is a, c, g, or t
  misc_feature (70)..(71): n is a, c, g, or t
  misc_feature (95)..(95): n is a, c, g, or t
  misc_feature (101)..(101): n is a, c, g, or t
  misc_feature (123)..(123): n is a, c, g, or t
  misc_feature (128)..(128): n is a, c, g, or t
  misc_feature (131)..(131): n is a, c, g, or t
  misc_feature (144)..(144): n is a, c, g, or t
  misc_feature (187)..(188): n is a, c, g, or t
  misc_feature (198)..(199): n is a, c, g, or t
  misc_feature (202)..(202): n is a, c, g, or t
  misc_feature (212)..(212): n is a, c, g, or t
  misc_feature (234)..(234): n is a, c, g, or t
  misc_feature (238)..(238): n is a, c, g, or t
  misc_feature (240)..(240): n is a, c, g, or t
  misc_feature (254)..(254): n is a, c, g, or t
  misc_feature (262)..(262): n is a, c, g, or t
  misc_feature (265)..(265): n is a, c, g, or t
  misc_feature (277)..(277): n is a, c, g, or t
  misc_feature (286)..(286): n is a, c, g, or t
  misc_feature (289)..(289): n is a, c, g, or t
  misc_feature (293)..(293): n is a, c, g, or t
  misc_feature (304)..(304): n is a, c, g, or t
  misc_feature (307)..(307): n is a, c, g, or t
  misc_feature (322)..(322): n is a, c, g, or t
  misc_feature (363)..(363): n is a, c, g, or t
  misc_feature (374)..(374): n is a, c, g, or t
  misc_feature (378)..(378): n is a, c, g, or t
  misc_feature (398)..(398): n is a, c, g, or t
  misc_feature (412)..(413): n is a, c, g, or t
  misc_feature (432)..(432): n is a, c, g, or t
  misc_feature (444)..(444): n is a, c, g, or t
  misc_feature (457)..(457): n is a, c, g, or t
  misc_feature (473)..(473): n is a, c, g, or t
  misc_feature (494)..(494): n is a, c, g, or t
  misc_feature (502)..(502): n is a, c, g, or t
  misc_feature (533)..(533): n is a, c, g, or t
  misc_feature (547)..(547): n is a, c, g, or t
  misc_feature (609)..(609): n is a, c, g, or t
  misc_feature (658)..(658): n is a, c, g, or t
tcatttaaattttttaatgggtctaaaaantntgtgaaaaatttttggtnaagttgtttccannaaaaannaatgattttaaaaaaaaaaaaatnaaaaangccaaaagaaaaaaaaaaaaanaaagnggnccaaaaaaaattntcctttccttctgaaggttttacgatgcattgttataattaannagttttttannaanaaaattaaanggccaattgaaaaaaaaagttntganancgttcttccaccantgattaanagnggggggggaggnattaggganaanattnatttagccttntgngctttctggggaganttggggaccttgccagccccagcagcctttttgtccactgntttgatgaaanccancgcaaatgtttgttttaaanaaagaaaagaaaanngacccaaagggggaaagtntgagaagctctnaaaaaaaatgggnttgccaggaaccaaanaaaaaatgggagcatcaccanaattcaanaatttagggccatcttccagctttttaccanaacggggattaatnttttccttcagctcagcaaaattgcatgcaatgtgagcggtgtgggaatccaatacaggggnatagccggcgcttatttggcctggatggttcaggataatcacctgagcngtgaagccagccgcttccattgg

SEQ ID NO: 720522 - DNA, 495 bp, Homo sapiens
  misc_feature (260)..(260): n is a, c, g, or t
  misc_feature (314)..(314): n is a, c, g, or t
  misc_feature (322)..(322): n is a, c, g, or t
  misc_feature (345)..(345): n is a, c, g, or t
  misc_feature (414)..(414): n is a, c, g, or t
  misc_feature (440)..(440): n is a, c, g, or t
  misc_feature (470)..(470): n is a, c, g, or t
  misc_feature (488)..(488): n is a, c, g, or t
tatggattccaaaattagttgtggaaatctgcaattataggtaattcatttttttagtggaagtaaattcaaaggtctatcatgagttaatgttaagtttgcttatattttaaagaaaaatgtagatatttaaaaactattctactaatcccagtgttaaatcatccacatctttgaaaatatatgtagtaatttggaatattcattagacataaattctcttttatattttaaaacacataatcacaaagaattatgtngcttggataattttacttgtagttgattgtgttcaaatttacaaacatagtctnctactatntatactttaacttttgttctatntgtgtaacctgccttacagattggaaacgtattatcaaaagttttgcatttggtgctacttttaaacanaatagtgtataaagaataagaattcntatactttgctcatatctatcacctctttntcagtcacactgctagcnaatttac

SEQ ID NO: 720523 - DNA, 193 bp, Homo sapiens
aagcatacacgacgacgtgctatagatacctcctgtggacgaaacagtctataatccttctccctatcctataaggagtctcataaaacctttattctattactgttgggtttacaggctgtgcattaagatcagctgctatatggcaatatgaatcactgaaatcccagggtccagagttattttgatggtc

SEQ ID NO: 720524 - DNA, 148 bp, Homo sapiens
  misc_feature (111)..(111): n is a, c, g, or t
  misc_feature (121)..(121): n is a, c, g, or t
cttcagatcacttagtttggttctcatggtgtatatcagcctcgtggtttggtatttcatatgattcgcctgattacacagatgaatcttgcactttcaagatatcattgngaaatttccngtccatcttatcatgggaattaaaaaa

SEQ ID NO: 720525 - DNA, 126 bp, Homo sapiens
tattccgcgccgctgtgggcttgttgagcccggttatcgcggctgcggcaatggcctttgctcgatcttcgttgtcacgaactcgatgaggctggtgcgttggcatcctgggatgagcgattcaaa

SEQ ID NO: 720526 - DNA, 502 bp, Homo sapiens
tcgactcggtccgtgttatcgatgccacttccatcagtcggaatagctattactaaaaagtcaaaaaataacagatgttgcggagaaaagggaatgcttatacactgttggtgagaatgtaaattagttcagccactgtggaaagcagtttggagatttctcaaagaacttagaactatcattcaacccagcaatcccaaaggaaaatgcattgttccaccaaaaggacaatgcactcgtatgtttatcacagtagtattcacaatagaaaagacatggtggaatcaacctagacgcccatcaatggtagactggataaagaaaatgtggaacatattcaccatagaatactatgcagccataaaaaaagaatgaattcatgtcctttgaagcaaaatgaatgcagctggaagccattatcttaagtgaattaatacaggaaaggaaaaccaaataccacatattctcacttataagtgggaatatgtggcatcgataaaca

SEQ ID NO: 720527 - DNA, 505 bp, Homo sapiens
tactactctgtgaatgccctagatatttgactcaaattacactcaatcttattaggtatattcgtaggattattagaatctacaaaccaaccctagaatatcatgctattccagtcacacctgtggaacaatgagcagtgtacgaccatgccgcatcacaatccaagccttggtaccctagatagtgacgacctcctcacaaaggtattaaagctgagccaattcaatctatattttgctttcagactaaacataatacatgctttcaaataacgtaacttttaaggtatctgaacaaagggcatgtaaggttcacttcacttctcaaactgcaattacacactcatcaggcttatggctgtctggactaattgctaacctcagtacctcctacaaattagcagtcttcaccttaggtttccacagtactcattacactttactcgtaatcacagtacaaacgttttgcgtctcacccatttcattgtaaacaaaccaattacac

SEQ ID NO: 720528 - DNA, 453 bp, Homo sapiens
ggagggtcaaaaagggcggtcggcggccggtcaggaacttaattctgaagatataagaactagacagtcagacctccaggactaagatgaagtgagccgagaggaaatcagagggtgggaatgcttctgtcgttagccgggtgcagtgctgtgtgtatctagttccagctacttgagaggctgaggcaggaggattgcttgagtccagaaagtggcaattgcagtggagtggaaatcgcgccactgctctccagcctgggtggcagagggagggggtgtctcaaaaaatagacaataacaaaatgcttgtgtcagttaacaatctttattagagggtttttagtctttctttcgtagctgtatgttaaagtggggggacaaatgcgaataaacgggtttattatgctttaacaggaagaaagaggggaaataatggcctcgtttggctgaccg

SEQ ID NO: 720529 - DNA, 86 bp, Homo sapiens
ggacgcgtgggcgacagagccagactgaggaagaaattgtatatcaggctgggcacagtggctcatgcccgtaatcccagcacttt

SEQ ID NO: 720530 - DNA, 497 bp, Homo sapiens
gatctgtgccctatccagaagatcatccacagagactatcaattcacatgaagcagcagctgcaagtctaactatccatctccaagagggaatggtcacaaacacaatgcctcatctagctcaacaataatcatccccaacaccacatgacctctaagtatcagtacgtggcatgcacaaataatttctcgtgaaaggcctcaacaaagcacaacccttaacttagggagggaagagacaaccacaaatgtaaagactccattaccttcggaggcaaagtgctggaaagtaaatgcttcatttctcttatggctcaatgtggtggccatgcgggctgtctgagggtctgcatgtcctgaaagtaatgaaagcactcctccctgatgtacagtggggaaaatatgtccatatctaaccagtgatacgagctatatagaagtattcaggacagccagtctatacatatctcactctgatgtaaatgaagtaacttgtct

SEQ ID NO: 720531 - DNA, 1003 bp, Homo sapiens
  misc_feature (2)..(2): n is a, c, g, or t
  misc_feature (341)..(341): n is a, c, g, or t
  misc_feature (346)..(348): n is a, c, g, or t
  misc_feature (354)..(354): n is a, c, g, or t
  misc_feature (356)..(357): n is a, c, g, or t
  misc_feature (568)..(568): n is a, c, g, or t
  misc_feature (630)..(630): n is a, c, g, or t
  misc_feature (677)..(677): n is a, c, g, or t
cnggagtgggaggcccgatagtgttccttctcctctttccctttgtcgtgagtccttgtgccgtcctgtcttctttcctaataatggtgcgcggattccttttccgcgactaatttttgcccctcgtggtccccgggtgttctggcgtgggcacccttctcctgtcacgtcagcgccggcgttctgcttctgcgcccaacttcctgtgcttcggtaatctctttggagagagaaaaagcgttcatgagttttgtaccttggaaaccattggatggtaggatttgtaacacgtcaaccattttgaagcttctgaaaagtaactttcaacttgcgaaggtcantcttnnnaaagantnncctaaacaccgagggaaacttaagaacgtttaaaatataggagtccgtgatttccctgtgttttcagtttctttccttctgtgaacgatgagacttggagaacgggctggtccttcaccacttcctgttggcctggcctggccggggaaggtggcagcggcaccggactgacctgcagtgacccgcgatgccgcgccacgagggacacttnatggcttcattcgagagctgctgccacaaaacgcctggcgccgccaccgacgggggccggcntcgaggacgcccgcctgcctcgcgggtcgtcgtccgcgggactgtgntcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgctatttaagcacctgtggtgtgactaggcttaa

SEQ ID NO: 720532 - DNA, 729 bp, Homo sapiens
catgtgtagcccgaggctggacctgaactgctgggctagagcaagtctctgcccctgcgagcctctggagtagctgggcctacagagtgtgctgccgcatccagctaatacagtctgtctaactcccgtctctctaattccccggttgtctatggccgcagaggcagactcctgtgccagcgtcatgtcaataccgcatccagcatacaggatctctgtatagataaactttctcgttttctcgttaagcacaaaatagatgaggtaggtactactatacggagctaagcagcgacgaactgtgcctaacgcttatacacatagggtagaataggacaagcgatttgtctcagggcaagggacgtcgtggttggtcgcaaatgtcctggtaatattcgccaagacagtatagggtacgggccatcggctgggtgaaatcaccctgtgatgtcaggcagtttgcagaggaccagtctcctgtgtgtaaacaccgggtgaaaaatacccatcgtctacgtagagataaatacatgtataaacttgtgccactgggtcagtggctgtgcagggctgcctgtggtcccagactgctcgggaggttgaggccacagtaatggcgtgatcccgggcagtgtggagtgtttgctgctggcaagcctacgatggggccaatgtgacttcaccagctcatggcgggacacggagcgtagacgtccgtcgttaacatga

SEQ ID NO: 720533 - DNA, 1307 bp, Homo sapiens
  misc_feature (411)..(411): n is a, c, g, or t
  misc_feature (733)..(734): n is a, c, g, or t
  misc_feature (739)..(739): n is a, c, g, or t
  misc_feature (822)..(822): n is a, c, g, or t
  misc_feature (835)..(835): n is a, c, g, or t
  misc_feature (865)..(865): n is a, c, g, or t
  misc_feature (868)..(868): n is a, c, g, or t
  misc_feature (893)..(893): n is a, c, g, or t
  misc_feature (896)..(896): n is a, c, g, or t
  misc_feature (902)..(902): n is a, c, g, or t
  misc_feature (931)..(932): n is a, c, g, or t
  misc_feature (941)..(941): n is a, c, g, or t
  misc_feature (943)..(943): n is a, c, g, or t
  misc_feature (953)..(953): n is a, c, g, or t
  misc_feature (955)..(955): n is a, c, g, or t
  misc_feature (966)..(967): n is a, c, g, or t
  misc_feature (974)..(974): n is a, c, g, or t
  misc_feature (1052)..(1052): n is a, c, g, or t
  misc_feature (1055)..(1055): n is a, c, g, or t
  misc_feature (1066)..(1066): n is a, c, g, or t
  misc_feature (1073)..(1073): n is a, c, g, or t
  misc_feature (1076)..(1076): n is a, c, g, or t
  misc_feature (1080)..(1080): n is a, c, g, or t
  misc_feature (1087)..(1087): n is a, c, g, or t
  misc_feature (1091)..(1091): n is a, c, g, or t
gataactgctggcgcaccgtcgtcgcgcagaaggtggttctgtattctagctccgagctgtgcttagcgatggcctggaaatccggcggggccagcgactggggagctcctccacaatctccgcaccacatggaatcaatcacagcacagatcaagtatagggagagtgatgcgtggctacaggaccgctcccagtatgctactatgtacccccagtacatggattcatccacaatcaataggtttccaagcaacaatcagttgctccacacatgcatgcatatgcgctaagaacttctatttgatcagttgcatgaaggagctaaagctcttgcatgtaggatctggaagtggaattccttactgcatgtttgcacgtatggttggatgtactggaaaaggtcataggantgatcacattaaagagctagtagatgactcagtaaataatgtcaggaaggacgatccaacacttctgtcttcagggagagtacagcttgtagtgggggatggaagaatgggatatgctgaagaagccccttatgatgccattcatgtgggagctgcagcccctgttgtaccccagggcgctaatagatcagttaaagcccggaggaagattgatattgcctgttggtccttgcaggcggaaaccaaatgttggagcagtatgacaagctacaagatggcagcgatccaaaatgaagcctctgatgggggtgatatacgtgcnntttanacagataaagaaaagcagtggtccaggtggaagtgatttatcttgctgctctttcttcttcccacaacatggcaggggttgantggtaaaagcaanatcagttgacagtataaaattacagtggantgntcatctcagtcctcaaagcttttgnaanaccaanaccatcacagctggtttggacttgttacnnctgttactntncagcatgaanantgtgtgtcttnnagggttnctgattcttcaaagaggcacagagccaaatggtcagaggaaggatgcaccagtataaatttgtgtaatattactttgncantgccatatttnacttggnaantatnacaagangggntctgacacatggaaagactgtagtctggtgaatgtgatcttgaggagtggtttagggtttactaggacggcttaattgctgtcctgatatgaattgatcagatggggtttgtgcattggataagacaccattacaagttaggattcttggattggtatctggagcatgtcttagacactggatgactttctttaaagttggagggggataatatgg

SEQ ID NO: 720534 - DNA, 654 bp, Homo sapiens
  misc_feature (47)..(47): n is a, c, g, or t
  misc_feature (383)..(383): n is a, c, g, or t
ctttcgcgtctgcggtgttcggagtgtggtacttctcctagttgcantcaggcttcatacgctattgtcctgcccgtaagttcccgttttgtgtgtggtgagtggaaactccatgttcttcgttggagacctctggtcctcccttcccttctttgtgccgtcgtctctgcggccagccctaatctccttctcgtggcttctccgtctctgaccccaaataggccttaagggcgtgggagaaatgagtttctggagctggaaaagccactgccttctgcacgggcctgagaagcccttggctggtgttgatgacttcacttttttccccatcagatcgacaatgctgacgtcttatattttgccagttagttctgatacatcgncctcggcccggccttgttcgtttctgaccgtgggaagatgtcggtaacgccctttatttgttggttaccagttagagcagccagcgggtccagaatggatttggaagacgtagccaccactgtaccttcatgggaagccagctcagacctcctacaaccttcgtacttctgacgagtaagcctttgtttcctaagtggtttactggtggacatcacgtgctttgagaacttttaattttctaggtatacttcggtcttcctcctcctcttc

SEQ ID NO: 720535 - DNA, 1359 bp, Homo sapiens
  misc_feature (47)..(47): n is a, c, g, or t
  misc_feature (837)..(838): n is a, c, g, or t
  misc_feature (843)..(843): n is a, c, g, or t
  misc_feature (874)..(874): n is a, c, g, or t
  misc_feature (887)..(887): n is a, c, g, or t
  misc_feature (917)..(917): n is a, c, g, or t
  misc_feature (920)..(920): n is a, c, g, or t
  misc_feature (945)..(945): n is a, c, g, or t
  misc_feature (948)..(948): n is a, c, g, or t
  misc_feature (954)..(954): n is a, c, g, or t
  misc_feature (983)..(984): n is a, c, g, or t
  misc_feature (993)..(993): n is a, c, g, or t
  misc_feature (995)..(995): n is a, c, g, or t
  misc_feature (1005)..(1005): n is a, c, g, or t
  misc_feature (1007)..(1007): n is a, c, g, or t
  misc_feature (1018)..(1019): n is a, c, g, or t
  misc_feature (1026)..(1026): n is a, c, g, or t
  misc_feature (1104)..(1104): n is a, c, g, or t
  misc_feature (1107)..(1107): n is a, c, g, or t
  misc_feature (1118)..(1118): n is a, c, g, or t
  misc_feature (1125)..(1125): n is a, c, g, or t
  misc_feature (1128)..(1128): n is a, c, g, or t
  misc_feature (1132)..(1132): n is a, c, g, or t
  misc_feature (1139)..(1139): n is a, c, g, or t
  misc_feature (1143)..(1143): n is a, c, g, or t
ctttcgcgtctgcggtgttcggagtgtggtacttctcctagttgcantcaggcttcatacgctattgtcctgcccgtctacagcattggcagcgggtacagaatggatttcggaagacgggagtcagcactggacctccaaggaagccacgtgcagacatctacgaccttcgcatctcctgacgagtttattgttggccaaaaccaggctttgattgagccaggatgaatgcgggtgttggatagtagaatattatatatacatataacattggttgtgagagccacgtgtaccacgattgtgtgttagtatctctggcttgcattcagtctgccttgtaacagaaactggcgatggattatgacgatgggtagccctctggcatacgtataaggatcagaccctgtgacttgcatgaaagtgaagatctggctatacatgcagttccacaacgttactgtatacatagcctgagttgaaagaaggctgtgcgccacttcaagaatgtcatggctagactttgagctttctaactggcctacctgcttatgtgaagagtaaggatctttctcaaatcttctgtcttcagggagagtacagcttgtagtgggggatggaagaatgggatatgctgaagaagccccttatgatgccattcatgtgggagctgcagcccctgttgtaccccagggcgctaatagatcagttaaagcccggaggaagattgatattgcctgttggtccttgcaggcggaaaccaaatgttggagcagtatgacaagctacaagatggcagcgatccaaaatgaagcctctgatgggggtgatatacgtgcnntttanacagataaagaaaagcagtggtccaggtgantggtaaaagcaanatcagttgacagtataaaattacagtggantgntcatctcagtcctcaaagcttttgnaanaccaanaccatcacagctggtttggacttgttacnnctgttactntncagcatgaanantgtgtgtcttnnagggttnctgattcttcaaagaggcacagagccaaatggtcagaggaaggatgcaccagtataaatttgtgtaatattactttgncantgccatatttnacttggnaantatnacaagangggntctgacacatggaaagactgtagtctggtgaatgtgatcttgaggagtggtttagggtttactaggacggcttaattgctgtcctgatatgaattgatcagatggggtttgtgcattggataagacaccattacaagttaggattcttggattggtatctggagcatgtcttagacactggatgactttctttaaagttggagggggataatatgg

SEQ ID NO: 720536 - DNA, 1255 bp, Homo sapiens
  misc_feature (411)..(411): n is a, c, g, or t
  misc_feature (733)..(734): n is a, c, g, or t
  misc_feature (739)..(739): n is a, c, g, or t
  misc_feature (770)..(770): n is a, c, g, or t
  misc_feature (783)..(783): n is a, c, g, or t
  misc_feature (813)..(813): n is a, c, g, or t
  misc_feature (816)..(816): n is a, c, g, or t
  misc_feature (841)..(841): n is a, c, g, or t
  misc_feature (844)..(844): n is a, c, g, or t
  misc_feature (850)..(850): n is a, c, g, or t
  misc_feature (879)..(880): n is a, c, g, or t
  misc_feature (889)..(889): n is a, c, g, or t
  misc_feature (891)..(891): n is a, c, g, or t
  misc_feature (901)..(901): n is a, c, g, or t
  misc_feature (903)..(903): n is a, c, g, or t
  misc_feature (914)..(915): n is a, c, g, or t
  misc_feature (922)..(922): n is a, c, g, or t
  misc_feature (1000)..(1000): n is a, c, g, or t
  misc_feature (1003)..(1003): n is a, c, g, or t
  misc_feature (1014)..(1014): n is a, c, g, or t
  misc_feature (1021)..(1021): n is a, c, g, or t
  misc_feature (1024)..(1024): n is a, c, g, or t
  misc_feature (1028)..(1028): n is a, c, g, or t
  misc_feature (1035)..(1035): n is a, c, g, or t
  misc_feature (1039)..(1039): n is a, c, g, or t
gataactgctggcgcaccgtcgtcgcgcagaaggtggttctgtattctagctccgagctgtgcttagcgatggcctggaaatccggcggggccagcgactggggagctcctccacaatctccgcaccacatggaatcaatcacagcacagatcaagtatagggagagtgatgcgtggctacaggaccgctcccagtatgctactatgtacccccagtacatggattcatccacaatcaataggtttccaagcaacaatcagttgctccacacatgcatgcatatgcgctaagaacttctatttgatcagttgcatgaaggagctaaagctcttgcatgtaggatctggaagtggaattccttactgcatgtttgcacgtatggttggatgtactggaaaaggtcataggantgatcacattaaagagctagtagatgactcagtaaataatgtcaggaaggacgatccaacacttctgtcttcagggagagtacagcttgtagtgggggatggaagaatgggatatgctgaagaagccccttatgatgccattcatgtgggagctgcagcccctgttgtaccccagggcgctaatagatcagttaaagcccggaggaagattgatattgcctgttggtccttgcaggcggaaaccaaatgttggagcagtatgacaagctacaagatggcagcgatccaaaatgaagcctctgatgggggtgatatacgtgcnntttanacagataaagaaaagcagtggtccaggtgantggtaaaagcaanatcagttgacagtataaaattacagtggantgntcatctcagtcctcaaagcttttgnaanaccaanaccatcacagctggtttggacttgttacnnctgttactntncagcatgaanantgtgtgtcttnnagggttnctgattcttcaaagaggcacagagccaaatggtcagaggaaggatgcaccagtataaatttgtgtaatattactttgncantgccatatttnacttggnaantatnacaagangggntctgacacatggaaagactgtagtctggtgaatgtgatcttgaggagtggtttagggtttactaggacggcttaattgctgtcctgatatgaattgatcagatggggtttgtgcattggataagacaccattacaagttaggattcttggattggtatctggagcatgtcttagacactggatgactttctttaaagttggagggggataatatgg

SEQ ID NO: 720537 - DNA, 345 bp, Homo sapiens
  misc_feature (35)..(35): n is a, c, g, or t
  misc_feature (77)..(77): n is a, c, g, or t
  misc_feature (95)..(95): n is a, c, g, or t
  misc_feature (293)..(293): n is a, c, g, or t
  misc_feature (342)..(342): n is a, c, g, or t
caggctggaaagccggcgcagggaggtcacctttnatgtagacatcgtcgtcggcgcgcattaaccactcatacttntccagaaatcagcatganaagatgatcaaaattcatatattgaaacatgaaaaggctctgaatgggttggatgatgccctcccatattgcggtggccaatatgctttactcagtctacagattcaaatgctaatctcttctggaaacaaactcacagacacactcaaaaataatgtttaactagatatctggacatccggtgctcaaggttgaagnagaaataaagaagcacgggagtaataacatgggattatcagaaacctgnctt

SEQ ID NO: 720538 - DNA, 660 bp, Homo sapiens
tgatgtgttggttttctcgatgagcgttaggccgctggtttggtgatcggtctgatgcaatgtctggacgtggtaagcaaggaggcaaagctcgcgccaaagcgaaatcccgctcttctcgcgctggtctccagttcccggtgggccgagtgcaccgcctgctccgtaaaggcaactactgcagtagcgggttggggcaggcgcgccggtgtacctggcggacggatgttagagtacctgaccgtcgagatcctggagctggccggtaactgcggtcgggaggacaagaagactcgcatcatcccgcgccatcttgtagctgtgcatccgtaatgacgaggagctcaacaaacgtgttagtgtccgggtgaccatttgtctcagggcggcgtccttcctaacatccaggccgttgcttctgtctaagagtgaccggatgagttcacccattcatgggttcatggtgtccgttggagtttgacccgcaaagatgtcttttctgatgtgtctgattcgtgtgtgtctcacagtcttgttaattcccagctcatttggtgtctggctgggttggctatgagccttttcttttttcctgagagtttgctggttcctatgtgtctgtcctttgtgtacacttctttatgcttatgtggctggtgg

SEQ ID NO: 720539 - DNA, 377 bp, Homo sapiens
cctgagtagggtgtgacctccgcagcggcagaggaggagcgcagccggcctcgaagaactttcttgctttggggtgggcttgaacctcttgattctttgaccctaggaggtcattgggcccattggcaacccaaaagggagggtactgttcaaaagctggctttcagggatttcaattgcccatgggaaggatgccccagacccctgagggaagggccatgtaaaggggctcgggcacccatggaaggacggcatttatttaggcgtttccttgtcctaaccgcaacaacggcccagcggccagggaggatcaggggcaggcctatcaagaggcaccattcgggcaggggactttatagaggagcctgaggtcagga

SEQ ID NO: 720540 - DNA, 858 bp, Homo sapiens
  misc_feature (164)..(164): n is a, c, g, or t
  misc_feature (167)..(167): n is a, c, g, or t
  misc_feature (170)..(170): n is a, c, g, or t
  misc_feature (178)..(178): n is a, c, g, or t
  misc_feature (182)..(182): n is a, c, g, or t
  misc_feature (187)..(187): n is a, c, g, or t
  misc_feature (201)..(201): n is a, c, g, or t
  misc_feature (204)..(204): n is a, c, g, or t
  misc_feature (219)..(219): n is a, c, g, or t
  misc_feature (233)..(233): n is a, c, g, or t
  misc_feature (236)..(237): n is a, c, g, or t
  misc_feature (241)..(241): n is a, c, g, or t
  misc_feature (251)..(252): n is a, c, g, or t
  misc_feature (261)..(261): n is a, c, g, or t
  misc_feature (277)..(277): n is a, c, g, or t
  misc_feature (283)..(284): n is a, c, g, or t
  misc_feature (291)..(291): n is a, c, g, or t
  misc_feature (431)..(431): n is a, c, g, or t
ccggacttcgagccatggcggtgacggaagcgagcctgtgcgccagtgccccctgcttcggccccagaaccggtcgaaaaccgtgtatgagggattcatctcggctcagggaagagacttccaccttaggatagtgttgcctgaagatttacaactgaagaatncangantattatgnagtnggcanctgagaacaatacntantggataccatcgaanagtacaacagagantgnngcantctcctgatnnaatgagctntatgatggagttgaanatgctnntggaagntggcttagagaatagacaagagctgtagtagcagcgtacctcctcgctcgcaccagattctacatcaagaccgtgtatgaaagagataggaacgtctgggtggggagtaaagcttgtgtatgcggataccgtgcttcagntaccatcaagttaaagagcagaagagtgctatctggtagagagcactttaatcgactcatcaagtggaaggcaaagtatcctgcagaatcaccagatcatcgagtggattttcctgttccattttgtgcctcctggacagctcaggtaaattctcctcagagctccttaagtaagcagttgatagtcagttttttggcagcaagtagaatcgctaaaggcattctgggatgttatggatggaaatcgatgagaagaccgtgggtacttgaagcctagaaggaagctccacggagtgcaacagtaccgcagaatttgctttcggtaataactgtttccatcaatattagaggtagaaccccaggcattcctactatgcttcctggagtgctcttcctggaacctgaccctgtgggaaaaccccgtgga

SEQ ID NO: 720541 - DNA, 1199 bp, Homo sapiens
gttatttgctatcgaggaggacttcgtaacccagattgtggagtgtgcctatgattgatagacacgagtatgaccatcgtagttgtgaatacgagtagtgacctttggcactagatatagttttattcgatgcgagatcctggagcttagagttctagacgaggaatcaaggtgagcgttgctggaatagatgtgtgcgtaagtaatgaagtacgtattaatattatgctatagatgaaagagaataataataggcctaagtgaggatgaatgacgagtactgcctagatgtatggagtactcaggagctagagtaagcatttgaggaacgcagacactattggtcgatttgtacttgttcaccagttagcaatcgagtggaatttggtgaggaattgggagtctgcgaaaaactttacgtcgttttactgtaaggtacaaaattgatcgtgagggagttaatgctcctacaatgagggaattggtttgtttcacgcataagtccctaatgataggaatatgtagtagaggtgcgatagatggggtaaaaggctgtaggtgacttgattcttcgctaaactggtaaaggaataccagagggaaggacggctagcacagggtaggtatggagatcgcatggtactgcgtgtagttctgtttgtggaaaatgtgaagcgtaagaggacgtgtgtgtagcggcacgcgttgtacgtcagtggcgtgggtacgatctacagtaagggaaagcgttctttgcaagggacgcaaatgtgagggttatccctataaactagttgctggttggattatcaattgaggaagtggggcaagccgtgacaacagtatggaagtggtacaacagtattggaaagacacaatggacacagaaggaggtatattcggtgagagtatacgcaaacaaaaagtcggtggaagttcattatagcgggcgtgttgacaacttcccaggtgaattctagatggttggcccatggcacaaaatttggttgaacagagtagggctggcgggagatggctctgaattctagttacagattggaactatggtactgagaggtatacgtgggagacagaaggatccaacaccagtgcaggactttgaggagggagaacattgatagagggaccatcacggatagagatagataacggttattataacaaagatgtagttactg

SEQ ID NO: 720542 - DNA, 893 bp, Homo sapiens
  misc_feature (133)..(133): n is a, c, g, or t
  misc_feature (199)..(199): n is a, c, g, or t
  misc_feature (202)..(202): n is a, c, g, or t
  misc_feature (205)..(205): n is a, c, g, or t
  misc_feature (213)..(213): n is a, c, g, or t
  misc_feature (217)..(217): n is a, c, g, or t
  misc_feature (222)..(222): n is a, c, g, or t
  misc_feature (236)..(236): n is a, c, g, or t
  misc_feature (239)..(239): n is a, c, g, or t
  misc_feature (254)..(254): n is a, c, g, or t
  misc_feature (268)..(268): n is a, c, g, or t
  misc_feature (271)..(272): n is a, c, g, or t
  misc_feature (276)..(276): n is a, c, g, or t
  misc_feature (286)..(287): n is a, c, g, or t
  misc_feature (296)..(296): n is a, c, g, or t
  misc_feature (312)..(312): n is a, c, g, or t
  misc_feature (318)..(319): n is a, c, g, or t
  misc_feature (326)..(326): n is a, c, g, or t
  misc_feature (466)..(466): n is a, c, g, or t
ggtacccgtaaaagcgagaagatgctgtctggtagagagcactttaatcacatctcaagtgtgaaggcagaagtatcctgctagaatcacctagattatttgtgtggattttcctgttcattttgtgcctccnggacacctcagggaagagacttccaccttaggatagtgttgcctgaagatttacaactgaagaatncangantattatgnagtnggcanctgagaacaatacntantggataccatcgaanagtacaacagagantgnngcantctcctgatnnaatgagctntatgatggagttgaanatgctnntggaagntggcttagagaatagacaagagctgtagtagcagcgtacctcctcgctcgcaccagattctacatcaagaccgtgtatgaaagagataggaacgtctgggtggggagtaaagcttgtgtatgcggataccgtgcttcagntaccatcaagttaaagagcagaagagtgctatctggtagagagcactttaatcgactcatcaagtggaaggcaaagtatcctgcagaatcaccagatcatcgagtggattttcctgttccattttgtgcctcctggacagctcaggtaaattctcctcagagctccttaagtaagcagttgatagtcagttttttggcagcaagtagaatcgctaaaggcattctgggatgttatggatggaaatcgatgagaagaccgtgggtacttgaagcctagaaggaagctccacggagtgcaacagtaccgcagaatttgctttcggtaataactgtttccatcaatattagaggtagaaccccaggcattcctactatgcttcctggagtgctcttcctggaacctgaccctgtgggaaaaccccgtgga

SEQ ID NO: 720543 - DNA, 1245 bp, Homo sapiens
caatccgactaatcaccacccaacaatgacgtattcaaactaagccaatagccctgggccgtacgcgctaaccgctaacattaccatgaaggcgcaccttactcatgcacctaattggaagcgccaccctagcgaatatcaaccattaaccttccctctacacttatcatcgttcacaacttctaagttctactgactgatccgtagaacatcggctgtcgccttagatccaagcctacgttgttctacatcgttgctagatagagcctctaccttggcacggactagacgagcatagatgacccagccaatcacagtgcctatcatatagtagaacccagcccatgaccccttaacgaggggccctcatcagcgccttcctaatgacctccggccttagcctatgtgatttcactttcacgacatcctagtaaggctccttcatactaggcgctacttaaccaaggacacttaaccatatacctaatgatggcgcgatgtaacacgagaaagcactgtaccaaggccaacagcacgagtcacctgtccaaaaaggccttcgagtacgggataactcctatttattacctcagaagtttccgatcttcgcatggatttttctggagccttgataccagctccagtcctaggcccctaaacacgcctaagtaaggagggcactgggtcaccaaggagggataaagcccggatagatccctagaaagtccactgctagaaacattgcggtatttactcggcatcagggagctatcaatcagcaggaaagacaccagagatcttgatgagaaaacgaacccgggaaccaataaattcaaggccatggttatttgcacctgtgacggggccctattataaacagcctagaaggtcaaaagacataaggacccctaaccaatccgaagagacctacagcggcaaccattatttggtagcaccagaaggcccccgcgacaacagcacattgggggcgaacacccgcaccaaaggtgtaacacgccacgcaaaaaattacattgagaccaccacacatatgaggtgagaagccacggaatagataatgaaagaacaggaaaccacacacgccaatgccgggagtcaacgacgaaacacagagaaaaacaaggacgcccgccccgccgtacctagacaagagacgacaatattattctaatcgtctcttactatgacccagcacacaagcaagcaagtgtagggaggaggggc

SEQ ID NO: 720544 - DNA, 368 bp, Homo sapiens
agcactatgaattctattgcccccacccccccgactcacaccaactattcctcagctcagtaaatgacaccacaaccaactgatcattcattcaaatctggctcatctatgactcattcttaaactcttctgacttgtctttaagtctctcccctgacatacagtctcgaatcagtaagtcctatttgttctactatcaaaatatatatagaatatgctaactctttttatattccctgccatgatcctaacagcaactactgtcactagctgtttcccagatgaaaatacatattaaaccttctccttcctattattcatgccctcctaaaacacatacttcctactgtagccataatgccttcttc

SEQ ID NO: 720545 - DNA, 217 bp, Homo sapiens
aaaacgctacatcgttgggggaagggaaagacttagaggaccccgggcccctccctgaggctcagaccaggcctcccggccccggccggcgtgagccgttcaaaatttacggtccccttggggaaaaaaaccaaaaccccgaaaaggccacgccggccgctctgaccggccgacacggtcaccttcgggccctggggcctttggggacgctgggctt

SEQ ID NO: 720546 - DNA, 1332 bp, Homo sapiens
cggacgcgctgggtcgacccacgcgtccgggcccccgcaaggtccccggccgtgcgcgagggagccatgatgaggcgcaccctggcaaaaccggaacgctcaacacgaacacaagctgcaaagcagcgtgctctcgaacatagtggagacagcactcacgggacgacactggtgccaaactctcgtcgcatgcctactgctgcggacaacactgccaggcttgcacgcagaccaaagtcagacccctcctggctgacactgcaacatctaaccgcgctactgctgctaacagagtaccctcgcactttaacacgctggcgcctgactgaacctttctgcacgattgacgttattgccagtcaccctctcacgggactctactctgagcacaggccaggaccgggttcgaacaggacctcttctgcaagatcgccaaaaggctaacgcattgaaaccccccctttggcaacacaccgttacatgggaaacccagctatgctagcacaccccttggacatatccgcgcgaaatggaccgcttccaataacgcccatagttatccttcaccaaggacaaacggggacacttccgaatgaagaaggcccttacacgcccataatctattacaccttcccacgatctttcagtcagaatacgtgacatcaagcgctatcacagcgcgaacaaacccctcaattccgtggaatcgcgaaccacgttgctataactctcattcaaccatggtggtcccaatgtaaaaaaacccgggggcaccaattttgtacccatgtcaaggaaacggtcttgcccaatctcttcggcactatttggccattaaagtgcctccgcaatacttctaataggcatccggtgtacgaccttccgtgtgggcaagtcggaagaagatctcttcacgttttaccaaccgacaaccgcgtttatggcaaagatatgcggttcacagcaacagcacatctttgcaaccacgtcggcacttcacttacaacaactgaaaccgctaacttaacgttttgcgtgctcccgccttggactacaagagtttctatacgtttcaaggccgaaaacttttccgggaatcagaatcttgggactataaagtattgttatcgagacacgtgttgacccaaaagcaacggcgctattgtcatcagcacacaagcgggatttccctataaccacaacgcttggtgccgtgttgcgtcgcccgttatatcaccccatatggcgaagagaatatagagttttaactgatataactagagtccgcatcatctagtcggcagccctgtcccagcaacgacaacttctttg

SEQ ID NO: 720547 - DNA, 490 bp, Homo sapiens
gctgcagccccgtgtccccatgctggcttaaatggaccccacgatgctcgtgcggatgtgggtgatggcctgcatcctgtgctccaacgctgtctcttgctgcgccatccagatgctccactcgatcaccgccgatcgcatataccacgtgacattcgacctttagaccgacactgcacagaggtcaccgcgcattactcgcggaacttgacaccggacagggccacacaagagtaagactgacagatccgagttatgcacaccgctacaaccaacacacagaaacaccaacccaccccgcgccgccggcgtcgcaacggcaggccggggccgccggcgcgcgaggggcggaccagggcggcagacggcaggaggagggaagggaagacaaccgagaaccaggggccgcacacggaagaccaccagacgcggagccagcgcagccaaacgacagcgtcgcgaccggcgcccgacggccacgccagcgcca

SEQ ID NO: 720548 - DNA, 638 bp, Homo sapiens
cttcccgtctcagaatctaaacgtggtcaccttcgagtagagaggcccgcccgcccaccgtgggcagtgccacccgcagatgacacgcgctctccaccacccaacccaaaccatgagaatttgcaacaggggaggaaaaaagaaccaaaacttccaaggccctgctttttttcttaaaagtactttaaaaaggaaatttgtttgtattttttatttacattttatatttttgtacatatgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaactttttgtgtatgtacttagctgtactataagtagttggtttgtatgagatggttaaaaaggccaaagataaaaggtttcttttttttccttttttgtctatgaagttgctgtttatttttttggcctgtttgatgtatgtgtgaaacaatgttgtccaacaataaacaggaattttattttgctgagtgttctacaacaacaaaacaaaaaaca

SEQ ID NO: 720549 - DNA, 177 bp, Homo sapiens
accgtcgctgcgccagtgggatttcccatgcggggagatggtggttttgacagaatgcctcctggtcggggtgggcgtccatgcctccatctagaagagattatgatgctatgagccctcgtcgagcaccatctccctctcctcccggacgagttggccggggtggtagcagagctc

SEQ ID NO: 720550 - DNA, 470 bp, Homo sapiens
gcgactacgttatttttgaagcctttatctgcaaagtagtcaggaattacatcgtctgcaaagcggtgtagatgatcataccagactcccacggacatccggcctggctcgtcataccgataacgccgaagctatgtggagcgggctgcgtacattttgtacgttgatgatgattggcgcatggagtattgcttcgcatggggatgccggtgccaatgcattaacgctggcagcaattagctcgtactctactccgccgtcgcagcaccgtttaagtcgttgtcacttctgatgcgcacgtgggtgttactttcgctattcagctttgtggtcaaatttggtctgatggtccagattagcgatctgtggcaatttttactggtttctctttccactgctgggcgacaatgcagcttcttaaattgcagatgccaaatttccgcattgtggggcactgatgttttagggct

SEQ ID NO: 720551 - DNA, 894 bp, Homo sapiens
ggcctggaatcgagcaggccgtttctgccgcgtccaccacaacctctgctgtatcagagggggccttcgccgccgcgacccacagctgcgcaacgcactcgcgactgcgcctggggtcttcctccgcccatacaaccaccatctacacgacactaggccaattgtcccggagaagaagcaatagatccagactacaccagagggagaccggggcgcagaacaatgagcggacaggcgagagccggagagaggagaacaagagagcgacaagcggaggaggaaacaagacaaagacatcaagcagtgacagaacaaagcagcaacccggcgcgagcagggcaggaggacacaagcagacagggccaaaaagcaaacaggagcaaccagaaggccaggatgcacgcacaacgggagaacgaatacacgagcgggggacgcgaggcacggcagcagcacgcgacagaaggccgcaagaggcacaacacagccagatgacaacagagcggaggccagaacggagacacccgggaccaccaaaaggcgacaacgcaagacacgcacacaggagcaagaacgagagagacgaacaggtcaggagaaagcgaggaaccgaaagaagaaggacgcagacaaacagacagagcaaagaggagagacgagcagaccactacggaaaaggcaggagggaaggaagagggcaagagcagaacgggacaagacgacagccggcggcacgagcacgcacgactagggagcgcagggaagggagaaacgaacgaggacggagagcagaccaacgcaaaggagggaggagagacgcaacagaggcagcgaggagagagagaacaagaagggcaagcaagcggaagggagagaggacaaaccagagagggc

SEQ ID NO: 720552 - DNA, 285 bp, Homo sapiens
tggccagacggttctgaactctttattgcccacctagcggctccaaaaatgtggggatacacgggtgtgagcacccacaccgtggcccctttggtcattaagagagacaaggcagcagagataaagatcatgtatgcgggagcaaaacttcgtcatgcaaatcccagctctgtgggaccttgagccattaacccaacctcccgtgggtctcagtgttgccatacagtacaatgggaactaggggtgctaagctcataaggatggtggtcaagatcacatgagata

SEQ ID NO: 720553 - DNA, 575 bp, Homo sapiens
  misc_feature (90)..(90): n is a, c, g, or t
acttgtgatcattccttcctcctgcaggagcttcccagcttggtcacagagtctcctgggcacaggttatccagacccgagccccattcncatctactgacacagggtctccacacgaggcgccagggaatatgggtttttaacaagcgtctcaccaaacactcctctatcatcccgccggagagctggctgggagccctctcgcttcagcacacacatcctccagcagctcagaaacgaccacgactccatcccaaccgagctgccattaacattcatctaaaactcttaggctctacatggacgacaaatcctctcgccatcttaatacccaaataaactccaaactcccgacccaacgacactgcgttataagaggcgtgcgctcccctgctggctgaccacgccagctgccctggccctgcacccctctgcatgccgcacagcagggtgtgaccatgccctcagcaccactctcgtccccactgcacggcacactgcgactgggtcacctgcgagatccctgaacgtgcccttgctgtggttttcaaaatcataacagatttgtattcaca

SEQ ID NO: 720554 - DNA, 246 bp, Homo sapiens
taaatcaagttccgggacccttcccacaggggggttaaaaaattccttgtgcccagagaaacctaccgttttattgggaggagcacactgaattgtaaaacacaggacccagacttttccggggaaggggggcaccaccagggagggccttgaaagaggtgttggttgtttaagcagccacgccttcggtttctttggagccagagcctttgtttaattgggttttttggccttggcctctttggg

SEQ ID NO: 720555 - DNA, 283 bp, Homo sapiens
aagccgacgcctttgacaagagattgagtggagtgatgggagggagagaatggagagaaatacagatggggttaggtgcagaccacaggttcaggggctctgtattacagcatggaaaaagactggcaattactaggtaggggtagcagaactggaacaaggtcttttgtattgtctagttttttaatggaatgggaaggtctagatgaagtttgaagacaggaatataaggagccctaaatgaaggaagaaatgatattactagcaaaggaggtcgcgggtt

SEQ ID NO: 720556 - DNA, 926 bp, Homo sapiens
  misc_feature (11)..(12): n is a, c, g, or t
cggcgtggcgnnttacagctcccctcctttaatgggatcctgggcgctctgtactatgacctgttcgggtgtctttccctatttgtccccctggcacccgcatttgggtgtcccttgttttccccccttctcccgttagtctgtttatgtctcgtcccgatcccccctgttgtgatttcccgtggtaccgtccccgacgctctccagaatgttgttaaattgggccccaccaggtttccgtactcgtgggtaatgcccccccctgttttttttctctgaaggccccttctcgttgcatatacatcctctgggtatcttcctcatgttaattctccggtttcacacaaggcacaaccctctgccgatagaaagtttccaaagtcccctgttgaaacacatgtggtgtcttccaaagcgtcatatgctccctcaattacacagtaattggcaggttgtaccccctctatactttgttgtataaagatgctccccctgtttaacattcttctagaaaagactcccgtacaccctcatcacaatcttctcccacaacgtgatgttaatatctctgttacaacacacaatgggtgtcttacaacattcttttctgacccccaaaatttcgcacgattattttaacacctcctactttcaatactaatatttctgggggcattatttgagtacttcccgtgtacaccaactccgttccattgctgtgttcaccactccgaccaccagccaactgtccaacattcatgcttaccacacgctctgctgttaacccacacccactcgccttaatccttaatgtccagtccaccccacaatacggaacaatcagtcgaaggaaatacgaggttcctagaactaactgtagtgttccacacaaggtaaaaaaaatgtggaaacggcccaacatgaca

SEQ ID NO: 720557 - DNA, 907 bp, Homo sapiens
  misc_feature (22)..(22): n is a, c, g, or t
  misc_feature (96)..(96): n is a, c, g, or t
  misc_feature (106)..(106): n is a, c, g, or t
  misc_feature (113)..(113): n is a, c, g, or t
  misc_feature (121)..(122): n is a, c, g, or t
  misc_feature (135)..(135): n is a, c, g, or t
  misc_feature (152)..(152): n is a, c, g, or t
  misc_feature (196)..(196): n is a, c, g, or t
  misc_feature (203)..(203): n is a, c, g, or t
  misc_feature (238)..(238): n is a, c, g, or t
  misc_feature (240)..(240): n is a, c, g, or t
  misc_feature (275)..(275): n is a, c, g, or t
  misc_feature (290)..(290): n is a, c, g, or t
  misc_feature (303)..(303): n is a, c, g, or t
  misc_feature (314)..(314): n is a, c, g, or t
  misc_feature (331)..(331): n is a, c, g, or t
  misc_feature (343)..(343): n is a, c, g, or t
  misc_feature (347)..(347): n is a, c, g, or t
  misc_feature (372)..(372): n is a, c, g, or t
  misc_feature (376)..(376): n is a, c, g, or t
  misc_feature (386)..(386): n is a, c, g, or t
  misc_feature (388)..(388): n is a, c, g, or t
  misc_feature (403)..(403): n is a, c, g, or t
  misc_feature (405)..(405): n is a, c, g, or t
  misc_feature (415)..(415): n is a, c, g, or t
  misc_feature (430)..(430): n is a, c, g, or t
  misc_feature (432)..(432): n is a, c, g, or t
  misc_feature (434)..(434): n is a, c, g, or t
  misc_feature (448)..(448): n is a, c, g, or t
  misc_feature (452)..(452): n is a, c, g, or t
  misc_feature (526)..(526): n is a, c, g, or t
  misc_feature (564)..(564): n is a, c, g, or t
  misc_feature (581)..(581): n is a, c, g, or t
  misc_feature (596)..(596): n is a, c, g, or t
  misc_feature (623)..(623): n is a, c, g, or t
  misc_feature (636)..(636): n is a, c, g, or t
  misc_feature (661)..(661): n is a, c, g, or t
  misc_feature (670)..(670): n is a, c, g, or t
  misc_feature (684)..(684): n is a, c, g, or t
  misc_feature (773)..(773): n is a, c, g, or t
  misc_feature (800)..(800): n is a, c, g, or t
  misc_feature (818)..(818): n is a, c, g, or t
  misc_feature (842)..(842): n is a, c, g, or t
  misc_feature (906)..(906): n is a, c, g, or t
atgtttcataatagccaaggcntaaaaactacaaaaatatctggctctcgagtgtgggcagctcagtgtgggacctggtctgagtcatgacttggnctgccctgcnggccagnggccgagnngattacctgccantccccaaagaggtccgnggggctgagggggtgaggaagttccttggctgcttccaaagcgngaaggcnaaggctgaggtggagctgggctggagtggttccananaaggcttcatcgatgcccttcaaggctgatggcanatccagggtaggganacgcctggatgtngctgccctggntcaactggctcctggancaaggccctaanccancagtttttttctccaaaaaccctgntggntctcccatancnaagtgggtggagaananccctcctgangctcccagtgcaganananctccacccaaccanagtnatccggaggacctgctggctgcatggctggtgtgatgctgggaggagagctggggatggaggaggatggtaggnaggaacatgcctcagcacagatgggcaggtgggttgancttccctgccctcaggnctgggcaccattggnacccaacagggccgtcttgcggaaganctgcagggttggnttgtgcagcagcgtgtaggccagancccagcttnccctgccgcggctngccccgggcctagctcccttggccatggagtcctttgtctgtagcagctgcatcccttcctcttcctcccctggtctgaggctgtcctngggggctgccatggtcctgggtaggangctctgcgcttgcaggancagggagcagaaggctgtcatggntgggatgcgactggctgacttcaatcttcaagaagtttcggtacgtgtagtagccgggggcgana

SEQ ID NO: 720558 - DNA, 779 bp, Homo sapiens
  misc_feature (170)..(170): n is a, c, g, or t
  misc_feature (172)..(172): n is a, c, g, or t
  misc_feature (179)..(179): n is a, c, g, or t
gggctcgtcgtctgggccgccgagagtcttaatcgcgggcgcttgggccgcatcttagatggcgggagtaagaggaaaacgatgtgaggcgggaacggctttctgctgccttttttgggccccgaaaagggtcagctggccgggctttggggcgcgtgccctgaggcgcngngcgcgtntgctacgatgcgggggctgctcggggctccgatcccctgggtctgggggacgcgcctgaatgtgaccgtgctcccgtttccctcaccctgccgcggggaaggaggagcgggccgaagaagctgcgcgcgaacgacaggactgttggggcggcctggctccctcgaggttaaagaatggtagaagctgcatcaatggagcacaatacagggagcttggaagacggatcagcaagtggttttggattcaaaggatgccgtgttatgatggctccagatgcaatctctcgttagcaatagttcagcagttatggtatacaagcgccgggacatcagatgatggcaaattcatcagatccttctaagacaagcaaactatcgggtattctgtgcgggaacaagcaaagaaacagtgggtcaatgtgcgaaatggaatgagctgcattgagtggcttatgaaagcaactcacggtgaggggcctgaaccaggagtgctgtagaagtgggtaagacttctcaaggaacacaagggtaaaaaagcagctttagattgacatactgatgctgggtccttgattgggaaagacttcaagtaaattctga

SEQ ID NO: 720559 - DNA, 545 bp, Homo sapiens
  misc_feature (170)..(170): n is a, c, g, or t
  misc_feature (172)..(172): n is a, c, g, or t
  misc_feature (179)..(179): n is a, c, g, or t
  misc_feature (262)..(262): n is a, c, g, or t
  misc_feature (309)..(309): n is a, c, g, or t
  misc_feature (315)..(315): n is a, c, g, or t
  misc_feature (322)..(322): n is a, c, g, or t
  misc_feature (347)..(347): n is a, c, g, or t
  misc_feature (399)..(399): n is a, c, g, or t
  misc_feature (421)..(421): n is a, c, g, or t
  misc_feature (450)..(450): n is a, c, g, or t
  misc_feature (457)..(457): n is a, c, g, or t
gggctcgtcgtctgggccgccgagagtcttaatcgcgggcgcttgggccgcatcttagatggcgggagtaagaggaaaacgatgtgaggcgggaacggctttctgctgccttttttgggccccgaaaagggtcagctggccgggctttggggcgcgtgccctgaggcgcngngcgcgtntgctacgatgccgcgcgcgcgctcgccccgcgcgcgcccccgcccccccgcgcgccgcgcgcgacgccgcccgccattgccgnccccccccccccgccccccccccaccccgcgccgccgcgcgacgcgntgcgcnccccccnaccacaccccccccccccccacccnccacccgcgcccccccccgccgcgcccccccccccccccccccccacccccnacacacacacccccctcccaanccccccgcaccccacaccccccccccccncccaccnccccccccccccctcccacaccccccccccccacccccccccctcccccccccctccccccctccacacaccccccctcccccgcccc

SEQ ID NO: 720560 - DNA, 224 bp, Homo sapiens
agagacttctctattacttacttgaacgtattgacctttatgaagaatgcttgtcaggaccattcaacctttaaaaactattctcggtaaggggtatattggcacctggggagcccccaagctgtgtgcctctggcattttctggttcttgtccatgccccggatgatcttctcctcctatgggcttctcgccaatcttgccaacagcttcatctctatctcta

SEQ ID NO: 720561 - DNA, 716 bp, Homo sapiens
tcaaagcaaaagcggccacaggtttattaagacattacgggctcttaagcacagcgggatctataaatcatttcccatatattatcacatattcaggaaagttcctgagaatgatatatcaagacgggcttctctggtgactcaacgggacttcaaatagtctctttagaagtctggagtaatgggtggcacacctatactatcagggcctggccctatttcattccccaagggcaaagtatccacttctcgggagaaaaatccagggtatgaacatgagaaatattcttatttttaatggactggggaagtttggaaaatcactggtcacaggacgggaagatgaaccaatctggacggcttctttcattttttctggaagcaatggccaagatttcggtagtaggatggagggtcagagaagtaacaccggtaaccaagttcattatagctttaatgggcttggggttggtttctgggagcacaagaatctggatggtatatatttaccactccacaattagaaccacaagcaacatacggtccattcctagatgtgggcaaggcttaatccatataaaggggcttcatcaacaaatcggttagggcacttcctgtgagttcacatcccaaagataaacttctccaatccccgcgaagagcggtatacttgcttactatctgacgagatgtgggtgctgcaaccttccataatc

SEQ ID NO: 720562 - DNA, 419 bp, Homo sapiens
  misc_feature (36)..(36): n is a, c, g, or t
ataaagcgctgtcaccttaacggtccttaattgganaaaccctgccgcagaaagaaagcatcccatggcttacctcaaaggaagatcactgtgtggctgggcgcggtggctcatgcctgttatcccagcattttgggaggccgaagcgagcggatcacctgaggtcaggagtctgagaccaggatggccaacatggtgaaaccccatctctactgaaaatgcaagaattagctgggcaagacagcgacactctttatcaaaaaaaaaaaaaaaaattcccgggttgcagggcctcatgcttgtatcctaaccttttgggaggcctgaggtgggcaaaccattagaaacacaggtgtgcagaaccaccctgaccaacttgttgaacccccgttctctataaaaaatataaaattaacccg

SEQ ID NO: 720563 - DNA, 340 bp, Homo sapiens
agatatgaactgtatctatgtttctgatgcacacacgtgtttagacaacagcacatatcattggactgttcctactgtggaagtagctactctttgggcatgctgactgcagtttttcatagccttacggatgagccctttctacgggagtgactccatgcttgtatacagagtatctatacaaatgttttagcatcttcatatgcggtgttaacccctagttctgtacagcatattctgttcaagtatttttttacaagctttggctgtaggcacatgccttctgccctggaactcgtgcaggtacgtagtagctggtactgtcacaacggctacacca

SEQ ID NO: 720564 - DNA, 490 bp, Homo sapiens
gtgaccgggaggatgataacttcctctctgggctcaggctctgaaactcaattatcaacatttactattgcatctggtagtgtctctaccagctttattaatagcagtcgcagtataccaggcatgaatcttggctgacagttggaatctgattttaatgggctgctactcccttggttccttcaattctgattttgggatatatatgaggcacaatgatgtcactgtgtatcaaccatacaatgtcagggttggggttacccgtagctctgactttcatttcaagtcgggaaccttcctttatattgacatttttcagtttttctacaaacatcggttttacctgatgtaccacagcttccacagttaaaatcactgaaatagaagatctgcctgccctgtttggggcaaccacagtccatacaccagaatcactgggtgtggcagggacaatatttagtgattgagtaccatcttctttaatgactac

SEQ ID NO: 720565 - DNA, 840 bp, Homo sapiens
  misc_feature (2)..(2): n is a, c, g, or t
  misc_feature (82)..(82): n is a, c, g, or t
  misc_feature (136)..(139): n is a, c, g, or t
  misc_feature (154)..(154): n is a, c, g, or t
  misc_feature (193)..(193): n is a, c, g, or t
  misc_feature (195)..(196): n is a, c, g, or t
  misc_feature (199)..(199): n is a, c, g, or t
  misc_feature (204)..(204): n is a, c, g, or t
  misc_feature (208)..(208): n is a, c, g, or t
  misc_feature (211)..(211): n is a, c, g, or t
  misc_feature (214)..(216): n is a, c, g, or t
  misc_feature (219)..(219): n is a, c, g, or t
  misc_feature (221)..(222): n is a, c, g, or t
  misc_feature (226)..(226): n is a, c, g, or t
  misc_feature (237)..(237): n is a, c, g, or t
  misc_feature (254)..(254): n is a, c, g, or t
  misc_feature (259)..(259): n is a, c, g, or t
  misc_feature (261)..(264): n is a, c, g, or t
  misc_feature (282)..(282): n is a, c, g, or t
  misc_feature (290)..(290): n is a, c, g, or t
  misc_feature (296)..(296): n is a, c, g, or t
  misc_feature (300)..(300): n is a, c, g, or t
  misc_feature (306)..(306): n is a, c, g, or t
  misc_feature (315)..(315): n is a, c, g, or t
  misc_feature (322)..(324): n is a, c, g, or t
  misc_feature (333)..(333): n is a, c, g, or t
  misc_feature (337)..(337): n is a, c, g, or t
  misc_feature (341)..(341): n is a, c, g, or t
  misc_feature (343)..(344): n is a, c, g, or t
  misc_feature (363)..(363): n is a, c, g, or t
  misc_feature (367)..(367): n is a, c, g, or t
  misc_feature (372)..(372): n is a, c, g, or t
  misc_feature (377)..(377): n is a, c, g, or t
  misc_feature (389)..(389): n is a, c, g, or t
  misc_feature (394)..(394): n is a, c, g, or t
  misc_feature (396)..(396): n is a, c, g, or t
  misc_feature (411)..(411): n is a, c, g, or t
  misc_feature (427)..(427): n is a, c, g, or t
  misc_feature (433)..(433): n is a, c, g, or t
  misc_feature (446)..(446): n is a, c, g, or t
  misc_feature (491)..(491): n is a, c, g, or t
  misc_feature (507)..(507): n is a, c, g, or t
  misc_feature (627)..(627): n is a, c, g, or t
  misc_feature (647)..(647): n is a, c, g, or t
  misc_feature (667)..(667): n is a, c, g, or t
  misc_feature (672)..(672): n is a, c, g, or t
  misc_feature (682)..(682): n is a, c, g, or t
  misc_feature (691)..(693): n is a, c, g, or t
  misc_feature (776)..(776): n is a, c, g, or t
  misc_feature (832)..(832): n is a, c, g, or t
tnaagcaaataaaataaaataataatactagagtaatactaaaaatataaaaatgcgactccagacattagcttaatctgtnaacatgataaaccctgtaaacatacatttactacattattgtcccagtgtcaannnntatctagtaaaggcnagtgctatacacttcatttagttcttcaaggcatatttngnnatnctgcnttgnggntcnnnaangnntgcngaaggcattcntctaactacactaaaanatganannnngatgactatcccaatggncaacaggntatgcnggcnagaganaggctttantactttnnncccattgcnaatntgantnngcttcacatgtcttatganccanctgtntagtnaaactgcatatnaacanangccaaatacttcganagtgaagaagtaaacngttttnctgtgagtcagtnggctagaaatataggtaacacactttccaaagttttttcccaaanatctaggcagtaaggngcataaggcaggtctacaaaataataaatagctgcgagtagcactaaatatattgtagtttactcaatagtaaagtatttctttttccaaatttcagttttccatctcaaaatgcatcanacttttcacacatgacacgnatcacaaatatttcacagtnatcanctcagtcgtntaagcacannnctgcctggcagatactatacaagaggtaaatgttaaggacaaaattcactatttaagtcatacaggacttatatcctattgtntgaactctaaagccaggtgtgggtggtgcctggctttaggcaggcacctaactctnaagacaga

SEQ ID NO: 720566 - DNA, 168 bp, Homo sapiens
cgcctcgacagttcacagaggtctttcagctcatttaatcccaggaaagaggcatcaagctagaatgtgatatacttttgtggaccatactagatacagagccagtggtgaggaagtgcgttctccagcactgcctctgtttttctcctctcatgtcctcaggaaatg

SEQ ID NO: 720567 - DNA, 159 bp, Homo sapiens
gctaaggcacgtattatgctgttaactgcccgctgcgagacgcgattgatgacgagtgctatgaggccattttcaagccgggcatgctgaaagaactggagacggccgagcatagcgcgtgaccatcacagtgacacgcacactcgctatatggctgac

SEQ ID NO: 720568 - DNA, 250 bp, Homo sapiens
cgcgtaagtgaacaccatcacaggccgcaggggccttgatcccatgataacacatcaacacccgtggcggggctacgtgaggactaccagcactgaatgaggagagaggcccatgcagcagattagatccgaagcttgaactaccacaaccacctcgaccgctgattgagtcgaatcccgtggccgagccttatccggtccaggcactgggcgggattcttgggcctgcggtcgagcgcatggccgaggt

SEQ ID NO: 720569 - DNA, 183 bp, Homo sapiens
ccccaaaaaaaaaaaaaaaaaaatttagtggggggggggggggcaggcctggggtccccgctccttgggggggtggggggggccaattgcttgggcctggggggtcagggttccggggggccaaagattgggccccgtgccccccaggtttgggcgccccagaggggggttccgtgtcccaca

SEQ ID NO: 720570 - DNA, 940 bp, Homo sapiens
  misc_feature (5)..(5): n is a, c, g, or t
  misc_feature (7)..(7): n is a, c, g, or t
  misc_feature (39)..(39): n is a, c, g, or t
  misc_feature (68)..(68): n is a, c, g, or t
  misc_feature (75)..(75): n is a, c, g, or t
  misc_feature (92)..(92): n is a, c, g, or t
  misc_feature (109)..(109): n is a, c, g, or t
  misc_feature (149)..(149): n is a, c, g, or t
  misc_feature (158)..(158): n is a, c, g, or t
  misc_feature (161)..(161): n is a, c, g, or t
  misc_feature (164)..(165): n is a, c, g, or t
  misc_feature (180)..(180): n is a, c, g, or t
  misc_feature (194)..(194): n is a, c, g, or t
  misc_feature (206)..(206): n is a, c, g, or t
  misc_feature (208)..(208): n is a, c, g, or t
  misc_feature (221)..(222): n is a, c, g, or t
  misc_feature (224)..(224): n is a, c, g, or t
  misc_feature (230)..(231): n is a, c, g, or t
  misc_feature (245)..(245): n is a, c, g, or t
  misc_feature (253)..(253): n is a, c, g, or t
  misc_feature (270)..(271): n is a, c, g, or t
  misc_feature (288)..(288): n is a, c, g, or t
  misc_feature (291)..(291): n is a, c, g, or t
  misc_feature (294)..(294): n is a, c, g, or t
  misc_feature (299)..(300): n is a, c, g, or t
  misc_feature (311)..(311): n is a, c, g, or t
  misc_feature (321)..(321): n is a, c, g, or t
  misc_feature (323)..(324): n is a, c, g, or t
  misc_feature (328)..(328): n is a, c, g, or t
  misc_feature (330)..(331): n is a, c, g, or t
  misc_feature (393)..(393): n is a, c, g, or t
  misc_feature (405)..(406): n is a, c, g, or t
  misc_feature (408)..(409): n is a, c, g, or t
  misc_feature (414)..(415): n is a, c, g, or t
  misc_feature (435)..(435): n is a, c, g, or t
  misc_feature (441)..(441): n is a, c, g, or t
  misc_feature (446)..(446): n is a, c, g, or t
  misc_feature (449)..(449): n is a, c, g, or t
  misc_feature (457)..(457): n is a, c, g, or t
  misc_feature (485)..(485): n is a, c, g, or t
  misc_feature (501)..(501): n is a, c, g, or t
  misc_feature (526)..(526): n is a, c, g, or t
  misc_feature (530)..(531): n is a, c, g, or t
  misc_feature (540)..(540): n is a, c, g, or t
  misc_feature (546)..(546): n is a, c, g, or t
  misc_feature (551)..(551): n is a, c, g, or t
  misc_feature (559)..(559): n is a, c, g, or t
  misc_feature (569)..(569): n is a, c, g, or t
  misc_feature (571)..(571): n is a, c, g, or t
  misc_feature (582)..(582): n is a, c, g, or t
  misc_feature (643)..(643): n is a, c, g, or t
  misc_feature (713)..(713): n is a, c, g, or t
  misc_feature (832)..(832): n is a, c, g, or t
  misc_feature (842)..(842): n is a, c, g, or t
  misc_feature (932)..(932): n is a, c, g, or t
gaatntncggattgctattggactttggagcgtatggcnccaaatcaactcattggctaaaacttganggaaaanggtggttaagtggccanaatggatttgtggccangggcatggatgctgctgctgctgctcttcctgctgctgcncttcctgcngcncannctgtggttctgcagncccaatgacacaantacttcttcaananggccttctacaanngntggatnntcttcctggctgtnctcgccanccctgtgtagtgccgtnngaggacgcaacgtcganatnatnaaaannttgcgtctaangctgctccanannaaananntgtacgggatccgagtggaggtgcgaggggctcaccacttccctccctcgcagccctatgtngttgtctccaannannaaaannctctcgatctgcttgggatnatggangtacngcnaggccgcngtgtgcccattgccaaaagcgagcaaangtgggctggctctgcngggctggcctgctggctggcaggantaannttcatcgancggaanagcangggggatnccatcagatntnatgtctgaggncgcccagaccctgctcacccaggacgtgagggtctgggtgtttcctgagggaacgagaaancacaatggctccatgctgcccttcaaacgtggcgccttccatcttgcagtgcaggcccaggttcccattntccccatagtcatgtcctcctaccaagacttctactgcaacaaggagcgtcgcttcacctcgggacaatgtcaggtgcgggtgctgcccccagtgcccacggaagggctgacaccagangacgtcccanctctggctgacagagtccggcactccatgctcactgttttccgggaaatctccactgatggccgggggtggtggtgactatctgaagaancctggggg

SEQ ID NO: 720571 - DNA, 487 bp, Homo sapiens
ccagtgagaggcaggcttcaagcttgcttagggggtgaattaggtgccttatcagacactgcatctccaaccaggggtcgatgccaaatgctctagttctttcgtggacacaagaaaagtccataaagagaaggggttctccatatacactctgtgaatcacctagtaaaactatgaaaatatcctgatcgcccagactcccactacagacactgactgtcagacagtatgggagtacatacctgggtctcccagtgttaattctacttatgcagacaaggtattgcgaaccacatgcccatagttagaacgaaatctgcagccttgacctgatagtttccgtgcccccgtacacgttctgaacaggcacgttccatcttgcagcagctcagacgcagcacataaacacagtgcagacggcctttcacctgacagtgatgaactactccacatgttcaaccatcttcaacagtcaagtagaaccacc

SEQ ID NO: 720572 - DNA, 474 bp, Homo sapiens
gcaaaattaacccctaataaaattacattaagccactcattcatcgagctccccaccccatgcaacatctccgcatgatgaaacttcggcgtcacatccttgtgcgcactgccgtggatccggtcacaagagttcaccgaacagagcactagttacctagaccaatgcacatacgtcaaccagacgcgctcaaccgcgcttttcatcacatcgcacgccaccaatcgacaatcgggaagcacccgttgcacacagtttcaattggggcattggcacattccaattctccggacggttaaccctttttctacggtccccaaaatagggcggcccattccaaaatcatttcctgtttcatacatgggcccttcattccttaggcaacgaatccgggggaccgaaagaggcccccttcaattattttcaacgggagaattccaattaattttacctttccgttaaaccatttccgaa

SEQ ID NO: 720573 - DNA, 318 bp, Homo sapiens
tacgaaatgcctcagcctcccaatgtagctgagtacaggcttgtcgcaccacgcctggtaattttgtattttagtagagacaggtttctccatgttggtcaggctggtcttgagctccagatctcaggtgatcctcttgcctctggctcccaaagtgctgggattataggcatgagccaccacgcccagccagcttgcattgtatttctttcttggacattgggagacggattgtgccctctgttgctcacggtgaatgtgcaatgggacagatcttgtgatcaccagaacctccgactcccgcgttcaagcaattct

SEQ ID NO: 720574 - DNA, 213 bp, Homo sapiens
taaagtgagtaaaagatctctgagccaggtgcggtgcaatgcgcctatagtcgcagccactggggaggctaaggcaggaggatctcttgagcccaggagttcaaggttgcagcaagctatgatcactccactgcactctagcctgggtgacagagcaagaccctgtctccgaaaataaaaaataagaataaaaagatctctgggatagcacta

SEQ ID NO: 720575 - DNA, 1599 bp, Homo sapiens
  misc_feature (156)..(156): n is a, c, g, or t
  misc_feature (208)..(208): n is a, c, g, or t
ctgtgtgctgctgagctgagctggggcgcggtcgcctgtctgcaccggcagcaccatgtcgctcatggtcatcatcatggcgtgtgttgggttcttcttgctgcagggggcctggccacaggagggagtccacagaaaaccttccttcctggcccncccaggtcacctggtgaaatcagaagagacagtcatcctgcaatgttggtcngatgtcatgtttgagcacttccttctgcacagagaggggaagtttaacgacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcaagcatcaacggaacattccaggccgactttcctctgggccctgccacccacggagggacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctccctcttaacacagcacttagacacgtgctgttccaccttcctctcagtgctatcttccagccttctgccagcagtaaaacttataaattttttaaataatttcaatgtagttttcccgccttcaaataaacatgtctgccctcatgg

SEQ ID NO: 720576 - DNA, 309 bp, Homo sapiens
aagccattctacctatgaaataatatatgaaagaggtgtaatgaatggaggtagtgaacaagacgaagtaaactgagaggtcagtgagggagacaggagccagatagtgttgggtttcatggatcattgtaaagatttcagatttattctgatttcacttggaatccattggaggatttaaaataagggagcaatattatctgttttacttttccataagtcacttcagctgccactggagagtcaactacggggaaagaaggacaaagtggaaactattgaagtatccagatgagaaaggggctttgg

SEQ ID NO: 720577 - DNA, 284 bp, Homo sapiens
aaaaggggggggggggggggggggggggggtttttttaaccaaccttttttttttcaccccccgttttcgggggggccccccccccccttttttttctcccctttaaaaacccgggggggttccccccccccggttttttttttgggcgggggggggggttttttttttccccggggaaccgttttcccccttggccctttctcaaaaattttttttttgccccttttaggggggccccccggggggggggccgggtttttcggggggcccccccggggcccca

SEQ ID NO: 720578 - DNA, 1503 bp, Homo sapiens
  misc_feature (156)..(156): n is a, c, g, or t
  misc_feature (208)..(208): n is a, c, g, or t
ctgtgtgctgctgagctgagctggggcgcggtcgcctgtctgcaccggcagcaccatgtcgctcatggtcatcatcatggcgtgtgttgggttcttcttgctgcagggggcctggccacaggagggagtccacagaaaaccttccttcctggcccncccaggtcacctggtgaaatcagaagagacagtcatcctgcaatgttggtcngatgtcatgtttgagcacttccttctgcacagagagggaacctacagatgctacggttctgttcctcactccccctatcagttgtcagctcccagtgaccctctggacatggtgatcataggtctatatgagaaaccttctctctcagcccagccgggccccacggttcaggcaggagagaatgtgaccttgtcctgcagctcccggagctcctatgacatgtaccatctatccagggaaggggaggcccatgaacgtaggctccctgcagtgcgcaagcatcaacggaacattccaggccgactttcctctgggccctgccacccacggagggacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctccctcttaacacagcacttagacacgtgctgttccaccttcctctcagtgctatcttccagccttctgccagcagtaaaacttataaattttttaaataatttcaatgtagttttcccgccttcaaataaacatgtctgccctcatgg

SEQ ID NO: 720579 - DNA, 1488 bp, Homo sapiens
  misc_feature (156)..(156): n is a, c, g, or t
  misc_feature (208)..(208): n is a, c, g, or t
ctgtgtgctgctgagctgagctggggcgcggtcgcctgtctgcaccggcagcaccatgtcgctcatggtcatcatcatggcgtgtgttgggttcttcttgctgcagggggcctggccacaggagggagtccacagaaaaccttccttcctggcccncccaggtcacctggtgaaatcagaagagacagtcatcctgcaatgttggtcngatgtcatgtttgagcacttccttctgcacagagaggggaagtttaacgacactttgcacctcattggagagcaccatgatggggtttccaaggccaacttctccattggtcccatgatgcctgtccttgcaggaacctacagatgctacggttctgttcctcactccccctatcagttgtcagctcccaggagctcctatgacatgtaccatctatccagggaaggggaggcccatgaacgtaggctccctgcagtgcgcaagcatcaacggaacattccaggccgactttcctctgggccctgccacccacggagggacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctccctcttaacacagcacttagacacgtgctgttccaccttcctctcagtgctatcttccagccttctgccagcagtaaaacttataaattttttaaataatttcaatgtagttttcccgccttcaaataaacatgtctgccctcatgg

SEQ ID NO: 720580 - DNA, 732 bp, Homo sapiens
tccgggattgctgctgtcgggggcccgcaccttccgtctggcgccgcccagtggttcctacgggagggcctgctccttcacctgccctgtgccgcctccaccttcagcctgctcttcactgcagtggtgagcgctttgccaccatggtgcggccgtgtggcctgagagctggggccaccaagaccagccgcgtatacggcttcatcggcctctgctggctgctgttccgcgcatgcatggaggatagaatgacatttgactggcgctggaactgccctgtgcagcctttgacctgaagatccagactatctgcccatctaatccaagcgcatacatcctcttactgcctggttgactcttcagacggcgtcacatggacacacatcactggaccatcctactgggcgacatccttccgactgagtagcagaggccacacgacacaagaaagagccaccaaagcaacaagcatagaacctaccagacaatagcaagacctgacaatgactgaaacaacgtgcatgcatgaaatgcagacacacgcacagaagacaaaaacaaaagagacacaaaatccatgcaagccatcccaaaacaactaaacaaacaagcccagaatggacccagacagtcaacacagcaataacagaacaaccaaagagaacacagagaacaaaaacattgcacatggacaaaatccacacaagcaatcacagagcaaaacaaaacaaa

SEQ ID NO: 720581 - DNA, 601 bp, Homo sapiens
  misc_feature (427)..(427): n is a, c, g, or t
gcttaagacagtgtaaatggttcgaatcacacacattttaagattccattgtatacataagcattttaagaatattgttttaacataattattaggcatactaagttatcatgaatgaaaatgtacatgtgacctgtagtatgttatatattattatggctaaatgttaaatgccatttttttgctttttagttttatgtatttttgcatgtatatacccacatttttacattgatttatgttctaaataataattaaaacacagtattataaaatgaatgaaatatttttgtgttccatggtcaaataattaataaattcaggaaataaaatctgatgataaatctgatataaataccagattaattatcattaatataaaataatattttcacatatgatggaatgtctccatactacaggattnctgacttgaataatatctaataggctttaattcattaccataccaaatgtccttaggaatcaatgtggcattttaaggaattcccaatttttgaaaattggtttttccatgtgtccctaatatccctttagctttaataaagcctatttttttggttttggaaatggagtggaa

SEQ ID NO: 720582 - DNA, 1832 bp, Homo sapiens
  misc_feature (175)..(175): n is a, c, g, or t
  misc_feature (203)..(203): n is a, c, g, or t
  misc_feature (265)..(265): n is a, c, g, or t
  misc_feature (1069)..(1069): n is a, c, g, or t
ggtcggcgcgagcttgtggggcgcgcggctcctaggggccggggcgctgaggccgggggaggcaggtgtccagagcccatcgaggggtggcgggtcttgacgtgctggccctggtaggggctacgctgcaattcctctcatcccataagcgctggggcccggggagacaacatantacggtgctactgttacacttgtagcgnccatcatcgaatggcatggagacgcacagtagaggccgatattcggggcgatgtactgaggntcgtagagcgggcagctccacggccgcaaaggacccacctcgaagacgaaatgtacagccatggactactcgagtacctgggtaggggacgccacgaagcggcgcatgagatcgcatgagtccgtgggtaacgtttgccaagcgaccaggttgttcgacacgtggccaggcaagggctcgacgcgtgggcgtgccctggatgaactctggaggcttagccggcgcaacttgaggcgcatcagcgtccctaacagatggcaccgctagtctgtagaacagacggggggagataggctgcagtggtttcccccgtaccttggacaccagatcttggcaccgtgcatatttctgcttgaagacggtcggaccgcaaaggaaaaccggaggttccaggctgtgggggctttccgaacttgaggggtccgctccgcgagggggcgaacttttcccaccaccaggcgccctggcatacccttgtgtttcggccgacagggcttgggcgcctggaaagtgttggattccggggcccttagatggggcttatgttccgtgtccggcaagccctggagaagaccgttgggtgggtataccccaacgacgaaggctcgccacggtggataggtctgggcggcgcgggcttggtggggccaacccacttttccgtgcccaattccgttcaccggcgcttgccagaggggccttcgaagaacgggtgctggtcaccctggggttgggttctcccccatcgccaggataaggggggccgccaatgagcagccaggttcacaccctttgggggagtgnttcggtcctgtcacggcggcgacgcgggggccaccggttccttgtacagaagcgttctggtctcccgtatagcgcattcgcgggggggctaggagagctgggtcccgcctcggtgtgagatcgctcgcggacagctggcggggccttccgttcggacagcggtctgggcgcgtttcgtgttacgcccacgctgagtgcagaggctggcattgacacacccgcaccgcgtcgcggttgcacaccgggggccgcactttccatctgggtggttttccctctggggacgccttcgctaccggggctggcccctagcgtgttttgcgctggctgtggccgccggtactcccggtgcggcaccttcgggggggaaaccagggcggaggtggactgcggcgggccccacggcacaggcgggggggtcaaaaccacggcggcgagcggcgagcaacggggcggcgacaaaccactggcgagaaccgtgctctgcgacgacgacccaactgcgagagcacgatagaaacgtcggtgtacatcaggagacccgcccaaaggaatgggcgcgtccggcagaaagacttcaccacgggcgctgcgagccacatggtcttgctccacaagggcgggcgtagccagcgagcgcgcacaaccaagcagctgactgttcgcaaccccacgggaattgtctcagactcgacacaacagacagacggaccagcacacacagaggacatcgctatgggtggagaccacagactaacaagat

SEQ ID NO: 720583 - DNA, 1440 bp, Homo sapiens
  misc_feature (156)..(156): n is a, c, g, or t
  misc_feature (208)..(208): n is a, c, g, or t
ctgtgtgctgctgagctgagctggggcgcggtcgcctgtctgcaccggcagcaccatgtcgctcatggtcatcatcatggcgtgtgttgggttcttcttgctgcagggggcctggccacaggagggagtccacagaaaaccttccttcctggcccncccaggtcacctggtgaaatcagaagagacagtcatcctgcaatgttggtcngatgtcatgtttgagcacttccttctgcacagagaggggaagtttaacgacactttgcacctcattggagagcaccatgatggggtttccaaggccaacttctccattggtcccatgatgcctgtccttgcaggaacctacagatgctacggttctgttcctcactccccctatcagttgtcagctcccagtgaccctctggacatggtgatcataggtcaacggaacattccaggccgactttcctctgggccctgccacccacggagggacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctccctcttaacacagcacttagacacgtgctgttccaccttcctctcagtgctatcttccagccttctgccagcagtaaaacttataaattttttaaataatttcaatgtagttttcccgccttcaaataaacatgtctgccctcatgg

SEQ ID NO: 720584 - DNA, 1305 bp, Homo sapiens
  misc_feature (156)..(156): n is a, c, g, or t
  misc_feature (208)..(208): n is a, c, g, or t
ctgtgtgctgctgagctgagctggggcgcggtcgcctgtctgcaccggcagcaccatgtcgctcatggtcatcatcatggcgtgtgttgggttcttcttgctgcagggggcctggccacaggagggagtccacagaaaaccttccttcctggcccncccaggtcacctggtgaaatcagaagagacagtcatcctgcaatgttggtcngatgtcatgtttgagcacttccttctgcacagagaggggaagtttaacgacactttgcacctcattggagagcaccatgatggggtttccaaggccaacttctccattggtcccatgatgcctgtccttgcaagggacctacagatgcttcggctctttccgtgactctccatacgagtggtcaaactcgagtgacccactgcttgtttctgtcacaggaaacccttcaaatagttggccttcacccactgaaccaagctccaaaaccggtaaccccagacacctacatgttctgattgggacctcagtggtcaaaatccctttcaccatcctcctcttctttctccttcatcgctggtgctccgacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctccctcttaacacagcacttagacacgtgctgttccaccttcctctcagtgctatcttccagccttctgccagcagtaaaacttataaattttttaaataatttcaatgtagttttcccgccttcaaataaacatgtctgccctcatgg

SEQ ID NO: 720585 - DNA, 600 bp, Homo sapiens
tctacctgatctacctagatgcaaagctcctttcgcgaggtctcggctggttcctctcacgatcaaggactccgctccagagcatcatagagtacgtaataagcgtgtgaacttgtctgatcttctggaaagtttgcttaaatgcaaatgaaaatgagagagacgggaaggaaaaatcattgaaaaaattcatggacggctgcaggagcctacctgaaaagtcacagcaccaggtcataaaagtaacacaagcttgggacatcctcagggggcacctggagagatagactgctctaagctcagataaacgagcagagtagtgggagagtctcgacttcatactcctaggttgggtcccaaggggaatactgtgagacttaataggtacattcgctttccgtggaggccacgaagatacggaagctgagagagctttaccaggaagggtggggggatgcctgccgctgcaagaaaatgtctgggaacagacacagaaacttaagcgacacaaagcagcacagagcagcataaactagaagcctgcttatgtgatcagggaattgggtaaaggctgttaggaactctgctctatgccgatag

SEQ ID NO: 720586 - DNA, 662 bp, Homo sapiens
  misc_feature (150)..(150): n is a, c, g, or t
  misc_feature (380)..(381): n is a, c, g, or t
gatggcattggggtgatgttaccccaggtgcttaaaggtatgacttcagagtctgattccattgggttgacaccaggagagaaaagtgaattggccctctctgctctaggtggttgtgtcttctacctcaaaaaatggctttattttggnatcacggagcttttatcaatggctaattttgaagaatatattcccttggattctgacacagtcagcactacaagatctggtgctatcttcaccaaagcctatcaacgaatggtgctagatgcagtgaccattttaaaaaaaaaccaaaaacttggagatttttctgaatggaacaaatggttctactgaaggaaccctactagagaggcgttggatactttgccatactnnccttttttggtaaggcggctccttaaagcaaatggctttgtgccccactctgtaaccatttatggctattaatgatcgtctagatgccatagaagacctcatggttgtggccccttggaaccaaaaaaataaaaaattttcccttccccgaagttgtagagcttctaaagaagcttccagatcttgagaggctactcagtacaattcataatgttgggtctcccccctgaaagggaagtcagaaaaccaacccaagacagcagggctataactgtcctgag

SEQ ID NO: 720587 - DNA, 494 bp, Homo sapiens
cacgagggacgagcgtttcgctcggcaagggcaaatcgttcgtactcagcgattcctcgctggccggcaaggcgtgaggagtctcgcgaactcgcgttgttagttgagttgcgacgcccccggagctgatccgggggcgttgtgcggatgccgggttcacgccgccccaggaggcccccggttcggccggtacctcaggtcttggggtacttggtgaagatcgcggccaccgcgtccttgatcttcttgtcagccttgtcgccggtcacgccattcaggttctggtccacggaggcatgccagatggcctgtttggttttgccgtcgtagatatccacgccgatgattccttcctggtaggcgtacgggtaatcccagccccaggcgccgtaaccaccccagccgccgtggcgccagccatagccatagccccaaccgtaaccaccatagaagccgggataaccgtccaccacgtttcgctgaccgatgccgta

SEQ ID NO: 720588 - DNA, 113 bp, Homo sapiens
  misc_feature (70)..(70): n is a, c, g, or t
  misc_feature (102)..(103): n is a, c, g, or t
tgagccggtacccttatgtctgaccacaatggaagcagctggcttcactgctcaggtgattatcctgaancattcaaggcaaataagcgccggctatgcccnnctgtattgga

SEQ ID NO: 720589 - DNA, 190 bp, Homo sapiens
ccaacggatttgccgatcgtgttccccattgtcgtggcctcagctaattggggcacgctattctgcgagcagctagttgtgtgtaccatactctactcccaaactatctgggcggaggccccgtggtgatgtcacatatggctagaacatgtatctcatataccaccgaatgtgatcatttatgggtgcg

SEQ ID NO: 720590 - DNA, 464 bp, Homo sapiens
gaaattctgatctttgatttccagctgccagattgtgctaccagtgagtttcctcacaatttacttttttctcaagcttaattgaagttttagaaaatgaaataatgtctggatgaaactcgatgacatttggcagttttatgaagtgggacacgtggaaatgtcctgtggcaagagatccatcaagaaagaatgcattctcctttgggacagaagggaaaacaaatgcagactttaaagcacttgacgattttcaggcagactcatcactgctggagaagctgctggggagaggaaagtgtgatacttcccagtctagactagtgatgaaaactagaattcaggatttaaaactattattatcccaggaggtgcttttgggggaaaaggctacagaggcaagtccccgaaggcactgagcttcccttctgttctgtattaggttgtgatttaacagtacttgg

SEQ ID NO: 720591 - DNA, 611 bp, Homo sapiens
gtaggatcataccatggtctaaggaggtaaaaattattaaggatatcaatactaagggccagtatcactctaatataatagggatcagagcattaatttgggggaggaaaccaggggggattaccggcatttaattaaacttaaaactttgtagaaggcaaccaaaatggttcttgggagaaaatcaacttttagattaaaaaaattttaggtatctaggagtatttaaatccttttcccataaataaaggtccagttttcttgggggcagaatgaaaatcagcaacttctagcatatagactatataatcagattgccagcttatggaatatattatcagccaggatgaggaggtccaaaggttactatggctcataaggacttacaggctaaaattagttttaaaatactatattaaatcctgaaggcaattttttttggttcccttgagacctttaggttaacggttgctggcaggctaggtgtaaatgttaacagcaggagaagttaggaatggagcagttctgttgcttgatttcccaaatgaaatactgccttgcctagagtttgtaggggtttcaaggtattggagttccaggattccctccct

SEQ ID NO: 720592 - DNA, 596 bp, Homo sapiens
  misc_feature (49)..(49): n is a, c, g, or t
  misc_feature (55)..(55): n is a, c, g, or t
cccccataaggatttccaatggctggcattttttattggtcccttttcnataccngatatgtttagattccacagacaccactgtgttacaactgcctacaggtattcaggtacagttagcatgctgtataggtttgcagcctacgaacaacaggctgtaccatatagccttgcagcctacgaacaacaggctgtaccatatagcctaagtgtgtggtaggctataccatccaggtttgcgtagatgaaccctatgatgctctcacaatgatgaaatcacctaacaatgcatgtttcagaatgtatccctgttgttaaatcatgtgttaagtaacacatgatggtgataacatcaagtgctgatgagaatgtgaagaaactgatcactcaaacatagctggtgggaaagtaaatggtacagccactgtggaaaacagcgtggcagtttcttagcaaactaaacatacacttaccatatgacccagcaaccgtccacgcaaaatgcgtgcatgtaaaacggtgaaatctgcgtcagctcactgtcaatgtcctggctctttatcgtatcctagtgttgtaaaatctcgtgccgaatt

SEQ ID NO: 720593 - DNA, 1784 bp, Homo sapiens
  misc_feature (190)..(190): n is a, c, g, or t
gagtgtgtgctacccggtcgccgcatattttttgttcctcccccgacgtgacgggtgtggaacgtttgtcgttgctctctcctgcgatgtggggacacggttgttgtcatgccgtaataagctgcggtttggttctctatctgtcttagattggagaggtgtgttctgtgtgatcagtcattcactcgangcgggaggagtgatgcatctgttgcctcctgtctttagaaaggaggtgtgggtcccgtcaatctatctctgctgctggcgagaaagtatgtgtgtggtggggttgtgggctcgtccaccgttgtgggtatgtcactatctctctctccttcttcactcgtcgggtcccgaccgacgttgagtggttgtctcctacattattgttttggtttgtgtggttcaccccaacctaccgccgcccgagcgagatgcaccccgaccgcaacgaagagagtgttgtttctgtcttgtagtggtgtagaaggaaaaagaggagccgccgcgccgcagcggcggatttcttcgtcggggcacatatcagtaggcacgtttctctcgttggtttgtctttctcctcgaaagagagaggaggagtgtttgttgcgcgtttttcctcacccaaagagaagcgcgcaacagatagttttgttaggatgagtcggcttcttgtttatatattatgggtcgtgagaacaaaagtagagtggtcgcccccccaccactatgatgaaggagagttgtgttgtgttgttgtcgccccccactgtttgcgttcaccacgcagcgcccggtagtagtggttcttttgtgctcttgtggggtcgtttccgcatctacaccctgcttctctgcatgaggaggagaggggcgtcgtcgtcttctgctactgctccgcatcatgcagaggaggagcccacgccttctgcttgtatgttgtgctgtgctgtggtcctctccccggggcagtggtctcctctcctctgctgcgcagagagcagtgtgggggtcgaccccacacacagccagcgcgcttctgcgcagcagcgcgttgtgctttgtgtgatgtgtttgctgtgtgaggataacttctctctgctggggcagacaccagcagcaggggggggacgattactactacacgctcggcggagtagagtgttgtgtgtgtgagtaggggcgcacgcgtgcagggaggagtgcccccaccctgcgcgaggagagaactccactcgcgtgttgtatattatcatattatagtacgcggtgtgagacatcacgcgtcgcgtgtgtgtgcgctcacacacgcgcgtgtgtgtgggcgcacagcacacacacgcgcgcgtgtctgtgtgtggcgcatcacatcatcagagcgtgtgagagacatacacactgtagtgtgtctctcagctgtgggagacacaccacacacagtggagagagagagagtgtgcgacacctctgagagagagacacacctctctctctctgcgcacaccaccgctgagagacaccagttgtggtgacacacaccacacaagaagagaaatatctctgcgccccaccacccccccgtcttctccggcacacacaaagaggggggagacaccacacaaacccacccagcccacacgcgcccccaccccactcctccccccgcgcacaacatcacaagggtttctctcttgtgcccacccgatttttgtggaggcctgcggaagtcctttttttaaacacccctttataaaaattgtgttccacaaacacaccacaca

SEQ ID NO: 720594 - DNA, 425 bp, Homo sapiens
ctgtcctgagcaccaggaaaaccctaaggcctgtctgagtagcagcccagtttcagagagctcttccaagctctcccccacggaatcaataagagcttgttgcatgctctaggaaagtcgcatcacaccctatgactgcaaaagagaccctgtcctctcttccaccctaagaataagaacccacttctccagcctcatcttgttcctgacaagacgggcttggcccataggcaaactcagagacctggctcttcacctttcacagggccttctctggcatcttggaggacaccctccactgtactggttctggctgccttggccacagtccagtgtccactccgaggacatttctgtccaaatgtggttcacatcgcctgtttaaactctcccagacacattcagacttcacatggacagaaatg

SEQ ID NO: 720595 - DNA, 1282 bp, Homo sapiens
gcattgacatgccggacatccggctaccgtcatgtcgtgtcctgcagcagataggattcgattcactgtgcagaaaatcttctcaagtgccagtacatcgtataccggtagacatggcgcggcacggccaaaggaccacggctgagaacgaccactacgtcgtgtggctcgcgtagcagtccggcacgatagggacgcgcagcgagatagcacagtgtggaccttgggaatgactggtgtcacgtgtgttccgctcggacggtagctggagttgagtgccaggatccaaagtttggcgtacggtcgctggaggtggcgaccagatgacttcacggaggtgtccctttgcgtgggtctacccattcactcgttcctactggtcgccccctttcctgaccgcagcagcaatgtgggggctttcaaaaacacagcccaagcccggcgattgccagcggcaaggttctcctgggcgcccttgcaaactaaagtctcgcgaatcccgcggatgactagtcctcgtccccgaggaggcaaagaacagtcaaggggaacatcccgagggttgcaggataatagcgatccccctgatccagcttctcgagacccactaccacggtaacacgggtgacttccaccgccacatatgtgagcgatctggacgatcttttgggctacctggggcttttcgacatatggcggcccactccctaatgagagaaaccacgagtcgaacgggcgatagaatgtggcccccccctgtgttccccccaatagaaaaggggggctgacccaaaggctggaaccccaaaaaaggcctttatggacccccccaaaggtgctaccccgtggtcggcgttccggcaacaacggcgcacgcgggcaccggggcaatcctgcaacggaaaggcgggctgccaaaacggttccgtacctttcgcaacgcggccccgagaggagggtgcgccttacacttaccttgtgcgtgttccaagagccccgcgcgggcactcttccagaacgccgacaaacgggaacccacattctccgccgacaaagggagtttcgcaaccaaaggtacaccaaagggaccggaatcctcccctaacggtccaacgaaggaaactccctttaataggcctcattacagtggccccaaagggcggctatggcctacttaagcacgcgcccaattcccccaaaagcgggtgctgtgtgtcaccttaaagccgctggccataggacaccgtttcgcccattccaacaggccaccccatacctttca

SEQ ID NO: 720596 - DNA, 690 bp, Homo sapiens
gtttctcataatgttttacatgatgacaccaaggacacttgagcatcactgtgcactgcactctgcttatttgagactggtttttagttgcagatttatttcaagtttttggaatgggtggtttcagagtatattgtttagatttctactttgtaacaggagtaattcaataaatgatacggaataccagatacgattctaagcatattatctcatttaagccttgcaaaagtgctgtaaagtagatgatattatacctatgttacttttatccttggatgtcacacctctctcattcttttctccctttttctctctaatcgccccaggggtggagaggttcctctatattaaatcaatataaatatagttcctctataataaatcagtcacatgatttagttctactatgtctgctgagtgctgatagtcccattcttctacttagaacctgcagttcatgtccatggggatgccctcctctgccatgtctagccacaaatttctcttctttttttcctgtgttcatcagctcaggtagcttggtgttgaaattctcagactcttcctctcctcacttgactttcagtctgcataggttcaggatggcgaaccatgagaccggatgtgctaagggacagcgcagagtgcctatcagaagctgaggcctttcattccaactttcctgtg

SEQ ID NO: 720597 - DNA, 330 bp, Homo sapiens
  misc_feature (26)..(26): n is a, c, g, or t
cccggaaagcaagttgatgaccaggnaatcagtgcaaacacatttttttgttaaacccatgtggtaaacacagaattattcctgggcccccacttaagtgtcaatttataattttacccatttatccaagattttactaagggtaaaattatttaaaaatgtctattaaattgatatttatatcttgcatcctatatcatgtcaatatgtgaaatagaaaaaagatacgtgaattttttagctaagcttgacagattgaaaaacaagggtcatttttttttgtagagggtgatataacccatgtaaatgaataaagacattttaaattta

SEQ ID NO: 720598 - DNA, 191 bp, Homo sapiens
ccctttaggaacccccccccttatgcctgtggcagtggcacggtgctgtatcctgcctggggtttggcctttactttttcctccctttgggtttgcctcccctgtttttcagggggctggatgcctctcgctttgggtaaatgccttcaaaaaaaatgacttcccagtccgtcagggagacccttcctgga

SEQ ID NO: 720599 - DNA, 437 bp, Homo sapiens
gcagtcaaggcagatgccacagttggccaggggcctgccctgttggaggcttgaggaggcaggggggtttccccaggccaggactctgctggagttctggggctggggaccccagacagttgctttgaaaggtgatttggggctgccatggcagaggctgccctttctttgaatgggccggcccagcacggaaaggaggaagggagtaaggtaggaatgctggagctgccatcttggcttccagggacttggtgtccatgttgtaacacatctgtcaatgtgtgggggtggatgaggttgccacaggctgtgccctttcctgatgcagcttgtgatgcgtgagatgctggaaatgtatttaactcgcagcaaaggtgtatttaatgttttcttcaccccaccccaccccccgactcattaataaaaacagctccgca

SEQ ID NO: 720600 - DNA, 184 bp, Homo sapiens
cgctcacaacattgctagcgggagaaagggcatcattataagctatgagtggaaaggttctggtcaagatgtgtctcacatctacacggggctgggaggctttaatgggggcccggtccaggtagaaaagaatgggtatgtagagcttagatgtccctatggtgacagagccatgttgtgagcg

SEQ ID NO: 720601 - DNA, 190 bp, Homo sapiens
ctcacccactccacagcctcactctccttcttctgtcggaccatctccagctgggagattcgagctgtcagctctgccattctccaaggccagctgatcctgagtctttttctggtccccgtgtaggcctgcagcacggcctccttgacctcttcagcttcttgacgctccttggcacagcttttcagga

SEQ ID NO: 720602 - DNA, 165 bp, Homo sapiens
gcgggaggcccgggcgttccccgagcctcgggaagctggccgttccggactgaacttctcggggagaggcaacaaaagacacaattgggcttggccaaggccttacaggttttaggtttggtttcgtcacacgcgaaaacacctggggccccgggggattgcaca

SEQ ID NO: 720603 - DNA, 323 bp, Homo sapiens
gacaaaattgggactctaagtattgcgcttttttttcctctccaacgactcgttccctttcaacaaatagcacttcagtccactgtgtacagaagtaatacatctcctatcgttagttgaataaattcacacaccgcgtttaagagatgaaaccacgacttcgtcaagccacattcgattgccataagattccaaagaattctatcctcttaaagcgaaccacatgtaacccgaaggtccccacctatcaaggttagaactgatattcaaattatagactcattccactaagcaagtaagctctaagctacaggttgatcata

SEQ ID NO: 720604 - DNA, 624 bp, Homo sapiens
gctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaaggttcatagcaaccagcacactataggtaagtcggcaccacttatttttctcttagacaaatatctcgtaacctttatcgcattaagtgaaactgttaagtaccgcacatattttcttaacattcttgtaacttcaacaactttcttgttgttgacaattgttctatgaaagagaaaccttcactacaccttgcccattctaataatgcgtattactatcgtaattgttcaaaaactcttaaaagaacggtgttatcataatggactcaaaataaagagacactgtgacattttataagctacattcatgaaaca

SEQ ID NO: 720605 - DNA, 916 bp, Homo sapiens
  misc_feature (27)..(27): n is a, c, g, or t
agtgtgaaactttagatggctacaggnagtattttaatcaaattgtaggctttttgtggttgaagatcacattctacatacaacccagggcttagtaaatagagcctacattgatgaactgtgggaaatggtacttgttaataccatgtctagcactgcgtacccactcgtattacacgttatcgatgaaaccttcgcgtcatatcctgacacatccctttttcgtgattttttgttgaccttctttcacgagtagtctctcgactcgcgtcgccaggtgtcttctgcacgtcgcgttgtagctcctttatctttctcgtagggcggcggttgttttttactttgtcctccgctccttcgtacttcttcctcttattttgcttcgccctcctccctcccgtcttgtattacttgttacctctaccctcttagtgttgctgctgacgccctctaccctccgccctcatatctgacccagcgctccatcctcgtccgttcatatgtgaaattttttttttggcgtctcctgcgccccttgcgctctccgatacttgcctttcgtagactatgcaggcgagatctattccgcaccgatctatctatgcattctcggatcctattgcatacagtccctgttctgcactcccccctgttactatcgcccatccgtcagtatcccgttctctgctggttatggtctagccgacgattatatacaactgcacagtctcttctggtctctcgcctgtcgacgtgtcttctgcccccctttgcttatttgcctcggtcgcgcgccctcccctgctggccgcgcttttaatctcttgtggcccctctcgctcctcacatccacgtccgatggtcatactgtttggacgccatcatcactatcgtctcctcgatatcccgtatcatg

SEQ ID NO: 720606 - DNA, 1861 bp, Homo sapiens
  misc_feature (1314)..(1314): n is a, c, g, or t
  misc_feature (1358)..(1358): n is a, c, g, or t
  misc_feature (1615)..(1615): n is a, c, g, or t
  misc_feature (1832)..(1832): n is a, c, g, or t
tcctgttgtctggtgttgttggttcgcagtgcagcaagagacgagaacaagaaagacgggactagaaacctatgatagtgcggtctatagatttgcggccgacctatctatcgtgaggtgttttgttcgtttttgttagcaacagagtggtggtcctgatggaccactacagattgttattccactccgcaggggtgtataaacgtgggttgatgggttcccggacgcactgtattctaattacggcgcccacccgtgtgtccgatgccgcgggaatgtgtctgtacacgccatccgggccccattatttccagaggggtaattgtagagaggagtcccccccggaagagaaacaattgggtgtgtcaaccaggaaaaagagtggaaagtggtgaccgcgttaagggctcctctccgcggacgacaacctgggcaatggagaattgggccacagtaacccacgtggagcccctctctctccgtcttcttggggaagaaaaaagggccccccggggttagaatcccactacagggtgtggagaaaaattggaagggggcaacacatggtccaaggggacgcaggaagttgggtaaagttgttaaaaggttgataggaaatgtttctccttgggcagaggacgttttataaacccccctggggcgctttgtgtttggtatagtacccttggcgggggaaccactgtcgaaaagttttgtaacccccggggcgcgtcaatgagacctcaggcgtgtgttgtggtttaatgacattgtctccctcggtcccaaagaaggaagaagggtgatatgttgggggatagtcccacattgtgcctcttggaagaggatttttatgagcccgcgcatatgttgactccacacggagagattttctcgtccgtggggggggaaacccacccgcggcgatagatatataaagagggaggtttaatatccccggcgcgttgtttaattaggcataagagtttgttgtgggcacacgaggcgttatttttaaaagggatattatatgctgtttgctctaaccgcgtagaatagacgttttggggtgtggacacacaccagagatgacagtcgtctgatagacataatattttggaagagagagacccccccacggtgggatatgtcgctggtggaaatattgtgtttcgccagagaatactgcattctcccgtgagtagcgcacacaccaatagggccccccacgagtggttttatagggaagcgcgcgccacgacagtatgtgctcctggtgagagatattaatatgtgtgttagcacagatatttngggaggacccaactagtttgggcggcgttggatagagccacacnctgctctcggggatatgagagataagaagcctctggctggtttgatagtgagctcgccatattatagtctgtgtcacccgagtgtttgtcgctgaaaagtgtacctcgcgccaaagagatttgtctggccactgttggtgttgtccgtggccacgcgattattgaaaatgggctgcctcctctcgaggtgaccacatccggaaaagctcgtggtggaagaaggcacacttctgcacactgtacactgtaagtgtgtnggattctcccctgtaaacaccacatgtttggtgttctttagaatgtctattctgtcttggacccacaacgaatgtgctttgtaagaatgttttgtgtatacacccaccgatagtttgttttcttgtttgatttttaaccggagataaataattaatagggggttatagctccctttgtaaagagaagaaaaatagtactcgagcatataactcgggnccgagaagagtagctaccgcccgtctttg

SEQ ID NO: 720607 - DNA, 1056 bp, Homo sapiens
  misc_feature (13)..(13): n is a, c, g, or t
  misc_feature (64)..(64): n is a, c, g, or t
  misc_feature (77)..(79): n is a, c, g, or t
  misc_feature (93)..(93): n is a, c, g, or t
  misc_feature (96)..(96): n is a, c, g, or t
  misc_feature (110)..(110): n is a, c, g, or t
  misc_feature (126)..(126): n is a, c, g, or t
  misc_feature (131)..(131): n is a, c, g, or t
  misc_feature (292)..(292): n is a, c, g, or t
  misc_feature (425)..(425): n is a, c, g, or t
  misc_feature (430)..(430): n is a, c, g, or t
  misc_feature (434)..(434): n is a, c, g, or t
  misc_feature (552)..(552): n is a, c, g, or t
  misc_feature (654)..(654): n is a, c, g, or t
  misc_feature (661)..(661): n is a, c, g, or t
  misc_feature (757)..(757): n is a, c, g, or t
  misc_feature (763)..(763): n is a, c, g, or t
  misc_feature (770)..(770): n is a, c, g, or t
  misc_feature (775)..(775): n is a, c, g, or t
  misc_feature (821)..(821): n is a, c, g, or t
  misc_feature (843)..(843): n is a, c, g, or t
  misc_feature (848)..(848): n is a, c, g, or t
  misc_feature (850)..(850): n is a, c, g, or t
  misc_feature (855)..(857): n is a, c, g, or t
  misc_feature (864)..(864): n is a, c, g, or t
  misc_feature (868)..(868): n is a, c, g, or t
  misc_feature (871)..(871): n is a, c, g, or t
  misc_feature (882)..(882): n is a, c, g, or t
  misc_feature (889)..(889): n is a, c, g, or t
  misc_feature (895)..(896): n is a, c, g, or t
  misc_feature (905)..(905): n is a, c, g, or t
  misc_feature (911)..(912): n is a, c, g, or t
  misc_feature (915)..(916): n is a, c, g, or t
  misc_feature (934)..(934): n is a, c, g, or t
cttcgagtgggcnacctaaagcccaagtttaaagatggtggtcgaggggccaactactccactncggccatacccgnnnagatgaaatttcantgnatccgggtgaaacncacccatgtgcccaanggttngataaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgcaccgnccaggcaatttggtgtatcgcttctgtgacgtgcaaagacgagacctatgacttgctctcaccagcaatgcgatgcccagccaggggcccgcgggtctggggtctatgtgggggtgtgggggggacggcggcnggggngggngcgaaaaattattggcattttttcagggcaccagtgggtggacatgaatggcttccgcgcacaggatttcaacgtgctgtcagaatcactcctctcaaatatgcccagatttgctatnggattaaaggaaactacctggattgtagggaggggtgacacagtgttccctcctggcagcaattaagggtcttcatgttcttattttaggagaggccaaatngtttttngtcattggcgtgcacacgtgtgtgtgtgtgtgtgtgtgtgtgtaaggtgtcttataatctttacctatttcttacagttgcaagatgactggcttnactatntgaaaantggtntgtgtatcatatcatatatcatttaagcagtttgaaggcatacttntgcatagaaataaaaaaaatantgatntnggggnnntgaggantatntgncaattaagttnatcttcncgtttnngcaaacttngatttnnatnncatctgaacttgtttcanagactttatattaacatattgggcatacaagagatatgaatgcttatatgtgtgcatgtgtgtaacttcatgagatacctctagggaggagggataaacgggtacaaaaattcagtgcctga

SEQ ID NO: 720608 - DNA, 1205 bp, Homo sapiens
  misc_feature (209)..(211): n is a, c, g, or t
  misc_feature (517)..(517): n is a, c, g, or t
  misc_feature (912)..(912): n is a, c, g, or t
cagtgttgtgtgttgtggtcttttgtcgttttggtgtcttgtagcctcttttcctgtgttgtttgctttgttgtgtttgtcgtttttcgtatgtggtgttggttttgtgtggcgatgaaggtagtagtgttggtcgtgtcgtcgttgtattctgatacgagacggtgacgagaataagagagcaggggacgctcgatccaggttgggcnnntgagttgctcctcccgccatatgatccccgcgtcgggtctcctctcttctctctatttgggggacaacttgggttgtcgtctcctccttcttggcgcgcgtcttgtggcgccgccgctggtttcagagtggcgccgacaagtttgtaaaaaaaaaaaaagggggtcccacacaatgtctatttttgttgaaagcgccagagggttgtcgcgcagcactcagaggggtgtggaggtgacaacagacacgcagctcgggtggggttgatttatgaaaaaagaataaatagcctcctgggtggttgttnaaaaaggcgcacacatgggttgcaaaaacaagcggtgtgtggtggtcgccgcccgctcgttgttagagaaaaggtgtagcaagacccaacaaggtggtggcgcggaagatttgtgccgccgcgtatgtgtccgcgacaccgcgggaattggttgagatggtgttgtcacgagcgcccacatatattatggcggcccgcgcaatatatttgtgtagatagctcgatgtcttgaaaaggagcgtatctttgggggcgaaaataaaatcttctgtgttaggcagcttataacgcgctttagtatgggaataggtctctccacagagaatatagggggtggaacaaacaatcaccctgtctccatagaattgtcgccctggtgctcgctctatttaganaggagcgccccaaataaagcgacgctgtgtggtatgatctatagatagataaagagtatccgacgagatggggttatagagagacctctctcgatagagagagagagtgtatatcgctctgtggccactatttatattcgcgccaccctcacagttatatttgggattgtaaatatacacccccaccccctctgcctttttatatataaaaatatttccctctctgtggaaaattacacaacggttaaataaaaattttatataaaattgttttcccccgcgccaaaaaaaaa

SEQ ID NO: 720609 - DNA, 915 bp, Homo sapiens
  misc_feature (24)..(24): n is a, c, g, or t
  misc_feature (66)..(71): n is a, c, g, or t
  misc_feature (80)..(80): n is a, c, g, or t
  misc_feature (85)..(85): n is a, c, g, or t
  misc_feature (88)..(88): n is a, c, g, or t
  misc_feature (94)..(94): n is a, c, g, or t
  misc_feature (100)..(101): n is a, c, g, or t
  misc_feature (103)..(103): n is a, c, g, or t
  misc_feature (106)..(106): n is a, c, g, or t
  misc_feature (108)..(108): n is a, c, g, or t
  misc_feature (112)..(112): n is a, c, g, or t
  misc_feature (114)..(114): n is a, c, g, or t
  misc_feature (124)..(124): n is a, c, g, or t
  misc_feature (126)..(127): n is a, c, g, or t
  misc_feature (138)..(139): n is a, c, g, or t
  misc_feature (145)..(145): n is a, c, g, or t
  misc_feature (159)..(159): n is a, c, g, or t
  misc_feature (165)..(166): n is a, c, g, or t
  misc_feature (175)..(175): n is a, c, g, or t
  misc_feature (180)..(180): n is a, c, g, or t
  misc_feature (195)..(196): n is a, c, g, or t
  misc_feature (198)..(199): n is a, c, g, or t
  misc_feature (209)..(209): n is a, c, g, or t
  misc_feature (217)..(217): n is a, c, g, or t
  misc_feature (220)..(221): n is a, c, g, or t
  misc_feature (240)..(240): n is a, c, g, or t
  misc_feature (245)..(245): n is a, c, g, or t
  misc_feature (260)..(260): n is a, c, g, or t
  misc_feature (296)..(296): n is a, c, g, or t
  misc_feature (359)..(359): n is a, c, g, or t
  misc_feature (371)..(371): n is a, c, g, or t
  misc_feature (406)..(406): n is a, c, g, or t
  misc_feature (896)..(896): n is a, c, g, or t
acaaaagagtagcattccattttnatgaagtgcacatgaaattatgaacaatacaaatgcattaannnnnncattaatantctantcnttaatnatctcnnangtnantgcngngggtgggatngnngtgggtggggnntctgtncacaatgttcagtnttttgnntatgttganttttnttagttgtgcatttnngnntgcgtagttnttgttaanttnntggtgcataggttgttgtnaagcnattactctcattgtnttgtcatacatgctaacattttggtaaatataaatntacaagtttcacagctgcatatatttctgaagtggttagaacagaggaggatgctggttagtngagtgctttaanatcttcgttcaaaacaagagattttcatctatgtnctcttctttaattccaaagcagtggccccactccttcagggtgatgtgcttatccttgttggggtcacactcctcaaagaaacgggttatgcagtgttccatgggcaccagagatgctcgcagaggagcaagttcagaatgtgtcaagactctatccatagggtgttggtcaagttcactaaactgccagtgcacaggatacacatacatgtggtagtttttcttaaagtcccttaagagaagatcaatgggatggtccccagccaaaagcctcttttcatccaggtaaattttcttgactttatttctctgcttctcatttagataaccagcgtgttcagagttggcttcataaagctgcatgaggatattcttgagccagtctctcatccgtagaggaaactgaatcacttcaaagtccgtacaagtaggaatagatttgcaggctccaaaataatccagctggagttgatgccctttttggtccctncagtctgcatttagtagcg

SEQ ID NO: 720610 - DNA, 902 bp, Homo sapiens
gcggtcgtcgtgtgtgtcgttgttgcggtgaggcgcggtgtcggcgggtggtctccagtgggggtgcatctggtgctggcgtcagttttcggcggggttacccggtgtcggtggtaacgcccgtgtgcgcgctttcggtgtggttgtaaccgccgccggcggtggattggtgtgataagcgcggcctccgcaaatggcggcgcgtatgtggtgtcgccccgtgcggtggtgttgcgcgtcgccgtcggtgggtgcgccgtggtggcggggagagtggcgggcccccccaggtctccttgtgtgggccaacccttgattatcggggggtgtatcgcgctggggcggttgccgcggggagatattggccgccggggtgttcggccgccctattgtgtcgcggcgagcgcctctgtgttacctcgcctgaggtggactgcacatgggcgctcgttggatagtttagcgcacgtcccggggccgatgtatgtgttgcagcccaggcctctttgttacgtgggtggccgacccctcgccactagatcgcgcactccgccctgggtgtccaccactcgcacgcctctggcggccgcctgagttgtgtcttcgacgcgccgccctggtatgcacgaggccgcggttatggaccaacgcacttgcgtcacccgggggtcggcgcagcgcaatgtcgctaaactggccgtccgcatagtgggtcgcgcatcggaagtgcagataggccgcgccccacgtttcgagatgtgaaccacgcccgctcggcctatgttgtacgtgtgccaccacgtagtagaaagaacggcctccctgatgtacctcttgctcgcctctttttcgaccgtaaccgcgccccttgtttcccccccctcgcccctggcccccaaaca

SEQ ID NO: 720611 - DNA, 199 bp, Homo sapiens
  misc_feature (84)..(84): n is a, c, g, or t
  misc_feature (109)..(109): n is a, c, g, or t
  misc_feature (127)..(128): n is a, c, g, or t
atttccctacagaacaagataatccccaacacatacaaacacacacgggttaagtcaaatgggatttattggcccaggccatgnatgctcacgccttctaattcccagncactttgggaggccaagnncggtggattcactcgagcccaggagtttaagaccagcctgggcaacatggtgagacctcatctctactggg

SEQ ID NO: 720612 - DNA, 308 bp, Homo sapiens
ggctcggtcccccatcagctatcagagggagacaggaaaatgtcagcctgcacacccaaaacccagtgatctggagggtgagcagggtgcagtgagagtgcccatgtgaggcctctgcacctggagctgtatgggtctcacgatgctccgtctgcagtgggagttgcacccgtttgagagatgaggaaacagacccagagaggtgggcacatttactctagtagtgctgggactgaagccacagcctgtccaaatgcaaagcctgcgtgcccactcatcacagcaccacttgtattcatcctcccacc

SEQ ID NO: 720613 - DNA, 1118 bp, Homo sapiens
tgtgaaactaggaggctatggacttatactcctacacagtcatggctccttacgcacgtcctcacaatcatcacctctcgctaatgctcgtatctcttgatatcactgcgctaaccttacggactagacttgcattactatgccatccatcgtgccgtacgacatcgcagcctcgctgaattcgttgtcgtttggattactccgtcagatacaggacaccatatcttctggtgtgtgaccagatcggtatctcgagtcgcgactaacgctcatgaaagatcttaattctgggattgcgatatcgtttacgtcgataagatcggcccgaggggactaaaactatctctgcaagtacagtaatgtgcctggccgtagggcggtagctgcgaagagcgtttcagccatctgcgcaatgcatttccgtgatctattcggtaacttacctacgttcctatatcaggaggatgtaatcctctactctctggtaattagcgctgtcagatagacctatgatagcaattgcgttcgattaaatcgcgtggttatcgcagcgcaataattttttgccgtacttgaggaagatggctcactggtgcgtatcatagatccaagcgttcctgctgaggtcgaactatcatgacttcttacttagagtgactcatggatttgtagtctgaatgctcgtctactccctctagatctatagcattaatagagaggggggtcatttcacctatacccattaggtagttataacggtcattacacgagaacaagacctcgtggtcatgggcgtattgccccatgttgtcctataccattcaaagggcggaagtcattacgtggttggcgttctctcagcctagaaatgaccctcccccgcctagagaaagggtcaagcggcagggcgtggaatccccagcctttcggggacgcaggcaaacccgggtgcgccccttggcctaatgtgcgcacggttttacgttgtattccgatgaaggcgcccggaaaagcgctttcggaaagcccgcctgtgtgttggggaacccccgtgttgaaaaacccgtccgccccaatttcccaagggcgtgcccttctctgtagacccggtggcatag

SEQ ID NO: 720614 - DNA, 936 bp, Homo sapiens
gggagagaactagtctcggtttttttttttatattttttggccactgggcattaattcacacggagcaggtggtcctcattgccccgttggccaaggcacacagggaacggggctctgcctgaaagtagggtctccgtctccgcgcgtatccaggtttgcaggctgtcttccgcgaggttcctgcgagggcgcgctgatttgaactcgaaagtgcttggaagctccacgctgtgggcggttcttgtcccgtgggacggcatctcccggagggcctcgggcgcgggcccggtcgcccagaagggcacagattcagtgagcagctgacagccgagcgagtcggagaggcgtggggctggacctatcgggggcactcgggcacgcgccgcgggatgggggggtgcgtcccttgtcacacctcacgaatggggcatctgtggggcctgcccctcgcggtttccccagatctccgagttctccggagaggatcttcctgagggccctagaggaaggccttttaaatgttccgtggcccccgttaattctgttaagaaaaaaaaagggacccaatttttgcgggaactgcccgcggtagaaccgaaccgcgtaccacattttaacgccgggaaggggttctaggaggggaacaccccccgtggtggaacacgtcggttggaagttgagaaactttgtctgtcccagaagtctcccccgagagggttctctccctccgagagtcctgtggggagaagggtctcctcacaacaggagaagaccttctgttgtcaagagacagaacgcaacaacaagagagacaaagacaaagaacaacttttttgtttaaaaaactccctgtgtctttttctcgacacagaagtttgcgaacataaagatctttaaaagaggggaacacaagaacttgccccattatatagaaa

SEQ ID NO: 720615 - DNA, 102 bp, Homo sapiens
atcagtcgaccgggagcatgctttagctgggaggtaaaggctgcagctgaactgtgatggcaccactgcaccctagcctgggtgacagtgagaccctatgtc

SEQ ID NO: 720616 - DNA, 606 bp, Homo sapiens
aggggctgcctggaaaagcttgtactactacacttcctctacttctcatacctgccaggattaatatgttgccctgaggtaggctatcctcagacagtataacccttcaaggggctctggcttcccacatttctttctttatccctttaaatgaaatctcttgattcccttggtatggctgatgcctttattccttaggagttaaggggaagaagtctgtttcatacagtttgtagagggcacagcagcaatcccttaacctccttcttaggtgatactttatagccctaaagtactcactgggtgatgaaattctaagtggtggtacaaacgtgacatgaaagccaccactgtaccaaaagtaaagtaatgggtgctaggacactacagaggagccacagcaatctcccctatatctggcccaagctgcacaggatgacagcaatctctcagatgagatttcaactccggcttgctttactcagcccgtcaatcacaacatgataccttactgaagagaagtatcataagagctggatggcacatgcaatcttgtcaatgcagcggaccacgcgtactgactgtagctctgacaaccgcatgtgg

SEQ ID NO: 720617 - DNA, 130 bp, Homo sapiens
caaaataaagcttcaggcaagaggcaaagatccagtgggaatatgggagaagggtggaggaccaacacctgctaccccagagatgcttttctaaaaaaagcaagaaatgcagtcatggaggggtattcac

SEQ ID NO: 720618 - DNA, 1375 bp, Homo sapiens
  misc_feature (1375)..(1375): n is a, c, g, or t
taccataattacttgggcattatattcacaatccgggggcacacgacggaatatataacagggcttgaaaacaccacttggataattcccttggtgagattcactaaagatggcgtcaccatgggtattcctggtgaacataaatattctcactaaggaaaaccccacagttataaaacaaagtcacacaagaaataaacgctaagctggtatccaccaatggaatatggacatggatattccaacatatcatgttataaaatgtcaagggacacaggttatattctgtcccatggtgtcaacactatttcccactcttatatggcgaatatccccaattgtgggcttactattttaatatctacaacacagctggaggtgtttataaagaggtcatttcaaaatgtggccagtgggtgcacaaatatcactatactcttctcacatctccagggacggtgttttccctggaagctgtttggggccctttggggacacggcggtctaaccccccatattggggcttaggggtttctggccttgggcgcgagatggtacacacagggttaaaaaggccctaaatacacggggggggcgggaggcggcactactacccgggggggaggacgcttaccacaccctggcatgtgtaccgggagtcccccacaaagggtggcacggggaagggacgcaaacgggggccacagccggccggggcccgctgggcgccccagttgggcaggagaaaagacgtcctaacccggggtgctctgggaaaggcttcttggaagttcccccgaccaaagatggtattatttttacaaaaaccggttttgggtatacgattttgcaaagctcgcaagtcgagaggggccctctccacagatagatttgcaaaacgaccaagagtgcacggaacttgcggatcggtacgcccaaaattaattcccaacggggaggaaccccacaatctataaaaccaccacaattgggcctgggactcgaaacacccgaggaggcggcgagagaggaaacaggggcgcgccgaaagacaactcgcggacaacggcaaaaccgggacacacaaacacaaccacgagtaggctcgcccaaggagcaccggtaaacctcggggtcctccccggagccacacacgtccgggaaaaagggtcgaaaacactaatgctgtgggacacaataaaaggccgcagacaccccgggcacctaattggaatgtcgagaacaaatcatccaacaacgcccgaagagacgagtgtacacacgacaagatgccagcattggagctgctaaacaaacaacgaagtcgaacaggcatctcctctcccccacgctcgcttgtctctctcacgagagn

SEQ ID NO: 720619 - DNA, 384 bp, Homo sapiens
cagaacctggactcaagcgatcctccagacctcagacctcccgagtagcataccaccacgcctgcctaatttgtgtatttttagtagagacgaggttcgccatgttggccaggctggtcttgaactctgggcctcaagtgatctgcccgtctcggccgcccaaagtgctgtattacaggcatgagccactacagctggtcccagcttctatgtcttttcttcattgattcaacaaatatttatgtagctagtaaatgccatatactattctaagagctggtgaaacagcagcaacccaaatattgccttatacggcttacattctaatgggagacatagcaaataattcaatgtataatggtctaggtagcaggaagtatcagt

SEQ ID NO: 720620 - DNA, 482 bp, Homo sapiens
  misc_feature (22)..(22): n is a, c, g, or t
  misc_feature (412)..(412): n is a, c, g, or t
  misc_feature (460)..(460): n is a, c, g, or t
ctcagacagcggaccccaaagntactattataccacgcctctttggcaaggatactctgtccgggatctacttattattacttaactcatctctgatccagagttttctcttgaattctttattattcaggtaccaggaagtattctccctgcatattctaacttttcaatttgagagtgaccttcctaagaccacagcctgtctcctaatcatccttccatgttacagagtcaggggcaagattattcagacaataaatgtttaataacttttactggctcacattcctggaggatagcacatactttaattccaggctccgaaaatttgtggtacatggataatacaagtgttaacaactgtgtgtgtatgtgtgtgtgtacaggtaactttactaggggagtgagaggnaagaggagataaaaatgcctggtactttttttttttcttcagtttttngagacagggtctcacttagggg

SEQ ID NO: 720621 - DNA, 302 bp, Homo sapiens
  misc_feature (205)..(205): n is a, c, g, or t
  misc_feature (223)..(223): n is a, c, g, or t
  misc_feature (247)..(247): n is a, c, g, or t
  misc_feature (280)..(280): n is a, c, g, or t
agggaaaggatggttgtccctggggagggccctttggccccaggcaaccttagcccctcaaaacagggagtcccaggacccagggaaagtgtggggacaggacagcctgttttttgtagcttcctggggtgggaggcccaggggcaaaacaataccccagggaaagtgggaggtggtgttggtgctctttccaggccccccatgntgggaaaggcggccaaancctggggcctccagcctgggactnctgtgatggggtatcccggtgatggtccccttnaacttcccctttgccaacctta

SEQ ID NO: 720622 - DNA, 1209 bp, Homo sapiens
  misc_feature (91)..(91): n is a, c, g, or t
gggctttctcgccagacatgtttttccggtgtgttctggttatattgtggtgcactacctttgtagagaaagtgggtcggacaattccacnacgaggtagggcttccctcgctagctacaatgagggggttctgggcgggggaaatttttttttcttgggagggggggacatcaggtttgtgcacttggtgcggcccgtcgttcgtcccaccatcgggggttatcctcccctgccaaaaacagctttgggggtcaaaggtcttgttcttttggggaacgctcctttggttaggttggcgccaagaacagagcaaaagtgcttggggggccttggaggaagcaaagtaaaatttgttggcccacgcagagattgtttctctctgtggccgtttgccagttgtcagaagaaaaatttcatcgagatcccctggggcaatctttcgacagtggggaaccacaatttcttgggggagaaaaagggggagacttctcctcttgtgaaaagcgcccccctgtaaagggtgttttaagaccacatgtaggcttgaaaacactgtcccccccctctctcccacggaatgaaagtgtggatttgaagaaccacacagtggcttcgagaagagttgaaaaggttgtttttctccacagagggaaaagtctttctggaatgggcacaacggggctcacaccctcggcttgagctgcacaacgctgtttggccaacaagttaacaacacataggtaccacggtggttgtgtaaagaagtatcccgggggaattcaccacaatccccgagggccttccggggagagtgcaatcggtaacttgagagcacaatgcctatacgcccgggagagaaattctggttccacaccggtccacagagatgaatgagaggaggattcgagagctcgccctatgagccaagtggcacaaggccctcaaataagcccctccctgggaatccctcaaccccctccattttgtctccacacacaagggccctggtggtttccacattgctatcccacatggacacacctccacaaatggccacgtgggcacgggaatcctggaggcaccttgttccgggatggtgtggtggaaagaaggggaatgagggaaagaaatggggggcctgggtcagagtttttatttttggggtgggatgagtaggacaacatatttcagtaataaaatacagaata

SEQ ID NO: 720623 - DNA, 729 bp, Homo sapiens
aaggaagacttccagaaggccaggttagttgtttagccaaaaaagtaccccaggtgcacctcctgctcctgtagaggtttctaaaagtctttgcaaaagtggcagcagtggttgtagccttcttaagcaaccatattccgtgcttcaggaaacaccagatgagtggtcatgggccacttatgtgtgttgaatatgacacgccagtaagtccggagtcaactagtgatgcacagaatctctggtgaacaggtgctcagcatctcagcctgtgtcatgtcgatgtggtcatgcggtcagagatagttctaatgctgcatcattcaccttcaagcgtgatatatgccagagttttatcagcgatcggccaatctagagggtgtctgcactggtgcagctgttggaacgcaagttgaagccaccactggagcatctgaaagctgttatgtatgatttgggagcttttgaatactagcgctgcatggctaccgataagcacacctcctccttgctggaaggtaaagaccttgttggctgaagcatatgcctttgtggctgatgaccttgtgtttgtaagcatctcagctgctcatgataataatacagcgacagttaaggttaaagcctagtaaaagtggttgtagtttgggctggtgtatagacctcggtctctctaaataacctccatttcgttaataatttagcctcttttatgtgtgattcaagtaatta

SEQ ID NO: 720624 - DNA, 440 bp, Homo sapiens
  misc_feature (248)..(248): n is a, c, g, or t
gctatatatgaaatttgtcttaaggtaaagaagtccaacaaaaaaggaaaggttgaatcacttatacactgctcccaatgtgagaatagtggcatccttcttgcctggatatgacaatggagcttgtttctatgattaagacctacccatggcagtgtatggcatgtaaaacatgcattatatgtgacaacccccatgaagaagaaatatgttttatatgtgccaacgcacaactttgcgccccgtgntattccatcaggtcgctggatttgtgactgttgtcagcgggcccccccaacacccaggaaagtgggcagaagggggaaaaacagcaaagagggataaaatagtttttgactctaatactgtatatgcatttaagtggaatatttggtgccatttacaacattattttcatgccaataaaagattttttttgc

SEQ ID NO: 720625 - DNA, 808 bp, Homo sapiens
atcaaggaatgtcaataacattgtaagaggaccaataaacagcctcctataaagtaaacctcttccctgtgagaatgcacactctactacataaagggaaggcccctgggctctgatttgtcgcgtttgtcattgagaacgtgtgtggaggatcagtgtgtgtgtatgtgattagtgattgagttggctatggttgttttagtttttcttttaaaaataaagatcacttccttcccatgttactaaattaatttatgtttgtgagaggttgagtctcatagtgtaaacaagtaaaccgtccattcataaggtggatgttgtaagcttgatggtggttgtgaaagtgatttagcttgtgaccacttttcatcctacagcttcaatatcaaactggttaggaaagcccaggggaacgggagggggcaggggaggaggcaacttctgaatgaatgaactggatttctgtttgctctgcaatgttaactatagaagttcccctcgtgtccttgggagatgatggcctttgaatatgctgacaagctttgaattgtgcctactaaattatagcagggtgactttggcacccaaagggagttctgactttctggggattataatagtaatttcccatgccataactctggactttattttgctaaaacaataactgagcagagtgtaaattattgtatattaaattgtttaaaaggcactgggatagtctaaattctaacgttgtaattaattatgttggccaagtaatctgtgtgaaataaatttgggctgaaaggtattgaaagtgttaagt

SEQ ID NO: 720626 - DNA, 1258 bp, Homo sapiens
  misc_feature (341)..(341): n is a, c, g, or t
gttgcccaggctggttgggtctcaaactcctggtctcaagccatccacccaccttggtctcccaaagtgctgggattacagatgtgaaccaacatgtccagcctttttttttttttggagacaaattcgggctcgtgtcacccagaacgggagtgcagggggtgccatctgggctcactggcaaccttccaccttccggaggcctcaagcaattctcttcaccccgagccttccgtggagatagctgaggaccacgagggtgcctcaccaccaaggccgtggtaaacttgtgggtgttttgtggatagaagagtggggtttgtgtgccgaggtgttctccntagtgcgtggctcgtggagaacctcagtgaaactctcaacgagattgggtccccacctctcaagccctcttcaaagaggtgcgtggggaatttcacggggttagtggagccccaccacaacttccgagccgtgcccccaagtttcatagacacacgtgcgcataataagagctcgagttgtggagacactcttctaaaagacaacaaaaaaaaaaaaacaacaaaaaaaagagagggggggggcgggcccatcccaagagaagatactccccagtcagagggggggcgcccacaaagcgctatacaccgcggaatacccacagggtcttccactgtgggggccacacaagcggtgggccccccatataagggagaggagcgcgcgaggtaaatattatataagaggcatagggagacaatagggggcccacgcaacgattactaaccacacagccgtgccacgcgcgacgacagtcgggggcgcgacacaaacccacggtgggccacaacccggcgggaggcgagcacaccctagatgaggcgcgcaggaaaggagcaacaccccatactaacacacccacgcggggggggggcgggcgggaggccgacacccaacaaccgagcggggcgccccaaaacagcctactcccccgaacaacgcacaaacgcacatctatcacaagcgggcccaccaacgacggggggaccaacaacactatcaacaacactgatctataacgacacggggacaacacaacacgggggcgtgacacacacacaaacaacagcgatggacaataatacgcacggcgctcgtgctactctgaggaagagaagagctatactgggcgacaagacggagagcgaacacaagacagtcacgtcgacaagcccgaatattaaacaacaccgcggcg

SEQ ID NO: 720627 - DNA, 647 bp, Homo sapiens
gactgagagacatgacacctcgagaagcgttacagaggtgtctccaattgatgacaacgctgagaacttctaccatatgcactaccgcgcgtctgggtatgacgcagtagacatcacttgcgagttgtcgccgtactgatgtgacacagatgaattgcggcactatcgcgtagtcgactccgaagcgctactagggctacgaggaaaagatacgcctgacttggacccgctacgtgtggcttggacatcaatggcgaagacgggttagactcggtcgagtcccggaaagctcccagcctgagtaggagcaatccgggacaaagagagaggttagaacgccatcagatggaacagggccaggggattgatatttctgaagcagggtaggatcccgttcgatccaggcatgggaattactagaaggtaacaggaggggccattacgcctgtccaatcgaatggacccaacagggcacgcacgacgtgggccggcagaaacgaccaaggattcaacacattcggagtgaacgaggaggatcggcggataggtgtcaatgccacgcactgctcgcatactgtagcaagatagcacctagtggtgccaggggtcacgaacagaacgggggagagaaggggatagtcaccatg

SEQ ID NO: 720628 - DNA, 343 bp, Homo sapiens
cgttggcgcgctgaaaccaaagtgcgcggtgggttcacataggcgttgcccaacgaccgttcagtcgggataatccctcgcatcgggtaaatcgtatcgccacgtatccgtggccctgcgtaaccctccctaattccgacctctgcagacctcttcctcatgcacaaagaaccccgtaaggtccgtgagtttcgccgccgtgagcaggaaattctcgacaccgcgctcaagttgttcctcgaacaaggtgaagacagcgtcaccgtcgagatgattgcggatgccgtgggtatcggcaaaggtcgacgcggccgcgaatttagtagtagtagtaggcggccgc

SEQ ID NO: 720629 - DNA, 102 bp, Homo sapiens
ggcctgtcagctagacacgatctgaatgaaaaactctacaaagcataattcataagcgtgtgacttggttgcattctgtgtggaatggaaggatcaagatgt

SEQ ID NO: 720630 - DNA, 107 bp, Homo sapiens
tcatcgtgcgggcttttctttgcctgtatttggcctgcaggttgtcactagattcgctgcggcggtgagccggtgcaagcgccctgctccatgcagaatacaaaggg

SEQ ID NO: 720631 - DNA, 395 bp, Homo sapiens
gctgcctttgcttttatcgctttgcaaaacaaaggggacatgttgggaacaggccccccaatgtggccataaactggctccaaaactggccataaacaaaatctctgcagcactgtgacatgctcgtgatggccatgacgcccatgctggaagattgtcggtttaccagaatgagggcaagggacacctggcccacccagggtggaaaaccgtttaaggcgttcttaaaccacaaacaatagcatgagtgatctgtgccttaaggacatgctcctgctgcagataactagccagagcccgtccctttgtttcccataaggaatacttttagtaaatcttaccactggcttgctgtcaataaatatgtgggtaaatctctgttcaaggctctcagc

SEQ ID NO: 720632 - DNA, 682 bp, Homo sapiens
  misc_feature (494)..(494): n is a, c, g, or t
ggtgttacccaggccggagtgcagtgactacttacaggcacagatcatacgtgcgactagagccttgaagctcccggtgtccagtattactcctgcctcaagcctcctgaggtatctgggactataggagtgcaccaccattcctggcataatcctctttgatgtagagttgaagaaaggtcaccagacgtgagacgctttatgttgcagttaatggtctcttcctcccttttctctgttacctgcaaatggacaattattccttctcgacaaggttttaggcttcccactttcagcatgcctccagacagtgtcctagaattactctagcaattgcgcaaagtaagagcagacagatgctcctaaatctatttccaggacacccgtctcatgatcaaggacgagtggggtccaaactccttgtgctgccagatgagcacctactggagtaaagatgctgcgcaaaaggccataatgatgtcaacgcagtgtcnactgatacagagtcagagaaccggagtgtcccattgcgcgcagggatatgttggcggttctgtagtgggccgcgagtactctgaacttctccagcaggtcgctagtggcgtggtcaagacgaagttacgtctcgtatgtctgctcttttgccttgtacccgcatggttccacgagacaatatgtgggt

SEQ ID NO: 720633 - DNA, 116 bp, Homo sapiens
ggtcgtacctgaggttgtagtagtcgggcatgtagggggcaggtctgtaggggcatcagatccagctcgaaacgaatgaactctagcccggacaccaaggtcaggaagagcgtcag

SEQ ID NO: 720634 - DNA, 302 bp, Homo sapiens
tggtccagagatcagttacaggtctgtatagacatgtgttactctctctgggtattaggagtggaatgaccggatcacaggacaggtgtaggtttaacttttgaagaaatggccaaactgttttccaaagtgactgttccattttacactcccaccctcagtatatggtataagatttctagttgttctccattctcaccaatactttgtagggtcagtcttttcaattttagatatttcattaggtgtgtagcggtattgcacaggggttttaatttgcatttccctaatgactaatgatg

SEQ ID NO: 720635 - DNA, 1507 bp, Homo sapiens
  misc_feature (437)..(437): n is a, c, g, or t
  misc_feature (1313)..(1313): n is a, c, g, or t
aacacaccatcattatgcaatgagccggcagtcactggcgtgactgatgtggcaatagagcgaacttgaagtgtggatgctctcgatatacctccatccattcgaggcacgactctcctcgttctgtcacgcgataaggcgtgctctagtgaatgtcgtcagagcagtaaggtttatagtgcttcaacttattaccttaaagctgtatactctctacagtagcaggtgcttacgagctgtgaccgtccatcgcgtactaatggatatgctacagtatcctctagaatcgttgcacgtcccagtacgtatgtctggtcgcatatatgtagactagtaggggctggtgctagatatgtccctcgtagagcacgtgtagcttctttggccgcgagtaatacgtcgtcagagagccggtgccgtgttgatgattagatacnttgcacttctaggatgttctaaaggatcgtattaagcccactttgtggtactcggcgttggacttgcgggcaatcggtcggaacgaacgtctggataccggcgtactcaattgtttacggaaaagggaattttgaccgctgataccggtcccgcaaaagacacgcaggcggaatttatggcgctgtttttagcaccgagaaggacaccttggagagaacaatacaaaggcaacaagcacgcagacaatactatgtaataataggaggtacaaacagttacgtggtacgcggaggcagccacgggttccggacacccctccataatacacgaagaacgcatttcatcataccgcacccttcctgtattcagcaacagctttatggttgcggcgacaacctctcgggacgagtacaggctggcttccgtaaatacaagcacgaccgttgcggtgttctgtaaatccaccctaaagagtatgccgagcgcacttgctacaggacaccatttggtcgagagcatcaaattacggcaaggagaccatagtgcgggcgttggtgggggcacctaacccgcccccacatacgagtaggaaaactctccgccagacagggtcacaaataaaccgcagtaagtgttctacacgagttgttgcaactcgcttataatggaggcgaatctacgggagaaaggttccccaaggtgaataggcggctaacaaaacagcacctgcgttaagggaggggtgcccccactgcggagggatggaaacgtgtagttcggccgtttatggtgatttaccaatcagccaaggatataagcagcgaggccctgctcattacaagcggagattataattatgatgccacgatgacgcngagtctgggtgggctacgagataaaacgagggattcatgtacacccatctttgagtgtggccagcccatcgctatgcaatgtgcggacactttgtgttgcgtattgtgaccggagcgacctacaaatacacttgcccaacagataacttagggcgagcggtgttggaatcaggcaccagaagggccgatgtctc

SEQ ID NO: 720636 - DNA, 265 bp, Homo sapiens
ctatacctattattcggcgattagcttggaggtctaggcacagctcttaggccttcttattcgagcgagcttggccagccaggcaaccttcttggtaacgaccacatcttcaacgttatcgtcacagccattcatttgttattatcgtcgtcatagtataccatcataatggaggcttggcacttactggttccctatatcggtcccgcatatgcgtttccggataacacatagcttgtactttactcctgtttcactcgctcag

SEQ ID NO: 720637 - DNA, 548 bp, Homo sapiens
acagagttctcgttgttgctgtctgttcgcactttctctttcggccgatgagaaaagtagccatcctgagtctccagggtgatgagcggacttgggtgtggatccagagcccgggcgggcagtgccccccggctggccggctgctgtcaccgcggttctccggggccgcctcaccgcgcccgcgcctggggcccccgtcctcctcctcctccgccgccgcctcctcctcctcctcgggctgcagccggctcggcgggcaggtcccggcgctcccggcgcggggccggggccgggggcggctgctccccgccgccgaccgctgcgcccccgcggcgctccccggccccggagtcgaggctgctgaaattccacacgaccagcgtctgcagcagcagcaccgtgagcgccgagcagcgccgagtgagcgccgggccagcctccgggcgcacggcgccgccaccatcttcggagcgcggccggcgagcgaggcgcggggaccccggcacgctccgggccgcccccgcgctccccgcagctcccgcggccgc

SEQ ID NO: 720638 - DNA, 307 bp, Homo sapiens
cccccttttttttttttcgggggggggcgggggggggaaggccccccccgggggcccccttttcttttttttggggggtttttgggccccccccccgggggggttttttttttttgggggggggggggggggctttccccccgggaaggggttttttttttttttttgggggggttttttttggcccccttttttttttttttggggggggccccccctttttggtttttttttttttttgggggcccctgggccccccccccccgctcttggggggggggaaaataagggggcccccgccccccca

SEQ ID NO: 720639 - DNA, 135 bp, Homo sapiens
agcgtcgggtgcgtatcgtcgcgggggggatctgactagaggtctcataatcccaagatggtagcttcgccatggctcctcagccaacgtggactagtactagtccagggttggtagtacgctggaatggaattg

SEQ ID NO: 720640 - DNA, 427 bp, Homo sapiens
gctcagttgatcctcacggtcaaatggctgggccagcatccggggaaaaggcagagtattaagtatctcatccggttactcagatttcaaagtatggcattctctctatcccattcattttctcaatattcttagaaagcaagaaagggataattagactcatcttagagatgaaaaaacggagacttggagatgacaacggaagcctaaaactctcaggttagataaataacagaggcggggccggggggttcatgccggtaatcccagcacttggggaggccgaggcaggtggatcaccggtggtcaggagttcaagaccagccgggtcaacatggcaaaaccccgtctctactaaaaatacaaaaattagcggggcatggcgggggcgtgcctgtagtcccagctacttgagaggctgaggcag

SEQ ID NO: 720641 - DNA, 491 bp, Homo sapiens
tggtcccgcgcaaagtctccccacaggtaaagtgtggaaaatactaaaaaagatgagggctacagagaatggctccaaacattctggacctaagtaagaaacacattgtacagctgtgacccaggaaacacacgactaccaaagcatagcaaagcgaaaacgaagatccctgaagcgccatgctgcgtgcccgtggcggacacacaccgctttctatgacattctgtcctacatttaaaacaacgttggtcataactcatgatactgatttccagctccagtaataagctgggatttgcagttgaaaacacactagcctagagtcaggcgccgtggatactagctttgccactactacacgtgaggcctcggccaattcagttaagcaggattgctgtgaagattcaaatgaagtcagtggcatattgaagtcaaatctacaagcgtagttttcctccttcctaaaaacatattttgtcccgcgttgtaat

SEQ ID NO: 720642 - DNA, 356 bp, Homo sapiens
gaagagggctcagatatagccctactgttgaaagggatgtgctatagcaattttgctggcttggcctggggacactgtgaacatggtggaggtatgatttatgatgtctcagtatcaagcttgtgactatctcatttacttcaggggaatcacaagttcaaacttccaggcagagttggatcagtctgttcctctctggtcaggcaggcaaggcgacggtgtcatgcgagtctactcagacactttgggactgtgacttcccaacccaaagaacaagtgtgcccactcttgagaaacggtgtactctcttgtttatgctggctcgcttctttaacagacgtgacgggatatgtagc

SEQ ID NO: 720643 - DNA, 613 bp, Homo sapiens
  misc_feature (191)..(191): n is a, c, g, or t
  misc_feature (202)..(202): n is a, c, g, or t
  misc_feature (220)..(220): n is a, c, g, or t
  misc_feature (273)..(273): n is a, c, g, or t
  misc_feature (275)..(275): n is a, c, g, or t
  misc_feature (278)..(278): n is a, c, g, or t
  misc_feature (285)..(285): n is a, c, g, or t
  misc_feature (298)..(299): n is a, c, g, or t
  misc_feature (332)..(332): n is a, c, g, or t
  misc_feature (347)..(347): n is a, c, g, or t
ccgcggtgctgacatcccggttgttcttctgtgccgggggtcttcctgctgtcatgaaggacgtaccgggcttcctacagcagagccagagctccgggcccgggcagcccgctgtgtggcaccgtctggaggagctctacacgaagaagtgtggcatcagctgacacttcaggtgcttgatttgtgcaggntccgtgctttncccaaggagatggtctcnttaagctttatgaaaactttatcagtgaatttgaacacagggtgaatcctctntnccncgtgganatcattcttcacnngtagttaggaacaggaattggaaccgtgggaanttccccgttaaaaantgggttgggggccgttcccgtttttaaaacccttttttatttttcccctttgggggggggaaaaaacacaggactcgtgacgaacggtgaacaagtagtgatgaggcagtgatcctgtgtaaaacagcaattggagctctaaaattaaacatcggggacctacaggttacaaaggaaacaattgaagatgttgaagaaatgctcaacaaccttcctggtgtgacatcggttcacagtcgtttctatgatctctccagtaaatacta

SEQ ID NO: 720644 - DNA, 240 bp, Homo sapiens
acgcattaaaaaatatcaatttgaagattgatgaaggtgagactgttgtgttggttggcccatctggtcaggaaagtcaacgttgattcggacaatcaatggattggaagacattcaagaaggtcagttgctggtcaatgactttgatctacacgatccaaaaacggatatgaaccgtatccgtagaatgttgggatggtgttccagcatttcaatttatataacataaatcaacattag

SEQ ID NO: 720645 - DNA, 833 bp, Homo sapiens
tccccactgtcagccacctcttctgtgatggtgagtggagccgcttaccccagctaggctgaagatgtcagcccaggagagctgcctcacgcctcactcaagtactatcgctcttcgattatacaagcctctatcttcttcgtcctcggcagacctgatcttctgcttcggccatctggaatcgctcactcgacgcagttacctacgcttctgtagtcgcttctgcttgggcgttgcgctctttcgtgcctcgtgcatggatctgtgtcctagtagtcctggaccatctctagtgactcttacaccagtgggcatcgccctcctgggttgtgtgggggccctcaaggagctccgctgcctcctgggcctgtatttggggatgcttgctgctcctgtttgccatcacagatcaccctgggtaatcctcatctccactcagcgggcccagctggatgcgaagcttgcgggacgtcgtagagaaaaccatccaataagtacggcagcaacccctgaggagaccgctggccgaggtagagctgggactatgtgcagttccagctgcgctgttgcggctggcactacccgcaggactggttccaacgtcctcatcctgagaggtaacgggtcggaggcgcagcgcgtgccctgcatcctgctacaacttgtacggcgaccaacgacatccacaatcctagcatacggtgatctttgccccatactcagcagggcttggcaccccctggcgcggccagactacagtgcagacatctgcgctgttccttgcaagaagagccagcatctacccggagggcttgccgcaagggcctccagaa

SEQ ID NO: 720646 - DNA, 119 bp, Homo sapiens
ggctcgcgagcagatacctaggtacacacaccactttttgcttgggaatgctgaaccatttgagaagagaaacttggcttctgttttcaaatggttcagcattcccaatcaaaaagtgg

SEQ ID NO: 720647 - DNA, 206 bp, Homo sapiens
ttctgaagtgttgggattacaggcgcgagccactgcccctggcccaggtatgttttttactgatggttgaatgttcctttttcactgtatcctgttcttgcaagatgtcatgctttctttcgtctctctgaggaggttttcctttccttcctgcctgcctttctttttctttcttttgtttccttcctcccttctgtcgtcttctc

SEQ ID NO: 720648 - DNA, 490 bp, Homo sapiens
cacaaggaaattgtatattctatgacacaagctcacaactccctgctttccactgcaagcggtggctcattactggctgggacgtatccttggattaatgtatgcacgcctctcttccttgtttcagagaaccataacaccctgagtgcagaacccctgtaattagagctgtcgttgttgcctccccacagcaagaaagcttttgcaagtttaatctcatcactgagaaagcttttagagacttcaaagaaagtatttgatgctgggcttttccttccacccagtgaaaaatgtgtcgaaggaaacgtaactaagttttaaatattcccctccttttttgtgtgtgtgcggttttgtcatttattgtgtagcataagtctacaactgtttatttattttgttgtttggtaattatattattccataagccttttcacaatcaatgagctataaagatgaaagtgtatccaataaaaactaagcttcctta

SEQ ID NO: 720649 - DNA, 413 bp, Homo sapiens
  misc_feature (380)..(380): n is a, c, g, or t
  misc_feature (406)..(406): n is a, c, g, or t
atttacctccagtgggacatataaagggtaaacaaatttaaatctaccaaagaactgggacttcccataaaaaaattaaacatcaaaaggagaactttcatatctgaccatagtggaatactggatattagaattattttcctgctaccaacagctataaaactggacaaaatatctgaagcaactatttttgggtctcagaaaacaagacagacatgtgattgtggataaaataaaaagatgtgaggttaactcaaaactcctcttggctttctgcctgagagcactttacaaatcatggtacaggaaactggagcccagtgagcagcatcttgccttgcggagtatcttagttcgttttctggcttgctgcaacagantacccagactggggtaattttttaangaggttt

SEQ ID NO: 720650 - DNA, 334 bp, Homo sapiens
tgaggagtcttacactctgcagcccaggcgggagtacaccggcgcattctcggctcactgcaacctctgccttccaggttcaagtgatactcctgcctcagcctcctaagtagtagggattacaggcatgggccaccatgcctggccaatttttgtattttcaatagagacagggttttgccatgttggccaggctggtctccaactcctggactcaagtgatctgcctgtctcggcctcccgaagtgttgggattacgggcgtgagcctctgaacctggcctgtctccatgcttcttccacagcctgaagaactgtgagccaaatgaacctct

SEQ ID NO: 720651 - DNA, 281 bp, Homo sapiens
gggcacttagagagagtagggccaggctggtgagctacatggacaggatattccctgacagtttcccactgtcacttgcagatcagagggtgtgattaactccattttctccagcagccataaaatgaatggggttctctccatattttgccagaagaggcagttatgattccacttctcctaatataatcattttaaattgagaacaactcatgatcacaattcataaaatccatattttaagacaatagttcttcatgtcacaaacacaatctattcta

SEQ ID NO: 720652 - DNA, 107 bp, Homo sapiens
tcggctcggtaccatcttgcgtccatcagctttgagaaatgaaggtgaaatgatgacttctcagatgaaaagaagaaaaagtaacttgctgatgggagaagactgcg

SEQ ID NO: 720653 - DNA, 831 bp, Homo sapiens
gagaagcggcaggaataacagaaaccagcagcgagcttcaagcagagactgagcaatactttaaatctttctgctaaacatgctcttctaacttctgatcaagatacgattgaggacttggtaactggctgtcttctatcagcaagagggctcgagagggccctgtgacactggtctgactccatcgcttctgactcactcgctaatccatgaggaggatgagtggcatgtcgcgcgcagacttcgcgccgtatcgtcgccagatcaccacgataagcgaatgaggccctaagaccgaacaggacaacccgtatccgattggggtgacgccgacaagttctgtctcgcccaagagacaggcaatgcctgagccttggtgccacccactgtggcatcgagccagacctcggtgtctgggctctgccgtccgctgtgatttacccctgagagacttgggcctggtacccaacatagaaagtaccaaccgacggcgcaactcctttgcattgagacagaggtcaaaaatttcctcgtcccacaaataccttcgtgcgccacttcctgtcggtactttgggtcgaataagtctccatccagcgcaaacaccctaacccccggagtgaactgagaaccgcgcttggcaaccttagcgggcccatatcgaacagcatcgctcgtgacaactagctaacaccaactccccaaaccgctcttgcgaccgcggtttgaaatcccgcttcgcaaccaacgaggcccccgcttcgtgcacagaggttctatacatccccaacctcgctccaggaccacccgcttgcggaccacccgttccac

SEQ ID NO: 720654 - DNA, 1128 bp, Homo sapiens
cgctcggagcttgtaacttggtacactatgtgcctcattgcggtcctgagcttcgttcgagaacaactgtgagatcggctgctattgccaagctcaccaacacctactgtctggtagcgatctggagtgctcagagaacttctacagttgtgttctgatgtgcgagctctccgataccatcccctgtgtgtgcactgctgtactatactgcctgtgctgcctgcatcatacgggctgcatgtgtgtgtgtgtgaacatgtgcactgtgtctcctggtacccaacaataccaccgaccagtgagctgcaacacattcgcaacagcctcccagacacagtgcagattcaggcgtggtggagtgagctggctctcagccttgggcaatgtcaccacctgacaattgactacgtggccttggtccacccagactatggacagtggagcacgagcaagaaattcttggcagcatgtgctcaaggtggcaagtcttcagcacacgaccagctggcctgaccactgtgctcagctagtgaatgctacttgtgtctctcacccaatccaatggactggcttgcctccatcccacacactatcaacttgaacacaccaggcatgagcttgtcctctacttcttcaagtccaaccctctgcttccgcggctacacttgctgcaccctacacccacctgacagctaccccgcctcgcttcccacatcgccgccatcgaacctgaccctgctctcgccctctctatgtcacccctgcacatcaaaccccccaccaccaaacttgctaccaacacgctgccacaccctgtccatccaacacctcaactacaccccccatcctactcacccacttgccaattcaccatcctgtcaaatctcacttcatttgcaccatccctcaccttcagaccgccctaaccaagtttgttccccataggcagactacttcggccctctgcacaccttaccggtccaaaccctcttctcccactccccgctcccagctctgcaacccgacttacatcaccaccgccactctgccatacaagcctccctctcacatcaccgctattctgccccctaaccctatacaaacgctaactacaccacttaaaccaca

SEQ ID NO: 720655 - DNA, 292 bp, Homo sapiens
aaggatccccggagggcaggtctcgtagggaagacatcagacaatataatatggtatggtaagaaggttggtgtgaatgcattaattatatgtgtgtctctggctacttacagcagcataggagcaggcatggagtgggtagagagctagattttactaggacagtattaatggggcaggagaggtgcgggcgtctgtcagaacactgcttataactgactggcccttgacccttaaacctgggatgaccgacggactccgggacactactccaggacccccatcaacggta

SEQ ID NO: 720656 - DNA, 553 bp, Homo sapiens
ttgcgtagggggcgggactaaggctgtcaattggtctgttttttgtgccgatcaatgagatgggtgcggtgattggctgactaccttgagagtagcgggttgagtgtgtaagccctgagtgagtgcagcgttttcttgggctatctgtctggtatctctctctaccagaagtgttctgccgtgttcccccagctctggtgtaccctggctctgcatctgcgtcgccatgatgtggccatacgtccagtgctcgtgctcagccagaacacaaagctgtgaatccgtgaagaaaagttcaatcttggaaacatcaatgcttgccaagactatttgcagatatcatccgaacatgtttgggacccaagtccatgatgacagatgcttataggacacccaatgggaggcattgtgatgaccaatgatggcaatgccattcttcggagagattcatgtccagcatccagcggacaagtccatgatctgaaattaggcgggaccccaggatgaagagggttggagaatgggaccaacatcagtaattcatactttgcag

SEQ ID NO: 720657 - DNA, 815 bp, Homo sapiens
  misc_feature (117)..(117): n is a, c, g, or t
ctgggcccccggcaacctgcccccgggattcacagagcagccccccccgttgcccccacagccgcccaccgcctcccccagaagaaaccctgcccggggcgacaaagtccacccccnccgacccacaaaggccacccgagaggacccctggatctctctgcacacggaagactctgggtcctctgtcccaagctatggtcctgcaggccccctgcacccaaagccctaggaagtcgcaggcacacccagttgaagcctaaccgggtgaaacccctcttataactgtgtggctgccaacccccgatgagcgtcacccttctccgagggggatagtgatccatcgtggaccggggaggaggaccccggagtggtggattggcccaccattgatggagatcctggtccgccaaggcggccattccccggtgtccaattgtgccaacatttatcgctgactgaattgctactggaccaagcacttacacgttatgttcccgtttcgttattggtacccaaactcttgccacgataacccgtttcatgagactgtttgtatggcaacgcccactgttctctaaagcccctgctctgttttaaaaaactccacgaggccatttttacatatcacgtaaattgtttttataaatttgtggttttcatgagaaccttgctaagcatttattaggaaaactgaatttccccaccggtgaactgaaaagttattttaactattatacataatcaagatcctgcctttacgggattagcttaacctaaaaagtttgcattaatgaataaattcttcctgcattcca

SEQ ID NO: 720658 - DNA, 393 bp, Homo sapiens
  misc_feature (317)..(317): n is a, c, g, or t
  misc_feature (327)..(327): n is a, c, g, or t
  misc_feature (357)..(357): n is a, c, g, or t
tgattggagaactaaggatgtaagaattctttatattctatcctgaattctgaaaattatagtgtaaaaggatgtgcaggctgggcatggtggctcacgcctgtaatcctagcacttcgggaggtcaaggcagaggattgcctgagcttaggagtttgagaccagcctggggcaacgtgggtgagatcctgtctcaaataagtaaataaaaagatgtgcagaattacattttgcataatatatgggggagcagtaagatctaggaatatggaactgttgttcactctgggatttttccacctgggtacttctggacntgaatttaantattctccaattgaggccaggaccaaaccngggggtttcccccaaaactttaaggccaaggaatta

SEQ ID NO: 720659 - DNA, 620 bp, Homo sapiens
  misc_feature (13)..(13): n is a, c, g, or t
  misc_feature (69)..(69): n is a, c, g, or t
  misc_feature (72)..(72): n is a, c, g, or t
  misc_feature (101)..(101): n is a, c, g, or t
  misc_feature (111)..(111): n is a, c, g, or t
  misc_feature (116)..(116): n is a, c, g, or t
  misc_feature (118)..(118): n is a, c, g, or t
  misc_feature (123)..(124): n is a, c, g, or t
  misc_feature (126)..(126): n is a, c, g, or t
  misc_feature (138)..(138): n is a, c, g, or t
  misc_feature (148)..(148): n is a, c, g, or t
  misc_feature (161)..(161): n is a, c, g, or t
  misc_feature (184)..(184): n is a, c, g, or t
  misc_feature (190)..(190): n is a, c, g, or t
  misc_feature (193)..(193): n is a, c, g, or t
  misc_feature (196)..(196): n is a, c, g, or t
  misc_feature (203)..(203): n is a, c, g, or t
  misc_feature (211)..(211): n is a, c, g, or t
  misc_feature (232)..(232): n is a, c, g, or t
  misc_feature (255)..(255): n is a, c, g, or t
  misc_feature (295)..(295): n is a, c, g, or t
  misc_feature (380)..(380): n is a, c, g, or t
  misc_feature (508)..(508): n is a, c, g, or t
  misc_feature (589)..(589): n is a, c, g, or t
gtcctggtactgntggtactcggacaccaggtcgttcatgttgctctcggcctcggtgaactccatctngtncatgttctcgcccgtgtaccagtgttggntggttttgtnccggnanatggnngngaactggtcggngatgggcttntttagctcctggntgggggtgctgttgctgatgttngtgggnganatnttcaggncggggggngggatgttgcacacggccgtnttcacgttgttggggatccactncacgaagtagctgctgttcttgttctgcacgttgagcatntgctcgtccacctccttcatggacatgcggccccggaagatggcagccaccgtcagtagcggccgtggcgcgggtcggaggcggncatcatgttcttggagtcgaacatctgctgggtgagctcgggcacgtgagcgcccggtactgctggctgccccggctggtcaggggcgcgaccggggcatgaagaagtgcaggcgagggaagggcacntgttcaccgccagcttgcgcaggtctgcgttcactggcccgggaagcgcagcaggtggtgacccgctcatggtgggcgacncaggtggttgaggtcccgtagtgggggtggt

SEQ ID NO: 720660 - DNA, 1716 bp, Homo sapiens
  misc_feature (196)..(196): n is a, c, g, or t
  misc_feature (217)..(217): n is a, c, g, or t
  misc_feature (1332)..(1332): n is a, c, g, or t
  misc_feature (1631)..(1631): n is a, c, g, or t
  misc_feature (1633)..(1633): n is a, c, g, or t
  misc_feature (1636)..(1636): n is a, c, g, or t
  misc_feature (1640)..(1640): n is a, c, g, or t
  misc_feature (1647)..(1647): n is a, c, g, or t
  misc_feature (1653)..(1653): n is a, c, g, or t
  misc_feature (1663)..(1663): n is a, c, g, or t
  misc_feature (1672)..(1673): n is a, c, g, or t
  misc_feature (1681)..(1681): n is a, c, g, or t
tgcgccccgtggacgcctgggtccgagcccgctcccggcttggcgcggacctgcatcccggagccgctggcggctcgggcgcctgcaccccgctgaggagctccggagggcgccggggtggcggagcggaggcggccggcaaggtgagagcggcggctgcgcgctgggaggagcagcaggtgcaggggcggccggnggcgcgggcagggggcaccgngagccgcgcccgtacctgggacccgacgccgcccggtgcccgcgctggccggcagagggcagcggcagggcgccgcgggccacacatggctgcgtgaccgcgggatgctgtctgtccccttgctcagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgtctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgaacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtncacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccaaccccagctcctctgggcaccagcccacccgctgacacctcgaagtccctcacactcgggtgagcctnanggnctgnctggctntggagncagagcctgngggcccagnnggctgggnagccagcagccacactgcgcgggggaaagccaccg

SEQ ID NO: 720661 - DNA, 1515 bp, Homo sapiens
  misc_feature (1131)..(1131): n is a, c, g, or t
  misc_feature (1430)..(1430): n is a, c, g, or t
  misc_feature (1432)..(1432): n is a, c, g, or t
  misc_feature (1435)..(1435): n is a, c, g, or t
  misc_feature (1439)..(1439): n is a, c, g, or t
  misc_feature (1446)..(1446): n is a, c, g, or t
  misc_feature (1452)..(1452): n is a, c, g, or t
  misc_feature (1462)..(1462): n is a, c, g, or t
  misc_feature (1471)..(1472): n is a, c, g, or t
  misc_feature (1480)..(1480): n is a, c, g, or t
tgcgccccgtggacgcctgggtccgagcccgctcccggcttggcgcggacctgcatcccggagccgctggcggctcgggcgcctgcaccccgctgaggagctccggagggcgccggggtggcggagcggaggcggccggcaagggcggcgtgccggcgatggagcgcgcggtagagccttggggcccagatctccaccgcccggaggagagggagccacagagaggcgcccgcacaggtctagggagtgagaacgtgatttctcagccgaatgagtttgaacataccccacaggaagatgacttggggttcaaggaagaagatttggctccagatcatgaagtaggaaatgtctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgaacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtncacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccaaccccagctcctctgggcaccagcccacccgctgacacctcgaagtccctcacactcgggtgagcctnanggnctgnctggctntggagncagagcctgngggcccagnnggctgggnagccagcagccacactgcgcgggggaaagccaccg

SEQ ID NO: 720662 - DNA, 1434 bp, Homo sapiens
  misc_feature (1050)..(1050): n is a, c, g, or t
  misc_feature (1349)..(1349): n is a, c, g, or t
  misc_feature (1351)..(1351): n is a, c, g, or t
  misc_feature (1354)..(1354): n is a, c, g, or t
  misc_feature (1358)..(1358): n is a, c, g, or t
  misc_feature (1365)..(1365): n is a, c, g, or t
  misc_feature (1371)..(1371): n is a, c, g, or t
  misc_feature (1381)..(1381): n is a, c, g, or t
  misc_feature (1390)..(1391): n is a, c, g, or t
  misc_feature (1399)..(1399): n is a, c, g, or t
tgcgccccgtggacgcctgggtccgagcccgctcccggcttggcgcggacctgcatcccggagccgctggcggctcgggcgcctgcaccccgctgaggagctccggagggcgccggggtggcggagcggaggcggccggcagaggcgcccgcacaggtctagggagtgagaacgtgatttctcagccgaatgagtttgaacataccccacaggaagatgacttggggttcaaggaagaagatttggctccagatcatgaagtaggaaatgtctctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagatgtcagatctggtgaaacaccagcggacccacacaggggagaaaccctacaagtgtggggtctgtggcaagggctttggggatagctctgcccggatcaaacaccagcggactcatagtggggagaagccctatagagcccggccaccagcccagggtcccccaaagattcctcggtcccggatccctgctggtgagcgccccactatctgtggtgaatgtggcaagagcttccggcagagttctgacctggtgaaacaccagcggacacacactggtgagaagccctacaagtgtggcatatgtggcaagggctttggcgacagttccgcccgcatcaagcaccagcggacacaccggggggagcagcccccccgaccagtggtgccccgaacggcagccatctcgggcagccacggcagctacccagggaccgaaggcccaggacaagccatatatctgcactgattgcggcaagaggtttgtgctcagctgcagcctcctgagtcaccagcgtagtcacttggggcccaagccctttggctgtgatgtgtgtggaaaggagtttgcccggggatccgacctggtgaagcacctgcgggtncacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccaaccccagctcctctgggcaccagcccacccgctgacacctcgaagtccctcacactcgggtgagcctnanggnctgnctggctntggagncagagcctgngggcccagnnggctgggnagccagcagccacactgcgcgggggaaagccaccg

SEQ ID NO: 720663 - DNA, 341 bp, Homo sapiens
  misc_feature (6)..(6): n is a, c, g, or t
  misc_feature (55)..(55): n is a, c, g, or t
  misc_feature (104)..(104): n is a, c, g, or t
  misc_feature (185)..(185): n is a, c, g, or t
  misc_feature (208)..(208): n is a, c, g, or t
  misc_feature (285)..(285): n is a, c, g, or t
  misc_feature (298)..(298): n is a, c, g, or t
  misc_feature (312)..(312): n is a, c, g, or t
ttgcgngtatacgcccagatggcctgaagtaactgaagaatcacaaaagaagtgnaaaggccctgccccgccttaactgatgacattccaccattgtgatttgntcctgccccaccttaactgagtgattaaccctgtaaatttccttcttctggctcagaagtcccgcactgagcaccttgtgncccccgcccctgcccaccagagnacaaccccctttgcatgtaattttccattaccttcccaaatcctataaaacggccccatccctactccctttgctgnctctcttttcggnctcatccggcctgnacccaggtgaaataaacagccatgttgct

SEQ ID NO: 720664 - DNA, 823 bp, Homo sapiens
tatgagctacacatctgtctgattaacatagctctataagaagtcatgaaatcacatagtggagaccactttttctttttaaaaatgttttgctattacaagactttcgcatttttatataggttttagaatcagcatgccagtatcttaaaaaaaaaaaaaaccggctgggggatttgggtggggattggggttaaattggaaatcttaacaatattacgcccatgagcattggtctatctcttcattaattaaggtcttcatttctctcagcagggtttgggtagctttcagagtggtagtcttttccacatctttaactaagtttttacctatgtgtggaatagaatggttctctaattttctggattaattctgcgtatacagattggcttgtttcattacaacttgtaaagtcattattcttataaatatgtggggaggattctatgtagatgatcatatgtggaaaacagttttacttcatccttcaaagtttgcttccttttcccttggagtacctgtgaatcagagactaggtgacgtggtagattccttcgtaggttgaaaactttattaaccacagttgcttacaagtggatgatgggttttgacatgtgtcagatgcccttggtattgttgacttgtgtacagtcacggggaattatgccactgtatgcctatagttgaaatcgctggggtggcaagtacagaggggaatgaaggctggggtaaggaggaatcctatgtagggtaaacagatatataaaaccagatcctataaacgtatgcgagcggccaaacggaaacaaaataataaagg

SEQ ID NO: 720665 - DNA, 279 bp, Homo sapiens
gttggagatctcttccttagagtaatgatttccaacatttttttttttggagacagagtctcgtcctggtcgcccaggcgggagtgcaagggggtgatctcggctcacggcaacctccgccggccgggtccaagtgattctccggcctcagcctcccgagtagcgggaactccaggcgtgtgccaccacatccagctaatttggtattttaagtagagagggagttccatcatgtgggccaggcgggtttcaaactcctggactcaggtgatccaccgg

SEQ ID NO: 720666 - DNA, 120 bp, Homo sapiens
aagctctgtctctgcaagtctctgtatgtctgtgtgttttcacccaggtttcacagtggctctcagcaggagagctggtctgacctgtgagtcccgcccagcacatggcacgcgacatcg

SEQ ID NO: 720667 - DNA, 138 bp, Homo sapiens
aaatttaccatcagcatatcacaactacaatcacagcttattggtcactatacatgtcgcacaaaatcactacaccatcattctcacaatgccactgacatcactactgtgtggatcagaccacataaaatgcctcca

SEQ ID NO: 720668 - DNA, 700 bp, Homo sapiens
  misc_feature (212)..(212): n is a, c, g, or t
aaggatgagaaccctgaaatgcatactctctccgatataagtctgtgtattatggcttagaacatctcgtgacgtggatcaatatcaagagtgccatctatcctacaaatacaatcgcatatagtccattattacccgtcgactgtctcagcgcaaacgacaatggacaatgctcaattacaggtaacgcgtataacttagaagacgtaacnatgggaagtacgcgcaatactctcacacacctgacgcgtagtgtgtatcctaatagagacaatccagcgtctcatgaccagtccacccaagtcatagcacgcaagggacatcagacgtggtcgcaatgatagacgacaaatgtttgctaaacaggcgcacgcgcgagtgcactctctacatctgcttgcattacaggcgatacagcgtctctagctctcgcagttagactcccttttgctacactcagcgtgcatcgcttgtcaattgcacatcgcggcatcgcaacggaaaggagggttctccaagacatagttcatacttttacgtttctctaagccatcttggacaaatgggaacctgggcctcggtgaacagaaagggctgcgcgtcaatgtacaacaagggctagcgagcagagaagaggagactcgtaatgggagcctcttccatatgaaatacagctggcgcatacacgtaaccatacacc

SEQ ID NO: 720669 - DNA, 323 bp, Homo sapiens
  misc_feature (3)..(3): n is a, c, g, or t
  misc_feature (135)..(135): n is a, c, g, or t
  misc_feature (275)..(275): n is a, c, g, or t
ggnaagatctgattaaggtcctggaggatatgagacaagaatatgagcttataataaagaagaagcatcgagacttggacacttggtataaagaacagtctgcagccatgttccatggaggcagccagtccagcncactgtgcagagcaagacaaggtgacatttccactgaactgaatgcgcacatttccatgtgccctggatgatttgaccctgcatggcgcaggtacaatgcactgaaattcttgcttgtggaaaacattgttatcgcgatngacccatgtctctggtactccttgcaaggctccatggaccattgcaag

SEQ ID NO: 720670 - DNA, 214 bp, Homo sapiens
tagacacgaaccgtgcctcgatgccggcgtcggcgtagggcttgagggcctcgaacaccatgaccggacccaggtcggatccgccgatgccgatgttcacgaccgtcgcgacccgcttgtcggtgacgcccgcgaactctcccgagcgcacccgctcggcgaacgcgcggatacgcccgagcacctcgtgcacgtcggtgtcgatgtgctgtcc

SEQ ID NO: 720671 - DNA, 666 bp, Homo sapiens
  misc_feature (191)..(191): n is a, c, g, or t
gggcccaatttaccttcctaaacaagttttggagtgtggcatagaacatgttttaagcacctgtatggccattctatgtatgtagtgcaaagacctctccatgtcatgaattctcatcacaccatttttgcttcctaaaaaggttgacgttatggaccaaaatgtcatgtcattgtgtagctcccctgacntatctttgtgcaagtgtgagtttgctacacatgctgactgcatggggcctgatttatccacaggacttgattctagaaatacaaaagcactgttgtttcacagcagcccgacgagtaggccctgcatggaatgaggcttttgctatgtcttcctgcatggtcacctctagtcatttgagagcttccattgcatgcagatcacacatagtaggagatgccatcaatttatcaattatttcaagcacactttaaattcatcttccctctgtctacctgagaattgctaatgttatattattcactgaccacaaggaaaatgagaaaattggttgctatcatttcactatctatagaagacaaagcactgtctttatttttacagtagaagtgctctaaagaatttctgtgtcaacttgagatacttttcacaaagacaagaagcattttactttgtgagagaaaagagaataattaa

SEQ ID NO: 720672 - DNA, 556 bp, Homo sapiens
  misc_feature (249)..(249): n is a, c, g, or t
  misc_feature (403)..(403): n is a, c, g, or t
tgatagctgactctagaggtatcccggtaaccacggctgaaactggattgactgatgcttgtaggatagacatgccgcagatgggcagagctggtggtgggctctctggttgggtgaggcactggcagggatgtggtctcattgtcatgatttgcatactgtttgctgtgagccccacccccttctttgttcctagctgactccagtggtctagccctcccatttcttccctatgaggcaagacagacntggatctcctggaaagcaccctggaaagctgggaaagttggggaagctgaatgtctgccttgggctttctttttcccactgcagaaactataggcccaggggatcactctctggccccatgtgggcctggtgaggggcgatgcagtcaaaaagncaagccactcttacccgtctaatggggctgttggtatttgtgctccaagggagtgcttaagccctaggctctggaattttcacaaaggtgtccttgtctgtggataattactaattgacatttctgtgatagtgactagaacctggacctcct

SEQ ID NO: 720673 - DNA, 358 bp, Homo sapiens
ccctgaatatgatcctgtcaatcggtgcctgtctgcatgcactgtagagggtctattgttctgtgagctgttctaagagctcaccataacatagactcatgcacatataggtagtactctagtgctagacgatagttattactaggctctatccttcgttctgacactatgcgtttcatatatgcatctcattatgtcgtagggtcatagagtcctgttccactcataacaggtctactcacatatgtgccaagatgcgtagaatattagtgcgtcagtgatcatcagcgacagcatgtagcagcaggtagctaacgttatcaccatggttttagataactatcgctgagcgtcaccg

SEQ ID NO: 720674 - DNA, 421 bp, Homo sapiens
ccctgctcgagcggcccctcggacaataagacagtggacatcatgacgaggactccgggtggggacctgaactggtacacctgaccctgcaattctagccctcatttaagatttgagtggtgaaaccaaatgaaaaacccctacagtgagtggaatcttttaatatactgttggctttagcaggaacagaactacaggagccatctctctcccctctcctccgtaccgagaggaggggtgggtctcagacgttattcctatggacttatttcttccatgtccagtgatttgcacaactttggtttcaaaagctgttgaaacataggaaaaccaagggcattgttcacagataggtgccaagtctcaccttgcatgtgtgcctctgttctgtccctgccccaacgtcacttctactaactcc

SEQ ID NO: 720675 - DNA, 190 bp, Homo sapiens
cgcgtagtggtctcatcaaggtgaacgggcggccgtggagatgattgtagccggcacgctagtagtacaagctgctggagccagttctgcttctcggcgaggagcgatttggtgtgtagtacattcgtgtcgtgtacagggtggtggtcacgtggccgagatttatgctatacgtcagtccatctccaaa

SEQ ID NO: 720676 - DNA, 1758 bp, Homo sapiens
tggttcttggtacaaaattttattaaagggtcttttagaaaagcaacattccaaatctccaaaattacagctgtgccaaggaaaaccctgtgttaagtgcgtggtggggacgtggctgtggggcatgtggcagggcggtctcgtggctttcccaccctttcgtgtctctgaaagtggcgggtgtgggtgggcagatattctctaatctctttgtgggttctcacacaaatgtgcctcaccgtgtggtctcagggccaagggcgctctctctatatagggcgccaaatctcttttaccacacggtaggggtctccacagaggggccacgcatgtagatctccttttcacacctgtttgagtagtggcccccaaagacaacacacccgctgtgtgctctgtagaaacccaacacacaccgtgtgccgcgcgccacacagaggcagcagtgtgtctcacacagcgtgttagccgtcaagtctatacacagaggggcgctccctcgcgggagctgtgtgggacaactcacactcaggagcgcccaaactccccaacgcacacactttctacacagtggggtactcttacgacgccccctctgctgttgtcgccaccacttcgcgaagaaaagtattttctccccccagaggaaaagacaacccacaacaaacactctcttccggactacagccccttttgtcggggcccccccacacttcctctcccagagtgactaagtgaccaaaccgcggctaagcgacacaaccccaattgagcggaggggtccccctccgcggcccaaaccaagcacagaaggcactccctccccatgacgggaaagatctctgcgtctaccaccgcgccgacgacacgaaaccttctgatgccgccgtgggacccccaaacttgtgcgcccccaccaccagaagaacacacctctcctattagctggtgggcccccaccaccttctattcacccacagcccatattacagcaagcccttccatacaccaccggtggccccccatcccgggcggacaaagccgccccaaacaccccctctactctctgtgaagaacttaccaagcgccacactacagagctactccccgcgatcaaacttcaccgccaccggggcccccttttctctccacccccacacgaaacaccctcccgcggcatgccaccgcgcgacgtggcccaccaagcaaacaacaccgagcacctcacctcgtcggacccccgcgtactcttggtgacgaactaacactatcgccacacccactacaaaatctccccgcacacacgatgaccccaacttcattacgaccgcagggtcccatcccacggatcaaaaaccaagcctcctatcttcacgagtatcaaccgcacatgctgcatcaaactagctccccactccgcagcagcacaaacacttccccccctactctgtgaagaccatattctgggcacagtgccaccatgttgcacccttattaactccctctagcctgcctaagccgcgcgactacactgtctgttacacacatcgaccagagaacaacgagctctgacggcacgcgacaaactctgcccggtagctacgacccggcgctcacaagacgagacctcctcctccgatcgtactgcacacaaccccacttttcgcacgcaccgaacacgtcatcgcaccatcagatgccagccgctaagcacacaccacactcaacacacacggccgcctgcgccacttatttatg

SEQ ID NO: 720677 - DNA, 87 bp, Homo sapiens
acatctgtgtacttctgtgccagcagttttcctggtacaggcgtaggaggctacaccttcggttcggggaccaggttaaccgttgta

SEQ ID NO: 720678 - DNA, 826 bp, Homo sapiens
ggcaacaacgcgccgcggcgacgggggctcaaggcccccggacaagagaagctgagtcgtgacggagaagagcaccacgtagtcttatcgagcccatatcgtcttggaggcatctcttccacggaggagatggacctgaaggtacatacagttcaagaacagacgaaactggcacgagcggctgggcacaagcggcaggcttgtgaagatgaactccgagaagcgaattgagaagttggagaagcggcaggccacagatgatgccacattcctcatcgtcaatcgctactgggcccagctggatgacactgtggaagcccattctccgtagtgcctatgagagccatggggtgatgctgtgcttcagacgacctgatggcacactgggacccatggaagggagccaacatgtgatagtggactgcctactcccagagccggggacatcagagctgagagaagccctgtgatgagtgcaggatgcagagacccctcatcaagtgagacacggccatatggcattgagagatgcgtggcactgaggatgcaaagaaaggcacgtgaaggaggctggaagcatggaagcatggaaggacgcaatggcaatacagcacaaaggcacgaatgtgtctcgtgtggtagacggactcaggaccgactacagagaccgggatggacggaaacatcagacaagagacgtgtacagcacgacagggcacaggagccccgcagtgaggcgggccaagcaaagacccagagaatgggccgagaaaaccgacgaatgaaggactggccaccaactggaaaaaacaccacgaaccaagga

SEQ ID NO: 720679 - DNA, 163 bp, Homo sapiens
agtgtacagcagagaaggggtgcagcaggtcctcggccagtgtgatgcgctgggcagggtcaaattctaacatcctcctacatacaggtcaaacagctgcacgtgctccagggtagtcttggtagcatgtaactcttcagaaggttttgggtaccggagctcg

SEQ ID NO: 720680 - DNA, 711 bp, Homo sapiens
  misc_feature (1)..(1): n is a, c, g, or t
  misc_feature (683)..(683): n is a, c, g, or t
nagaaaatgaaagtgattagcaatatgcaaatgttgacatttttgttgcttagcaatgtagctcttttgcatagtaaaaaataaaataaaataaatggtttccagaagcctggaatttaaaagtaaaacagtaacttctcttcacatcaaacaaaaggcatttggcttcttccaaacatacagagtaaaaagcccaagattgtttcttctatagctttctaacttcacttatgtattcctgtgttctttcacactcttttggtggagctgtatgctgctacacaatggtgttattttgatgtcatttttttcagttattcctaagggtgaccagactatgattacggtctgagttcccttaggcctggcatacaattcattatttttcctcaataattctaagtgatagttgcattaggtaattaacttagagtcaaattgaaagagagcttctcttttcatctgtgaacaaaatttataagtttatgtaattatgttattgcaaccatatcactacatgctttggccatttaagtaacaaaggcaaatattaaaacagttttcacatttcatgctaaatcctcaggtaaacaattcttatgtaaactgtaagtactgtcttataacactttgttttgccccgtatccattagagattgtggaaatgtattgcagcttacaanatttttaaaatgctttgagcctcaaaaa

SEQ ID NO: 720681 - DNA, 327 bp, Homo sapiens
  misc_feature (20)..(20): n is a, c, g, or t
  misc_feature (52)..(52): n is a, c, g, or t
  misc_feature (55)..(55): n is a, c, g, or t
  misc_feature (84)..(84): n is a, c, g, or t
  misc_feature (205)..(205): n is a, c, g, or t
  misc_feature (240)..(240): n is a, c, g, or t
  misc_feature (270)..(270): n is a, c, g, or t
  misc_feature (310)..(310): n is a, c, g, or t
  misc_feature (317)..(317): n is a, c, g, or t
aataatttgccaaaggtcantcagctgactagaatttaaacctgtctaggcnggncgcagtgctcatgcctgtaatcccagcantcgggaggccgaggtgggcaaatcatctgaggttggcagatcatctgaggtcaggggttcaggaccacgctggccaacatggtgaaccaacatctctacaaaaatacaaaaattagccggnatgatggtgggtcctgaatctcagctactcagagntgagacatagaatcgcttgacccaggaggnggaggttgtagtgagccgagattgtgccattgcactccancctgggnaacagagtga

SEQ ID NO: 720682 - DNA, 855 bp, Homo sapiens
tgaactaatacagaagttggtaccaagagtggggcattgctgaaaagatacctgaaaatgtggaaggaattttgaaactgggtaacaggcagagattggaacaggttggagagctcagaagaagataggaaaacatgggaaagtttggaacctcctagagacttgttgaatggctttgacaaaaatgctgatagtgatatgaacaataaggtccaggctgaggtggtctcagatgaagatgaggaacttattgggaactggagcaaaggtgacacttgttatgttttagcaaagacactggtggcatttttgcctctgccctagagatttgtggaactttgaacatcagagagatgatttagggtatctggcagaagaaatttttaagcagcaaagcattaaaaaggtgacttggatactgttaaacattccattttaaaagggaaataggccgggcacagtggctcacacctgtaatcccagcactttgggaggctgaggtgggtggatcacctgaggctgagttcgagaccagcctggccaacatgaagaaaccccgtgtctactaaaaatgcaaaaattagttgggcataatggctcatgcctgtgatcccaactagggaggctgaggcaggagaatcacttgaacccgggaggtggaggttgcagtgagccaagattgcgccactgcactccagcctgggtgacagagcaagactccgtctcaaaaagatttttggtggtgttaaagaggaaaacagagcgtaaaagttcagaaaatttgcagcccaatgatgcagtagaaaagaaaacccattttttgaggagaaatttaagctgactgcagaaatttcc

SEQ ID NO: 720683 - DNA, 263 bp, Homo sapiens
tgacttagaggacccaagctccaacaagacatgctgaaggaatagcaattcacctacacagttctggaggatggttgcacgaaacacactgggaatggagcaaacaggtctttgagttttcgaacacgcaggctgtgagactacctattgtagatattgcaccctaatgacattggtggtcctgatcaagaattttggtgtggacgtgggccctgtttgctatattataaagcaaaaattctatcttgaaaattccaaaaaaa

SEQ ID NO: 720684 - DNA, 339 bp, Homo sapiens
  misc_feature (182)..(182): n is a, c, g, or t
ggcacctcagtcaatctgattttgatttatgtagaccccccaagacatataccacaccatctctgacataggcacctgagttctggcctgggtttacgctgtggagatcacatgactggagcggatgggtggacagaccaggaatggagctcgtgagagcaggctgcaggtgatggagcttncagaagtgggcggctgtggtgttgccttctggagagtagcagagatacagctgccatgttccgcatgagggtcttgccaagcccctcaggctgagattgggttcagggagggagatgggggtgacatgtagcttagggaaagcaggagcctctctgg

SEQ ID NO: 720685 - DNA, 138 bp, Homo sapiens
tgcaccccagcttgaacaacagaacaagactcagtctaaaaaaaaagccaagttatagtggccaggcacagtggttcacacttgtaatcccagcactttgggaggccaaggtaagaggatcacttgaggccaaggtaa

SEQ ID NO: 720686 - DNA, 193 bp, Homo sapiens
aaaatgaaaagctgtggattccttccagactaagaaggtttgatcaagcaagaccccctgaagcattggcccaaataatcctacatttgaaatagatgagatgatcgagtcatagaccactacagcgaggatttctgtgttttatcatgatacccattgtatggacaacaccccaaccagcaggaacgatttg

SEQ ID NO: 720687 - DNA, 127 bp, Homo sapiens
ccccttgtttcccccccgttttgggggggggggggccccccaattaatcccccccctccttggggggggggggggttttgggggtccgcccggcccggtttttttaaaatttttttaattttcccca

SEQ ID NO: 720688 - DNA, 104 bp, Homo sapiens
ctggatgctttaataattagaactattgcactcttataccgctattcatacaaaacagataattcaactatagtaggaaagagttcatagtatgtttgaccaca

SEQ ID NO: 720689 - DNA, 141 bp, Homo sapiens
  misc_feature (65)..(65): n is a, c, g, or t
  misc_feature (75)..(75): n is a, c, g, or t
  misc_feature (134)..(134): n is a, c, g, or t
gggttacagaggaggggagcttccgtggctccctgaattagaaggtggctgcagcctcagccggntagggatgangaggcttggttaacacctagccgttgcaggcagagagaggaggcgaggaaaggcctggngtgtggg

SEQ ID NO: 720690 - DNA, 236 bp, Homo sapiens
tggcccgaggtaattcattatttgtatgaagttataaaagtagctgtaaatggttaggaattatgtcatttgtattaaacccagatttatttttaagaaaggggttcaagctgttgtgaaaaaagttttaccttttacctttgtcagtttgtaaagaaaggatttccttttaccctttgtaggtcaaagagcccccgatgtatcatttcaaacccaataaacagggtcgtgaagga

SEQ ID NO: 720691 - DNA, 158 bp, Homo sapiens
tctgtccaatcataacacagggaggttagaagtaggctggtgacaaaatatgttgtgtagagttcaggtgagagtgcgtcatatgtttgttcctaggaagattgtagtggtgaaggtgtttattataatacatgtttgcttgttcccgctgggtggac

SEQ ID NO: 720692 - DNA, 1559 bp, Homo sapiens
gcaagaggtatttctgctgtggaatgtggcccagtgccgaggagacgccttcagacacatgaatctccagaagtcctgtgagacacagcattgatgcccaccagggcattctggtgtgctgtgaccccccaggtgacatggtggacttcgtggcagctgagagcactgagtgaccttacgtgccctgagcagctgaggaggaagaagacatgggcaggttgccgccagtgagcctgagagccttcttgcaccatcctgtgcttggaccagtgccagctgtcaatttgctggacgctgacttatgtcgagcaaggttctcatcagtgatgtgaagcatgcatgtgtgcacatggcagtgacatgcaatgtcccagagtggcttatcgcggacgccctgctgcggattggtcatgcctgtgaggcagacgtagacctgtttgactcaaggcccttgggtaggggccaagaaccgacagaaagtgtgaccttggggactcgggaattttggccaggtaggcacaacaagaaacatccacgtcatggcattggtaccatgacatacttacacaccaaagacaacgattggagacacacatccaagattgatcggagtgtcgttgtgcccaaacacagacggtgaaacaacacgaccccgttaagacagtggatccagaaattggggggacatgggggcaaggacccagccccaaacatgaagcacgcgaatgggcaatgggagccacgaaggattggggaagggccacttagaacaccgggggattccatatcgccataggaccgatgagaacaaaggacacacgggggaacagttctcaaggacagacgaatacgattccgacaaagccgcagggaaagaaaaaagccgcgggcactgtgtgttaggagcaatgaatgacaacgcgaagaggcacactatacaccaggaacggcccgtcacgtttagtgttggcacacaacgaacacgtttggcgaatgacagaagcacaacacgaccacgagtgaacgattggccacgagggcacgataacacatgcacaggtagtgcccaggaagaacagggcccagggaggggacagacgaagggacgcgcgcacaaccacgagtaacaacgaattagacacccgagcaacaagggcggtacaccgctggtgcggtcagaagaatcaaacgaaagcgtccaggacaagtagctaccgagcagaggggttaacccaagagcactggacacataacaacacacaccgggggaagccgcaacgaaaaccgcaaagatagaaagcgcagacgggaacaaccacaacacaaagaacgagggacggaaatagagaccgaagagaaaggaaaaacggagaggagagaacatcacacagggggacacacagaacaaaacagaggcagagaggaccaccaatggaaatcgagacggaacacacgaccaaagggcaaggacgaagaggaagaagcgggaagaagagcaaaacacaagaggagggcgaacacagacacaacgacgaaaacaaaggcatcgacgaagaaac

SEQ ID NO: 720693 - DNA, 455 bp, Homo sapiens
  misc_feature (139)..(139): n is a, c, g, or t
  misc_feature (270)..(270): n is a, c, g, or t
gtacattgtatgggcttagacaaatgtatgatgatatctacaattatagaatcatacagaatagtttcactgccctaaaacttctctatgcttcacctgttcatccctttcttccctaatcccctggcaaccactttanaaaaaaaaattaggttcagggggtacatgtgcaggtaaactcggtgacaagggggtttgttatacagattatttagtgacccaggtactaagcctagtacccaatagttacttttctggtcctgtcccttntcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatcttttctttggcaaccacttt

SEQ ID NO: 720694 - DNA, 1123 bp, Homo sapiens
ctactacacgacacagacttacaacactgagcacacgctggcctactgcgcttaacacgcggaaacccagcactgctctacaacacaacttacgaacgactcaacctctcaacggcccgcgctcaactctacgcacagcacggctgagtttcgttcagaggctgaaacccactgcaaccctacacactcctgcgcccacaaggcacaacacaaactgcacgcgggcaaactgcgcacaccaccgttacgttgcgccggaacgcgcccgaactcttcaagtcgtgcgctacagcaacgcctccgctcgcctttgtgccccggaaatttccaaggccctcgcgcacaaaaaaaccttggcggcccccccccacgagcacctcaaccttaccaccctcctccgtccccaccacgtccttgcaaacccgtgttgtggagggcttggtggtggtttttcccacacctttggggtcgccacctacccaccccttcggccaccctggccctccccacctttccctcccccccgctccctcgcaccttcctccccattcggccctcgctcaccctccacctcctccaccccgccaaccgccccggcctggcttctccccctccctccacctctcctccgaccccctccggccacaccccctaccccctttcctctcctccccggggccccttccccccccccttccctcccccccccccccccaccccccccccccccgccccccggcccccccctcccccttcccccgccccccaccctcaccccttaccccctgggccttcccccgccgcggcacgcccaacccccctggccttccccccgcccccccccttcccggcgcccctcgccccccttccccaccttggcggcctccacgcccttcaacccttggcggcgacctcccccacacccttcgcgccccttcggccccacaccccccctttctccccccacagcccgctccctctatccctcccctgtcccctcctcctccggcggcccacccccctcttcctccgccgcctaccaccgctcctccccaccgcccaacaacactcgcgcggccactctctgcaacccgcctccttttccctcctaaccgccccccta

SEQ ID NO: 720695 - DNA, 517 bp, Homo sapiens
ctgcttctccatggcacttattacattgacatatttatgtgtttattgtctacctcccctaactagaccaatagctcctcaagggcagggactgtttctgtgcactgctgaaatcctgtcactaaaaacaacggcacagagtatgaacttaaatgtttaactgtgttttcataatgatttaaaaaaaattccagctgggtgcggtggctcacgcctgtaatcccagcactttgggaggccgagatggatggatcacctgaggtcaggagttcaagaccagcctggccaacatggtgaaaccctgtctctgcaaaaaatacaaaaattagccaggtgtggtggcgggtgcctgctttcccagctacttgggaggctgaggcaggagaaccacttgaacccgggaggcagagattgcagtgagccgctccagcctgggtgagagagtgagactccatctcaaaaaaaaaaagaaataaggttggagaaaaacgcatgcaatggatcagggtgacgggtg

SEQ ID NO: 720696 - DNA, 104 bp, Homo sapiens
ctcgcgaacgtgttatccacagtgactataagatactctcgttgtgaaaactagcttcttatagtcactgtggattacagtaagttatctttctaccagatgta

SEQ ID NO: 720697 - DNA, 508 bp, Homo sapiens
taaatagcaagttttcggaagacatcttttttttatcctagatggacatatttaagttttcacggctgctggaagagatgacattaatggtctggtcatgaacgcgttcaaacacagcattatggagaggactacctcttcactccggtgcaggctccatcatatacctattattcggaaccagatatccgtcaacgccctcatactgcatgtacatgtctcggatgacgatgcccaaaccctccagaccgttgtcttgtccaccgacgccacctaggctctaattcttgcaccgctcactgcccacgtttgctcgttagtgctcgaggactaggtcgatgtgacgatacttgtactgcatacggtagcgctaagttaggaggttccgacgatcataaaggtaacgattgcgggctttttcttctggacgaagggcctggacatgatcctaattttttttgtggaatcccatgacccgtttattgaatccgtgctaccccattttctt

SEQ ID NO: 720698 - DNA, 499 bp, Homo sapiens
ttcccaccagcaagaccacgatagctgaaggctatgctattgaacactgtaactcaacttttacgtgctaccttatagatacatttataagtcaccataacaaccacttatttttcaggaacttggggcagatcctgtcctgttcaaaccagttgagactgccaacccttcaactgggcctgtacacatgcccaagaggtggccttttgacatcagagggccaaaaactccaccctcagatcatgttaacgccaccattttctgcacatatgtcatatgaaccccaattatgactgcatttttccccactgccaatcacctttccccatgcctcagaccaccctacttctctaacctataaatctctctaagcctcatctttggggaggtgaatttgagagccattctcccatctcctcactggacagccttgtgaataattcttctctcttttgcaaaacccatgtcacagtgattgatttactgtgtgagaacagaa

SEQ ID NO: 720699 - DNA, 1207 bp, Homo sapiens
gacccacgcgtccggaaggaaggaaggaaggaaggaaggaaggaaggaaggaaggaaggaaggaaggaaggggagagacgagagagaagcaataactgaatagaaaaacacgacagaaagacacgcagaacacgaacactactctggacacgaacacgaccgacaccggcacgaaagaaatgaacagacacgaacacgacaacacgaaacgacaacgaacagaaacgacacacgaaatgaatagaacagaagagaagagaagagaagagaaaggaagagatagagaagaacgagagacagagaagtagaagaagagatcaagtcttaagttttggttatcattataatcgagaatgtggttgagtcgcaggggggttgctcctcgttaatgctcatggtcgttggcgtgtgggcccatgttagtgttgcttctagacaatacagagtccgacttaagagcagtttgtacatgaccatgcgcaagcgacgtagagcaatggtctgggtaccgatttggcatcacagcgtgtggcaaggtaaatgccctggtcttcgcactgaaagaaggatatggcgtgttggacaacgcattggtcccgtagattcgcattggcgtggtagcgtgtgacggacgcttcgctctattagagcagggtctgtgcatcagtccttgtatgccaaggctccgcctgggactacccgacatgtatgacagttgctgtcccttcagcctcactccattttcacgtatccgtaggcctaaagacttgtgagtttgccaatcctgatgtacgaactagctgcatttagtctgcctctcgccaaggttgtccgcagcgtcccttctttactcaatacttagggaaagcaggtccaacaacagactatggtgatgcgagcacatctgcgtaccacactagacagtgagcccttgcggacagagactatctctacctcaggagggctctcagcacctagcgtatgtcacgcctgcccaacaatgctgagtacatcactgacacgaatggcgctgaactgctggcgccttgcacggaacccgagaattgagagcgcaggacgtggcaactagcagcacagactggaaccacctggccagtgggaaacccgtctaccaacccacacgccggcgcgtgggcaaaacccaaacgcgacgccacacacaacacacgcttccagaagacaccag

SEQ ID NO: 720700 - DNA, 312 bp, Homo sapiens
acggtctgctcgaacccttcataaacagacagtatcggtatggctcctctttcctctcccgtccctctcctttcttctttctccccatccctcctctttccttcccccttcattttggtcttcccttcctccaccttctctttcctttttttttttttttttttttttttttttttttttttttttttttttttttttttttttttttttttttctttttttttttattaaaggggggggggggggggggggggggagaggggaaaaaaaagggggggggggggggggggggggggggggggggggggggga

SEQ ID NO: 720701 - DNA, 182 bp, Homo sapiens
ctgtgagtgttgcatgctctccagtgcgggtgaactcccgcatgatgtctcggagtgacatctgaactccccgtcctccatcttgaccctggagctggtcccgttcatatagggtccacgcttgttccactcatgagtgagctgtcgctccagtgctccctgtccacgtccacctctgcccc

SEQ ID NO: 720702 - DNA, 237 bp, Homo sapiens
gcgagcagaactggtgtggatgagtacagaacatagtataagcaattttaaatgtgccagggagtgatcctatttagaagagtatcaacagtcatgaaacagtagataatgggtaacttgaattacatatctgtacatcagaagtatctttaaaagttggatacgagaaatattctcgctgatagcttttagtgaaataatgctctgtgtgagcaaatactgctattataccattct

SEQ ID NO: 720703 - DNA, 1331 bp, Homo sapiens
ccatgctgcctcgcggtggctatcgataagagcacaaacagagaagacacaacagaaagagaacaggaagcgagatgccgtgccccactggacgaccgctgcgaggattggtgcccgcgcccaaaagcgagggacgcgctttcctacccctccgatggggcggccactacgccccgcgatgtatttcttctcgccaagcccaccaagcggaaggggccaatggtcacccgccgcgacgggcctaaccaaagatctaaaagaggcttcccctcggaatccggggatctgattccttggaggctccccccctcttggtgtgcccccgcgggtggtatagatgcccagttcgttgctttatggccccatattccggtgttgtaccgagcgggccgcgcgtcccgttctgggaccaatccccaggaggaaataattgtttaacacacaaattctgggaaaacgcaaatgtgttatgtaagtagccttcttagacacaactgtataaagaaagggaggggatctcccccccgccgatccccacctgttttaaggggtaaaaagccttttttttaagagagtgaaatcaatttgctgggttgtttatatttcttgggacaccaccaacggaaattaatgtgggataattgaaattatgggagagctcctgacatgtctccgggtgttccagcttacaccatatcccaccagaatggggggtttttaatcttttgataatccctcattaatgacccaagccattatattaaataggccaatatatgggagatccagtgccccgcgcatattaatagtctcttggaacccatatgttaaatatacattctttatatgacccaacagttgttttttagataggaattggtttctcctaaaggaaaacccacactctctttgatccaaggcctcttcttcttgcccagaaattggtggtgccacactctctggtaacaatctctcctgtgtgggtaatctcctggttttctcctaaaatacacttgtgttactgtgcctgtgaaagattcaccagatttgaacacatagttagtggtgacagtggctgttgagttgtggaactggtgggcccgttatgtgacaccagctgagccccacagtgaagaatatacatggtgacattgatagcctcttaagggaaatttgcttcccaattttaagctgggaagtcaactgggataacttttaaaaagaattaccaataaccatggctttttagaatttcgttacgtatgttaagaattgtgtaccaaattgaaaagtctgtactgatcctccacccattaaatttcagtttatga

SEQ ID NO: 720704 - DNA, 1015 bp, Homo sapiens
gggtggcagccgctgtggtgcttggctctctgagctatccggtgccatccttgtcgctgcggcgaccctcgcatcaactgcagccatgaccgagcagatgacccttcgcgggacccttaagggccacaatggatgggtaacacagatcgccaccacaccgcagttcccggacatgatcctgtctgcgtctcgagacaagaccatcatcatgtggaagctgaccagagatgagaccaactatggcataccacagcgtgctctgagaggtcactcccacttcgttagtgatgttgttatctcctctgatggtcagtttgccctctcgggctcctgggacggaacgctgcgcctctgggatctcacaacgggcaccaccacaaggcgatttgtcggccacaccaaggatgtgttgagcgtggccttctcctctgacaaccggcagattgtctctgggtcccgagacaagaccataaagttatggaatactctgggtgtctgcaagtacacggtccaggatgagagtcattcagaatgggtgtcttgtgtccgcttctccccgaacagcagcaaccctatcatcgtctcctgcggatgggacaagctggtcaaggtgtggaatctggctaactgcaagctaaagaccaaccacattggccacactggctacctgaacacagtgactgtctctccagatggatccctctgtgcttctggaggcaaggatggccaggctatgctgtgggatctcaatgaaggcaagcacctctacactttagatggtggggacatcatcaatgccttgtgcttcagccccacattgtagatgaattgaagcaagaagttatcagcaccagcagcaaggcagagccaccccagtgtacctctttggcatggtctgctgatggccagactctgtttgctggctatacagacaacttggtgcgagtatggcaggtaactattggtacccgctaaaagttttatgacaaagtcttagaaataaactggctttctg

SEQ ID NO: 720705 - DNA, 144 bp, Homo sapiens
ggttgccggccgcgtgagctcgagatatgaatattagtgaggaagatacattctttctttttctttatttgagacagggactcagactgatccccaggctggagtgcggtggcgcagtcacggctcactgcagcctcaacctcc

SEQ ID NO: 720706 - DNA, 815 bp, Homo sapiens
  misc_feature (20)..(20): n is a, c, g, or t
  misc_feature (93)..(93): n is a, c, g, or t
  misc_feature (115)..(115): n is a, c, g, or t
  misc_feature (123)..(123): n is a, c, g, or t
  misc_feature (169)..(169): n is a, c, g, or t
  misc_feature (172)..(172): n is a, c, g, or t
  misc_feature (199)..(199): n is a, c, g, or t
  misc_feature (209)..(209): n is a, c, g, or t
  misc_feature (218)..(218): n is a, c, g, or t
  misc_feature (235)..(235): n is a, c, g, or t
  misc_feature (237)..(237): n is a, c, g, or t
  misc_feature (242)..(242): n is a, c, g, or t
  misc_feature (252)..(252): n is a, c, g, or t
  misc_feature (267)..(267): n is a, c, g, or t
  misc_feature (332)..(332): n is a, c, g, or t
  misc_feature (363)..(363): n is a, c, g, or t
  misc_feature (368)..(369): n is a, c, g, or t
  misc_feature (381)..(381): n is a, c, g, or t
  misc_feature (405)..(405): n is a, c, g, or t
  misc_feature (427)..(427): n is a, c, g, or t
  misc_feature (446)..(446): n is a, c, g, or t
  misc_feature (448)..(448): n is a, c, g, or t
  misc_feature (455)..(455): n is a, c, g, or t
  misc_feature (459)..(459): n is a, c, g, or t
  misc_feature (479)..(479): n is a, c, g, or t
  misc_feature (483)..(483): n is a, c, g, or t
  misc_feature (487)..(487): n is a, c, g, or t
  misc_feature (591)..(591): n is a, c, g, or t
  misc_feature (790)..(790): n is a, c, g, or t
tttgctggaattctgctgtnggtggggttttggctgatggacagggaaatctgcacaagtatttcgggtcacaaagaaggacgccccaggaancccgcactccctctagactacntccctggncaggacccggagccctccgcttctaggcactaaaaggaggctgtcnaangagggcaggctcccggccctgcctgtncaggctaatnaggtttgcnaagtctgtgccgccgcntnaaggnctcgggcgtnccttcctcccttgcngggatggggatggagaccaggagcacagccctgagcgtggtgggtcgcagacgcactgaggccangcgcggggaaaggaggacgcagggatttgtnttttnnaaaggagatgtnaggaagtgttatgaatcgagagtngcctttgctaaggtgctgcgcncgggcggagaccgggcggncntgctgcnaccncgcctcgcaccccccgcgcncctnatcngggtacagaagatagctcgagaacgtgctgtacttgttattattgcctccgtgagccttcccgccatccagcttcacatacacttcgtcccctgaatccaagtncagcaccacgctgttactggcgtagtcgtagttctggtcggcgtcctgtgcaatggcgctggcccggacctgcccgttcttgcagaggtccgcccacatgctggtgccgtcgccgccgcgcatgaggatgtggtaggtgaagaagtagatgccgcgcacctggcagctgaacttgcccgtggtggggtcatagtgattnctgaggttggtgaccacgtcatcga

SEQ ID NO: 720707 - DNA, 558 bp, Homo sapiens
  misc_feature (6)..(6): n is a, c, g, or t
tttttnggcctctatttcctggtgatgagatattcataattttatattaacccgagagctgacaacctcattaaactcatctattagtaataataattatggtcttttagattttcaacatattttcttttccaaaaagggattttcagaacaatcaacatattttttattggctataaatgaaaagaataattctttcttcctttccagtcagtatattttttattctttttcttgccttactgaattggttaagacttcagtaattggctgggtgcggtggctcacgcctgtaatcccagtactttgggaggctgaggtgggtggaccatctgaggtcagaagttggagaccagcctgaacaatatggtgaaaccctatgtctactgaaataccaaaaattagccggacatggcagcatgcgcccgtagtcccagctactcagggggctgagacaggggaactgcttgaacccaggaagcagagcttgtagtgagctgagattgcaccattgcactccagcctaggcaacaagagtgaaactccgtttcaaaaaaa

SEQ ID NO: 720708 - DNA, 1079 bp, Homo sapiens
gggtggcagccgctgtggtgcttggctctctgagctatccggtgccatccttgtcgctgcggcgaccctcgcatcaactgcagccatgaccgagcagatgacccttcgcgggacccttaagggccacaatggatgggtaacacagatcgccaccacaccgcagttcccggacatgatcctgtctgcgtctcgagacaagaccatcatcatgtggaagctgaccagagatgagaccaactatggcataccacagcgtgctctgagaggtcactcccacttcgttagtgatgttgttatctcctctgatggtcagtttgccctctcgggctcctgggacggaacgctgcgcctctgggatctcacaacgggcaccaccacaaggcgatttgtcggccacaccaaggatgtgttgagcgtggccttctcctctgacaaccggcagattgtctctgggtcccgagacaagaccataaagttatggaatactctgggtgtctgcaagtacacggtccaggatgagagtcattcagaatgggtgtcttgtgtccgcttctccccgaacagcagcaaccctatcatcgtctcctgcggatgggacaagctggtcaaggtgtggaatctggctaactgcaagctaaagaccaaccacattggccacactggctacctgaacacagtgactgtctctccagatggatccctctgtgcttctggaggcaaggatggccaggctatgctgtgggatctcaatgaaggcaagcacctctacactttagatggtggggacatcatcaatgccttgtgcttcagccccaaccgctactggctctgcgctgccactggccccagcatcaagatctgggacttggagggcaagatcattgtagatgaattgaagcaagaagttatcagcaccagcagcaaggcagagccaccccagtgtacctctttggcatggtctgctgatggccagactctgtttgctggctatacagacaacttggtgcgagtatggcaggtaactattggtacccgctaaaagttttatgacaaagtcttagaaataaactggctttctg

SEQ ID NO: 720709 - DNA, 713 bp, Homo sapiens
gccgccttggcctctcaaagtgctgggattacaggtgtgagccaccacgctcagccagtctcatgctctttaactactgagttgtattccactgtagaaatgtggcatgatttatatgttcaatgtcctcttgacggacatttaagtttcaatttttttttttggccttcacaaacgatgttacaatgaacatccttatagatgtatttggtagtatttatcccatggttttttctttctttttgggagacggggtttggctgtatctcccagcatggagtgcagtggcacaatcatagctcactgtaggctcaaactgggctcgggcgatcctcccgcctcagcctcccgagtagtgggacttcaagcactaaccaccaaccccaccagataatattaatgtttgggtgggtgggttggtagtttggtttttttggaggcggagtttcgcgctgtgttgcccaggctggagtgcagtggtgccgtctcggctcgctggacctccagcctctcaggttcgggcggttctcctgcctcggcctcccgagtggctgggatgtgcgggctcctcccaccagcccagctaatttttcttgtcttcagtagagatggggtttcataatgttggccaggctggtcttgaacccctggctcggtgatcctcccacgtagctccccggtgctgggattgcggcttgagcccccctcctgct

SEQ ID NO: 720710 - DNA, 494 bp, Homo sapiens
  misc_feature (4)..(4): n is a, c, g, or t
  misc_feature (13)..(13): n is a, c, g, or t
  misc_feature (31)..(31): n is a, c, g, or t
  misc_feature (95)..(95): n is a, c, g, or t
  misc_feature (99)..(100): n is a, c, g, or t
  misc_feature (107)..(107): n is a, c, g, or t
caanaaaaaagcnagccttttaatattttgncgcgggacggaaaacggcaacaccccgcccatttttataaaaaaaacggaggagccccccccanaatnnaaagaanttttttcactatttgacaaagatggcgaaggaacaataacaacaaaggaattgggaactgaaatgagaactcttggacagaatcccacaaaaacagagttacaggacatgattaacgaagcacaagctcatcggaatggcacaatagacttccctgaaactctgacaatgatggcaagaaaaatgaaagacacagacagtgaagaacaaattagagaaccattccgcccgtttaaaaaggatggcaacgcctaaattaaggctgcacaaccctaccatgtaatgacaaaacctgcacagaactaacaaatgaagaatttatgaaataaccacggaagcacaaattgaatgttatgcacaaaaaaaccatcaaaaagctccacaaatc

SEQ ID NO: 720711 - DNA, 1066 bp, Homo sapiens
  misc_feature (369)..(369): n is a, c, g, or t
ggaatctgccgaagactagaagtgtgaatcatgatggaacacgcacacagagcataaattatgagattcatccctgctactaattatggaataccaacattgctaacatgggatctagtgaagaagtagtccctcatcgttatttgcatggaagttcataaagtaccagcttctaattgaaactaactgagaactgtgaccattctgatctcaatggaagcctccacccggcagtgcatagcctgtgacaacgtcattagccattaagaaaaattcatcacacaattccttcttatctgaattgtccctaaccccatcattctttgtctttctcaaatattgcactgtgaacagatcataatggtaatnaataatatcttaatgacgcataacacacagcatatcattgcaccttcatctgcgataggatcaagtccgtatcgaaggcccatgtagcacagtcagccgacctgtaagtgccccgtgtagtaaatctactaccacgtagcaagttaaatgagagtctgcttcctacatagcaacgatggcagcatgagtccatagcaactacacctagaagcccccacggactacaagctaaaaacagtggactaacttacatcaatgttcattggcccctgaagaatcgtaatcccctagagatgtaacatactatctgttatgctgtaagcttatcacaaattagtgtttcatatatatgggatcacctactttacaggaactcctggatatagagtcgccatatttgcctcaatgtaggtttgcacccctatgcgtctgggtcaaaatagtagcgtatgcctgagccttcctcttcttttccgcgcggtcctggtcttttttcgccatttcttgcctgtctttgcccctgtgtaggaaagaatatcttatctcttccctgggctagcctttgtcgggttattgacccttgtggtttgctctgacaatggggcttaagcgtccttgaattgccgggcaggggttgccttattccgcttgtaacagcgcgggaatccggggggggttggaaagccgcgatgtaccg

SEQ ID NO: 720712 - DNA, 480 bp, Homo sapiens
  misc_feature (75)..(75): n is a, c, g, or t
  misc_feature (79)..(79): n is a, c, g, or t
  misc_feature (114)..(114): n is a, c, g, or t
  misc_feature (117)..(117): n is a, c, g, or t
  misc_feature (427)..(427): n is a, c, g, or t
atgagtgtgggagcacttcagctctgtaaggggccagcgttctgacctttaaccacatgaactaacctgcgtcanattngcagaaagtagcctgttaggacagcagctgctaangtntgccctggtattttagtggggagaaggctgggactcttcatggcatcaacacttgcatgctcctgaatctttgatcagagatgaggtgccatttttggcatttccaccgcgtctcgtggtagcctttaaaagtggtagaaagatgctgcctaattcccccgaggatgattgtcattccatgcaagcataaatgtgccgtgaggaagttttctcattccagtttctttggacttcgtaacattggaattgtttttccataatttccggcattccataaatatttgtcaaggacaaagaaaaggaatgtggntgtttatcctttcatatgaatgactttgtacacatgacttcctgccttcaata

SEQ ID NO: 720713 - DNA, 402 bp, Homo sapiens
taccctctctcctctttgttctctcattgttgttattttaataaatgctcagtagtctgtatcagagtctctggctcataggaatttggaaaatagaggttttgtagggaatcacttcgtaaagaaaccacatttggttgagtactttttttatatgttacatgtttatatgtcatttcctgtgggaaaagacatgaatgctttggaagacggtctatgacaagatttggaaagttggggcggctaagattcagtggacaaagctaaaacctgcagagcaatgaactctgggtggtagtggaattatgggtgattcttagttttttaatacgtttctgtattttccaaattttctaaaacaagtatatgttactttaataatcagaaaagacccaaacttta

SEQ ID NO: 720714 - DNA, 105 bp, Homo sapiens
acttcttataggacaaagtcccagtttctctggcagcatttcaatctttcccaattcatttcatttttctgggtaccgcagctcgcacattcgtacatccatggt

SEQ ID NO: 720715 - DNA, 199 bp, Homo sapiens
ggccgttagcagccagcatgtaattcccccttcctccagagtcacattgactccggaacgtggcgggtactgggctgaggagatccccaggcgatcccgaacctccgcctcaaatccagtaccaccagagtaaccaccctctgccccgatcccagctcgaccctattgatagtgtgctgcgctgctacgtgtgggatcc

SEQ ID NO: 720716 - DNA, 278 bp, Homo sapiens
gcaatgaaatttaagagagatcataagagagagactcaccacaaattgctccaacatgtgacaaatagttgcagaacacgagaatcgttcttcacaaaatcacacttgagtcttgaagagcccgctctgataccaattgattgttgcgctgcgctgctacgatccccaggcgatcccgaacctccgcctcaaatccagtaccaccagagtaaccaccctctgccccgatcccagctcgaccctattgatagtgtgctgcgctgctacgtgtgggatcc

SEQ ID NO: 720717 - DNA, 195 bp, Homo sapiens
agtgttgggccaggtgttaacccatgtccagtgctctcaagacgtgacttatcccattggtcacagtgggcactctactccactttatgtttttaaacgataataataccacatcactctgtggcagtacaccttcagcaatttcaaacaggacgtgataacaccacatgtacggggtaccgacgctcgagattc

SEQ ID NO: 720718 - DNA, 2270 bp, Homo sapiens
  misc_feature (1948)..(1948): n is a, c, g, or t
ggctgtgtgaagttatcatcagtgcaaatagccgagacgggaggggagtggagatggggaacagccgagatcagcattcatgggcatccacggtgccgaggtcacagaaggaactgacccgagagccgtcacagggcggccttaggttagacttgaaggagaacttccaggtggcagctgctgaggccaggacggattgacaggagacgcctgggccacgtgcccaggctcacgcctggaatcccagccgtctgggaggctgaggcgggtggatcacctgaggtcaggagtttgagaccagccggagcaacatggtgaaaccccatctccactaaaatcacagaaattagccgggcatggtggcgggtgcctataatcccacttattcggaggctgaggcaggagaatcgcttgaacccgggaggcggagcttgccgtgagccgagatcgcgccactgcactccagcctgggcaacacagcaaaactccatctcaaaaaaaataaaaataaaaaaagagacagctgacgtgctgtaactcagcaccatccgacagcggccaggcctgtgggcgcaggtgctggggacctccacacccctcccccggaggttcctggatgcttttctagtttttaaaaaaaacaaaacataaccaccctacagctcctcctgcaggacatcatgatagctgtgcttctgatttgccagatagcttgctatttatcctctccctgtcctgcagaccggaggtctgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttaattacatctgcaaagaaactttatccaaatgaggtcccattcccaggttctggggcttaggacttggacagatcttttggacgtcaccacccaacccattgcagttgtgtttgattctttctgagaggctctaggggaggatccttcccgcctcttccagctcctgggggctccaggcgtccctgggcttgtggccgcatcactccagtctctgcctccgtctccacgtggccttctcctctgtgtctgtctcctcttctgtctctgacggacgtatctcgttttgtctttaaaccaggtgactttttcagggaccccctccccagcgctgagctgtacgtcctgtgccggatcctgcatgactggccagacgacaaagtccacaagttactcagcagggtcgccgagagcgttctgagctcctgttgcctgctgtgtcccctgtgtcctgctgaaggatccccgcctggctggccaggactccagctctctgctgtctccctcaggggccggcctgctgctggtggagacgctcctcctagcaggcagacggctgctgtgacggtgccgtctaccaggcagggtctcagtccttctccgcactccagcctgcatcttcccatcttctgcacgatttccagtgtgtttcctccatgggacgccatcgctgccgctcacccctggatgcccacaggctatggagtggcagttctctgggcggcttccatctctcctgccttggtgcgtctgtaaacaccccccaccccgagcccaggcaggccagactcacacccaccccgtgaggccctcctgggcacatgctcactgcggttgtagggagctcagcgcatccacgtttcccccgtgctccgctcccagctgctgttcccggcctgtgtcccgaccctcagacctcagttcaccctctggtgcccacacagccccctttcctcnctggcccctccaccagggaatggctgggccaacctggggctgggctggggtgagccctttaactcacagccttgaccttagaggcactgaggttcaggaggcatctgcaaagcgagaaccggagcaggcctaggtgctgttttcacggcgcgtgcacccagcttacctgttcctgggctgggcgtcagtctcctatatttcagctgttttcctttttctgagacagactctggagtttagctcttcttacccagactggagtacaataatgcaatctcggctcactgcaacccagcctgggcgacagagtgagactccgtct

SEQ ID NO: 720719 - DNA, 279 bp, Homo sapiens
  misc_feature (113)..(113): n is a, c, g, or t
  misc_feature (117)..(117): n is a, c, g, or t
  misc_feature (193)..(193): n is a, c, g, or t
  misc_feature (242)..(242): n is a, c, g, or t
  misc_feature (245)..(245): n is a, c, g, or t
  misc_feature (267)..(267): n is a, c, g, or t
gacgctgagccgagaactggagcccgagctgcgccgccgccgctacgaatacgatcactgggacgcggccatccacggctccctctacatccttaggggctcagcccgttatnactnctcccatgagatccttcgggatgaagagtccttctttggggaacgccggattccccggggccggcgcatctccgtnatctgccgctccctccctgagggcatggggccaggggagtctggacagncgnccccagcctgctgacccccagntttctacagaca

SEQ ID NO: 720720 - DNA, 802 bp, Homo sapiens
gtagagagtggggacgtccggcttcgcagcggaagtgttcgttgtgccagcgactaagaagagaattaatatgggtgatgtagagaaaggcaagaagattatatgatgaagtgttcccagtgccacaccgttgcatcacagggcggcaagcacacacgagtgggccaaatctccatggtctctttgtggcggaagagccggtcaggcccctggatactcttacacagccgccacattatagaacaaaggcatcatctgggcgagaggatacacgtgatggagctatttgcagaatcccgcaagaaggtacatccctgtggaacaaagaatgatctctgtcggcattacgaagaaggaagaaagggcagacttagtagcttatctcaaaaaagctactactgcgtacatacatgccacctgccttattttattacaccaccagaaatgtctcatgactattttatgtgtaccatcctttactagatctcataccatcagaattcagatcatgaatgagtgacagaatatttgtgggcagccgtgattaaaataaagactgcttgtgcgttaactgactattgtcagtccatgaatttctagtagtaacccaattcagtaaatgctatcgctgttacgccttataagatctgatgaactcgtacgtaatgtccattctcacaagatgggactgcacttaaacttacgggccggtgcattaggatcattacggtctcggccactaatctgggcagggccggttaaaccacagtcacggttggacgcactgccaagacgggacaaa

SEQ ID NO: 720721 - DNA, 528 bp, Homo sapiens
tgtctctctcccctcccctacctgtgtgggccccctggccaagggttctcagcagcctctgctcaccgttctgagctcctgttgcctgctgtgtcccctgtgtcctgctgaaggatccccgcctggctggccaggactccagctctctgctgtctcccttgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctgaaaaaaaa

SEQ ID NO: 720722 - DNA, 785 bp, Homo sapiens
  misc_feature (724)..(724): n is a, c, g, or t
cctgtctcagatccctgatgcacaaattaggtcttattaataagtgtgggaaaagagaggagagtccaccttcttggtcaggcccctgaggcatgcatttctaccaaggaatatggacagatgacagaggagaagagcccaaagccaaatttatacatgagtgcaagtggatgcaaatttgttgctccctgcatctgtgtatatgctttctgttaaatacagaaagaaggaacaataggcttgcacacttttctaactacatgtttaagtggcagagtccaggctgtcgagtcacggttgggtttgaatctgactccaccagtaactttggttggaaaaaatcacttatcctctttaagcttgattttatttattttattttatgtaagagtgagacagtagtagcttaatagggttgcttttaaattagagtgaacatgaggcatttattcggtgccagacagataactgcctataacaggatgtgatcagcacaagtaacagaaaattagcctgacggtggcttaagcaatgggaatgtttatctcacatagcaaaaagtctgtaaatagatggttctagagttgggtggaagccaaaatgtcatcaggatttccttggaaccgtctgctttgccatcctcagtattgcagaatggctgctcctgcgccaagcatcattctgcaaatgatggtgtccacagccagagtggacagtagtacanggagccttctcattctgcccttatccgggaataaccgtcagcagctccaggcaacctcccc

SEQ ID NO: 720723 - DNA, 990 bp, Homo sapiens
  misc_feature (581)..(583): n is a, c, g, or t
  misc_feature (600)..(600): n is a, c, g, or t
  misc_feature (684)..(684): n is a, c, g, or t
  misc_feature (702)..(702): n is a, c, g, or t
  misc_feature (711)..(711): n is a, c, g, or t
  misc_feature (728)..(729): n is a, c, g, or t
  misc_feature (742)..(742): n is a, c, g, or t
  misc_feature (750)..(750): n is a, c, g, or t
  misc_feature (769)..(769): n is a, c, g, or t
  misc_feature (862)..(863): n is a, c, g, or t
  misc_feature (875)..(875): n is a, c, g, or t
attggacccccagagtttgaatgctctctcggagtatgccgccatctgaatttcttccaaggcccctgttaaagaaggcttgcaaaagtgctgccagaagggacaccgtccttttgcgggttggcacatgtccaccggattgcttcaccatgttcctgctcaagcatctagcacctcggatgaaccgtaccgggtgctcctttctttggaagatctctcgacaagctggtatcttttgcatgtccccatccagagcagatgatgcggtacactaggcatgccccagctgtgcacagtccctgcccgtagccttccggtggctatcttgtccccaacttttgtacactggcagtctgggcatcgcggatgttcacaatgtccacctgaggctgcgtcctcctatggaggggttgccaggatcttctgttttcgctctggatctgcgctgtagatctcctggatgatctgctcagccatagtttttggggaggggcttcccatgcccagactccttgatcattctacccccgtgatccctcggcccttgaaggtcttggcaatgatggctgttggctggtgcnnngcctggccaaaggcctngcacagctcctccacgctgtgtccatccacgatgatggcatgccaaccgaaggcctcgcaccgcttctggtagatgtccatctnggtgctgcagtggggccngggtcactntggcccaggcgattganngtctagaatgccnacaagttngtccagcttatagatgccngccgaaggccatggcctcccatacagagccctctgacagctccccgtctcccagcaagcatagactcggtagctggccttgtcgaagtatttnncgcgtgtagccnatcccacaagcgggccccgaggccctggctccagggagccacgtggccacgtcggtgaaagcattgtttcgggaccgggtgcccgtccaagtcggagctgatcttcctcaggttc

SEQ ID NO: 720724 - DNA, 2113 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctgaaaaaaaa

SEQ ID NO: 720725 - DNA, 299 bp, Homo sapiens
accgccttgccgctcacttaggtgcttcgcgagcgataggccgaggcctaggccgccgagttcccgtgtagtgggtttttccacccgcgtgaagcgatcgaaaatcgtgatgagctgatcttcggggattccctttcccgagtcggaaacctgaatgcgcgcccgccccgcgaatcgggaaaggcataccgtgttcttcctccgttcggcgtgaacttggccgcgttcgcgaggaggttccagacgatctgctgaattcgcacggcatccgcgcagataaacgagctcggagagccgag

SEQ ID NO: 720726 - DNA, 337 bp, Homo sapiens
tacaattttatttgtctgtgatctcacgacgaatttcgttactctggacgttgaagttagggaatgtcatttgacagctttctatcagagcattattgtccacaatttgagttacttatgattttctcgatcctctgcccttataggagataccatgtctctgtcattgatcctgtagtcacagtccctattttgagtacagatcttttcttgtgtactgtgttggccacctctgtttgcatcgagttatttgcattcagcctgatgttgcagacaactccgttatagttggacagttcctgcttacgtgctacttgccattaccttgcctattttc

SEQ ID NO: 720727 - DNA, 2253 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacaggacccagcgggttttgctctgaggatctttgcaggtggaagtcactgagggaaggtgacctggagcctgggcagagcaaggaaggagggccacaccttctgtccctctgccctcaggaatgctgcttttcccgaaagggttaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctgaaaaaaaa

SEQ ID NO: 720728 - DNA, 2205 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagcgttctgagctcctgttgcctgctgtgtcccctgtgtcctgctgaaggatccccgcctggctggccaggactccagctctctgctgtctcccttgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcacggcttccaccaggtgcaggtggtgcacttggggggtgtcctggatgccatcttggccaccaaagtggccccctgaagcccaggcagcatgttcattatagggatgtcctcccccaggctgcaggtggaccgcccggtccccaagtaccataggacagtcacataggagcgtgtagtcgtgactgaataaagaaagcaaaagcctgaaaaaaaa

SEQ ID NO: 720729 - DNA, 560 bp, Homo sapiens
aagtagaacaccactcagaatgcgtgcgtgcgtgcacacgttgcgttgtacatgagtgtgagctgatttgcacccacaccctctgtaagtgcctgctgtggttttggttttgattattccgttaatgctgagtctgtttcacaaacgagattagcagaattaattattgaagatgcagtatgctttatggttttaataacactgttaaaaactaaacaaggaagttaaatatgttgatgattatcggtgactgctcaccacacagcatccctcaggccgagtcagttggcccagtgactcccacatcacaaactgccctttcttggtcagaagaagcagagtggagccttctcatccccacgcgcgcagctgtggggccccgtggtcacctggccacatgggagtttgcatactgagtggttcatcttttccaatgtgttgtgtcctttaatttacatttatatttcattgccctttctaatgatcagaacagcacatcttgttatagaaaattaggaaaataaataaaattacagtaaaattacacaaacacaacaaaa

SEQ ID NO: 720730 - DNA, 178 bp, Homo sapiens
  misc_feature (50)..(50): n is a, c, g, or t
  misc_feature (145)..(145): n is a, c, g, or t
aggatctcacactgggtcgagtctagaattggcatcatgggtagcagctntggaaggaagcataagaaagggacacacgaggactccacacagccccaatgtcactttccaacaacaaatattctctttaatttctgagagtatncaaaggagtttaaccccattcagtggatgatac

SEQ ID NO: 720731 - DNA, 383 bp, Homo sapiens
aaactacatactagtgtggctatatatgacaaaatgcagtcacacaggaaatctgctaacagagcagtataatatatgctatagaaataacctatgtaaggctgggcaaggtggctcacatctgtaatcccagcactttgggaggccaagatgggcagatcatctgaggtcaggagttagagaccagcctggccaacatggggaaaccctgtctctactaaaaatacaaaaataagctgggcgtggtggcacatgcctgtaatcccagctaatgggaaggctaaggcaggacacatcacttggaacctggggacacggaggttgcagtgatccaggatcgcactagtgtactgaggcctgggcaaaagagcaagactccatct

SEQ ID NO: 720732 - DNA, 1990 bp, Homo sapiens
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctgggcgagtatcagtgcttgctggagctgcaggtggaccgcccggtccccaagtaccataggacagtcacataggagcgtgtagtcgtgactgaataaagaaagcaaaagcctgaaaaaaaa

SEQ ID NO: 720733 - DNA, 2660 bp, Homo sapiens
  misc_feature (2338)..(2338): n is a, c, g, or t
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagctgcaagccaggggccggcctgctgctggtggagacgctcctggatgaggagaagagggtggcgcagcgcgccctgatgcagtcactgaacatgctggtgcagactgaaggcaaggagcggagcctcctagcaggcagacggctgctgtgacggtgccgtctaccaggcagggtctcagtccttctccgcactccagcctgcatcttcccatcttctgcacgatttccagtgtgtttcctccatgggacgccatcgctgccgctcacccctggatgcccacaggctatggagtggcagttctctgggcggcttccatctctcctgccttggtgcagagactgtcacgagcgggacctccccagcccctgctgcggggctgaaatgcgtctgtaaacaccccccaccccgagcccaggcaggccagactcacacccaccccgtgaggccctcctgggcacatgctcactgcggttgtagggagctcagcgcatccacgtttcccccgtgctccgctcccagctgctgttcccggcctgtgtcccgaccctcagacctcagttcaccctctggtgcccacacagccccctttcctcnctggcccctccaccagggaatggctgggccaacctggggctgggctggggtgagccctttaactcacagccttgaccttagaggcactgaggttcaggaggcatctgcaaagcgagaaccggagcaggcctaggtgctgttttcacggcgcgtgcacccagcttacctgttcctgggctgggcgtcagtctcctatatttcagctgttttcctttttctgagacagactctggagtttagctcttcttacccagactggagtacaataatgcaatctcggctcactgcaacccagcctgggcgacagagtgagactccgtct

SEQ ID NO: 720734 - DNA, 2661 bp, Homo sapiens
  misc_feature (2339)..(2339): n is a, c, g, or t
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagcgttctgagctcctgttgcctgctgtgtcccctgtgtcctgctgaaggatccccgcctggctggccaggactccagctctctgctgtctccctcaggggccggcctgctgctggtggagacgctcctcctagcaggcagacggctgctgtgacggtgccgtctaccaggcagggtctcagtccttctccgcactccagcctgcatcttcccatcttctgcacgatttccagtgtgtttcctccatgggacgccatcgctgccgctcacccctggatgcccacaggctatggagtggcagttctctgggcggcttccatctctcctgccttggtgcagagactgtcacgagcgggacctccccagcccctgctgcggggctgaaatgcgtctgtaaacaccccccaccccgagcccaggcaggccagactcacacccaccccgtgaggccctcctgggcacatgctcactgcggttgtagggagctcagcgcatccacgtttcccccgtgctccgctcccagctgctgttcccggcctgtgtcccgaccctcagacctcagttcaccctctggtgcccacacagccccctttcctcnctggcccctccaccagggaatggctgggccaacctggggctgggctggggtgagccctttaactcacagccttgaccttagaggcactgaggttcaggaggcatctgcaaagcgagaaccggagcaggcctaggtgctgttttcacggcgcgtgcacccagcttacctgttcctgggctgggcgtcagtctcctatatttcagctgttttcctttttctgagacagactctggagtttagctcttcttacccagactggagtacaataatgcaatctcggctcactgcaacccagcctgggcgacagagtgagactccgtct

SEQ ID NO: 720735 - DNA, 141 bp, Homo sapiens
  misc_feature (24)..(24): n is a, c, g, or t
  misc_feature (31)..(31): n is a, c, g, or t
  misc_feature (113)..(113): n is a, c, g, or t
gaaaagatccaggcgtggtggcanatgcctntaatcccagctgctcaggaggctgaggcaggagcaattgcttgaacccaagaggcggaggttgtggtgagtccgagattgcnccgtactccagcttgggcaacgagcaaa

SEQ ID NO: 720736 - DNA, 2609 bp, Homo sapiens
  misc_feature (2287)..(2287): n is a, c, g, or t
gcctcgcggaggcgggactctggccgcctgttttttttgcatgccgcgctgcgcgcaccgcgggctccgggctcagaagtgcggacgcccggctcccggcgtggacgccatggtgctgtgcccggtgattgggaagctgctgcacaagcgcgtggtgctggccagcgcctccccacgccgtcaggagatcctcagcaacgcgggtctcaggtttgaggtggtcccctccaagtttaaagagaagctggacaaagcctccttcgctactccgtatgggtacgccatggagaccgccaagcagaaggccctggaggtggccaaccggctgtaccagaaagacctgcgggcccccgacgtggtcattggagcggacacgatcgtgacagtcggggggctgattctggagaagccggtggacaagcaggacgcctacaggatgctgtcccggttgagtgggagagaacacagcgtgttcacaggtgtcgcgatcgtccactgctccagcaaagaccatcagctggacaccagggtctcggaattctacgaggaaacgaaggtgaagttctcggagctgtccgaggagctgctctgggaatacgtccacagcggggagcccatggacaaagctggcggctacgggatccaggccctgggcggcatgctggtggagtccgtacacggggactttctgaacgtggtgggattcccgctgaaccacttctgcaagcagctggtgaagctctactacccgccccgcccggaggacctgcggcggagtgtcaagcacgactccatcccggccgcggacaccttcgaagacctcagtgacgtggaggggggtggctcggagcccactcagagggacgcgggcagccgcgatgagaaggccgaggcgggagaggcgggacaggccacggcagaggctgagtgtcacaggactcgggagaccctgcctccgttcccgacacgcctcctggagctgattgagggctttatgctatccaagggcctgctcaccgcttgcaaactgaaggtgttcgatttgttaaaagatgaagcaccccagaaggctgcggatattgccagcaaagtggacgcctctgcgtgtggaatggagaggcttctggacatctgtgctgccatggggctcctggagaagacagagcaaggttacagtaacacagagacagcgaacgtctacctggcatcggatggcgaatactctctgcacggcttcatcatgcacaataatgacctcacatggaacctctttacatacctggagtttgccatccgagagggaacaaaccagcaccacagggcgttggggaagaaggcggaagatctgttccaggatgcgtactaccagagcccggagacgcggctgaggttcatgcgggccatgcacggcatgacgaagctgactgcgtgccaggtggccacggccttcaatctgtcccgcttctcctccgcctgcgacgtgggaggctgcaccggtgcactggcccgagagctggcccgtgagtaccctcgtatgcaggtgactgtgtttgacctcccagacattatcgagctggccgcccacttccaaccccccggaccgcaggcagtgcagatccacttcgcagcaggtgactttttcagggaccccctccccagcgctgagctgtacgtcctgtgccggatcctgcatgactggccagacgacaaagtccacaagttactcagcagggtcgccgagagcgttctgagctcctgttgcctgctgtgtcccctgtgtcctgctgaaggatccccgcctggctggccaggactccagctctctgctgtctccctcaggggccggcctgctgctggtggagacgctcctcctagcaggcagacggctgctgtgacggtgccgtctaccaggcagggtctcagtccttctccgcactccagcctgcatcttcccatcttctgcacgatttccagtgtgtttcctccatgggacgccatcgctgccgctcacccctggatgcccacaggctatggagtggcagttctctgggcggcttccatctctcctgccttggtgcgtctgtaaacaccccccaccccgagcccaggcaggccagactcacacccaccccgtgaggccctcctgggcacatgctcactgcggttgtagggagctcagcgcatccacgtttcccccgtgctccgctcccagctgctgttcccggcctgtgtcccgaccctcagacctcagttcaccctctggtgcccacacagccccctttcctcnctggcccctccaccagggaatggctgggccaacctggggctgggctggggtgagccctttaactcacagccttgaccttagaggcactgaggttcaggaggcatctgcaaagcgagaaccggagcaggcctaggtgctgttttcacggcgcgtgcacccagcttacctgttcctgggctgggcgtcagtctcctatatttcagctgttttcctttttctgagacagactctggagtttagctcttcttacccagactggagtacaataatgcaatctcggctcactgcaacccagcctgggcgacagagtgagactccgtct

SEQ ID NO: 720737 - DNA, 126 bp, Homo sapiens
gacgatgtattcacttgccaaagctgggacagattgagcattaaaaggatcaggaggctgagtgtggtagctcccagcaccaggtaggaatcaagggatgtgtgtgctccttctaaagaaccaacg

SEQ ID NO: 720738 - DNA, 1173 bp, Homo sapiens
cctccaagtcccagatcatgtctctgtggaggtctggtctccaagatgcccccagaaaaagtgcagctggctctatgtcgacattaccccaacacctagaggcgatcttctgggtcactggctggagagccagacctgggcagttcctggtcggctccagacgccttctgctgcaacttggctcagtgccctacttatcagcacactgtccagcacctatcagagcctcggtgggcagagcagggggcaggggagcaccatcttgcaacacatcagacacccttgagagcatctcatcagagggaccccctgaagctggtggccacattacagacaaatacttcaaggcagagaaaacagctagttcatggaacagttccgccacttgcccaatgccttaacactggaagccggcacgcaactcaagtcaaagacaggcttgcgagaggctgcagcaccgagataggggagatccaacatactccgagcacgccctgcagacagtgcgcgccttgaacgctcggcccaaggatggtctcttgaacagccttgcatacgaacactcctagctaatagggcactgtgacccaaacatcgagcgccctgggcccctagcccactcgccactgaagaaccacttgggacgcaagacaaaacagcgccagcccccacacgccaacacaagctggcttgaccaacagacgatacccaagcactaccaggcacacacagagcaagcaagcaagagctggcacaggggaaaatgcggcgacaccgagaacgaagcgccacagccatgggaccaccccaacatacaagaggaaccaagcggagatgccaaaagaaccacgagcgggaacaccagacaaaaagacaccacaacaatccaagacagaacagccacaacggcgcgcagaacaagaccacggaagcaccaccaaggaaaaaccacacaagagcacaaccagaacaaacggcaaagcactgaggagacgctcacaggcaccgacagggcacgcgaacaaaccccacagcgcaccctccagaaagacacccacacagaagtgagaaacaatagacagaagcaccgccaagggacagcagacaaaaaaaaaacaaaaccaacaatacccgcacaacgcgcacaacacagaacaggcacaaggcacaagc

SEQ ID NO: 720739 - DNA, 101 bp, Homo sapiens
ccccccccccccccctttttttaaacaaggggttcttgggcccgggaaaattttccgtttttggaatttttaaacctttaaaaaaattgggaaagggggga

SEQ ID NO: 720740 - DNA, 1800 bp, Homo sapiens
atggaccccgagcactgcgcgcctttccgcgtggggcctgcacccggcccctatgtggcctcgggggacgagcctccgggcccgcagggaacccccgccgctgcgcctcacctgcaccccgcgccgccccgcggcccgcggctgacccgctttccggcctgcgggcccctggagccctacctcccagagccggccaagccgcccgccaagtacctgcaggacctcgggcccggcccggccctcaacggcggccacttctacgagggccccgcggaagctgaggagaagacctccaaagctgccagcttcccccagctgcccttggactgccgagggggccccagagacgggccctctaacttgcaaggctccccaggcccctgcctggccagcctgcatcttcctctttccccgggactccctgactccatggagttggccaagaacaagagcaagaagcgtcgtaaccgcacgaccttcagcacattccagctggaggagctggagaaggtcttccagaaaacccactatcctgatgtgtatgcccgggagcagctggccctgcgcacagacctgactgaggcccgggtacaggtctggttccagaaccgcagagccaagtggcggaagcgcgagcgttatgggaagatccaggaggggcggaaccccttcacggctgcctatgacatctctgtgctgccccgtactgacagccaccctcagctgcagaactccctgtgggccggtccaggatctgggagccctggaggcccctgccttgtgtctccagagggcatcccctccccatgcatgtctccatattcccacccccatgggagtgtggctggcttcatgggggtgccagccccttctgcggctcaccctggcatctactccatccatggctttccccccaccctggggggccacagctttgagccttcctcagatggtgactataagtctccaagcctcgtctcgctcagggtaaagcccaaggagccacccggccttctgaactggaccacgtgatcggttgcatggacctgcagaatgagctgcccacctctttttccattcccagtcgctcccagcccacccccgcctggacaccacggaggaagcacctctgcctccaagccccagatggttctggaggctgcgagagcagctggcactgtcagcccccagcagggaacacgttacagggtcttttctcttagaacaaggtggggctgcctaggagaaggggcttcgaagcagccaggactcttcctaccacaaactgagtcccctcacctgaactctgggctggaggcagggagacactgccctgcttcctccagactttgtccaagtccattgtcatctctccagctaagacagcttacttggctcatcgttcagggaacccaggaaaatgggaggagaacgccccgtggactgaagctcttcatgatgagatggaaaccaaaagggagtctcccatgatggggtggagtcagccctgcttcccctccccaccagcagggggcgcactggtgtctgacactaaggagggtgtaaaggccaaggtcagcatagactgaggcacactggctcctcagctccagccaccctcactcctgccatgtgcctgcactcccagcatgccatgcagtcatcttcccctccaagggggcagaaattccaccagaaatcaccacatatttggaatcttcttccacgggaccagcccagagctatgccatggaaatgatattggatgttggtaagaataaaacagatttctacagactg

SEQ ID NO: 720741 - DNA, 446 bp, Homo sapiens
accctggcaactgcttcggatgctccacctggtggcggaggccctgggaggcctgcctttgctgttggagggtctgtgctagctgggcctgctactctttggcctgctgctgcaggccacccaatacttgatcctgctgctggatggaggcattgagtgcggcgactctcaagttcatataggccacctgggcagtcaaccgggcccaataaccttgggaggcctgctccaactcttccttggcctggctgaggttggagatggagctctgcaggtcagtgatcaggctagacagctgctgcttttcttcttcgaagtggccccgctcaacatgcagcttgtcttcctgctggcctcgatcagtctccagcatctctaccctggcttggagctgtgtgttgtttgcggcaagagtggctgcctcttgcttcaaggtttccagctgc

SEQ ID NO: 720742 - DNA, 95 bp, Homo sapiens
ctccttaattgatgggcaaacactctccaaagagtccccaagtcatggccttgaactctcagctccagagaaggcctcaccatcaaatgcctcag

SEQ ID NO: 720743 - DNA, 122 bp, Homo sapiens
  misc_feature (93)..(93): n is a, c, g, or t
tcgggtgacagggctgccactgccagagacagaacgtggttgaaagtgcagagacacaatactgtcaacctaaaatcttacacacgctaaggnaaaacaagtcctttaagaacgaggataaa

SEQ ID NO: 720744 - DNA, 368 bp, Homo sapiens
tacagagtgaatgtcaggagacctacactggcacatcattatcactcaaagacgtccatagtttacgttagtgttcactcttggtgttgcacattctacaggcttcttgacaaatgaacaatgacatgtatctatcatttagtatcataaagaatagtttcactgccctaaaaatcctgtgtgttctgcctgtttgttcctttctctcccctaacctctggcaacccgtaatctttttatggtttccaaggttttattttttctggagtgttctgtagttggaatcacacagtatatcaccttttcagtttggctcatttcccttagtagtgtgcattttttcccatgcgtttagatggattggtagt

SEQ ID NO: 720745 - DNA, 399 bp, Homo sapiens
  misc_feature (180)..(180): n is a, c, g, or t
  misc_feature (256)..(256): n is a, c, g, or t
  misc_feature (309)..(309): n is a, c, g, or t
  misc_feature (350)..(350): n is a, c, g, or t
tctctaagcaaaaagaaaatgatgaaagaagcaaacttggagcatcagaaaggaagaaagaacatgataaaatgaaaatatgagctcctattatgaacatcgtattaccattcattgtgaaacttaatcgtatatttatatataagcatccttcagagatgctgtgggttcagtttcagnccactacaataaagtgaatatagcaataaagcaactcatatgaattttttggtttctcagtgcatataaaattaancttcatgctatactgtagtcatttaagcatgcaatagcattatgtctaaaaantgtacatacctttatttaaaaacgcttttattgcttaaaanaggctaaatggcccatctgagccatcggcttttttcctggcagaggggg

SEQ ID NO: 720746 - DNA, 245 bp, Homo sapiens
gatcacatcgcagtgagactcgtgccgacatgtgtctggtcctggtaacacctcttatgaacactggtggctgggcttcatagcattcgactactccgtgaagtctacggacaggaagatggttggcgacgtgaccggggccccagggctattgcctccaacggccaaggttgcgtgaacaatctggggccctgcatataggggcatcttcaattgaacatttttgctcggtcaatcattcccca

SEQ ID NO: 720747 - DNA, 284 bp, Homo sapiens
tactctaagatcccgtagcgcgcgcacatcacttattatatgatagaaactgaggcagaagagcttgatgtctattgtgaatagctgaggggacaagctgcacaggaagatctagcatgagactgtaatgcttatcctagagatacctgtgttcgtttaaaaccatttttcaaaaaggatgtacaaagccattacatgggactgatcaagaatgcttccatatagcagatatatcagcaaagatcagaggatgcttagcaggtactttgacctgtatttataga

SEQ ID NO: 720748 - DNA, 572 bp, Homo sapiens
ccgggctgcggcctgggagtccgatggctgcagaggacaacccggggcgtggtgccactggaggcacggagagccttccatatgaccaaggacatgttgccggggtcatatcctaggaccccagaggaacgcgccgggccgccaagaagtataacatgcgagtggaagactacgagccataccccgatgatggcatggggtatggcgactacccgatgctccccaaccgatcacagcatgagagggatccgtggtatcagtgggaccactcagaactcaggatgaactggggtgaaccgatacactgggacctagacatgtacatcaggaatcgtgtggacacgtcacctacccctgtgtcctgggatgtcatgtgtaaacatctcttcggctttgtggctttcatggttttcatgttctgggtagggcacgtgttcccttcctaccagcctgtgggtccgaagcagtacccttacaataatctgtacctggagcggggtggtgatcctaccaaagagcctgagcccgtggttcactatgatatctgaggaggcttgatgggctttttgccc

SEQ ID NO: 720749 - DNA, 164 bp, Homo sapiens
  misc_feature (24)..(24): n is a, c, g, or t
  misc_feature (36)..(37): n is a, c, g, or t
  misc_feature (115)..(115): n is a, c, g, or t
ataccgcgtcgataccctgcacgnccgctcgcgcgnncgattgctcgccctcgccgcctgccggcgctggcgctggaaccgttcgtcgccagttaccaggcctggcacgagggcnagcagctcggtaccgcgaccctgcaggctaagccgaccggcggcaacca

SEQ ID NO: 720750 - DNA, 968 bp, Homo sapiens
  misc_feature (315)..(315): n is a, c, g, or t
gcggaagcgggctcgcaccgacgaggtgcctgccggaggaagccgctccgaggcgtgaagatgaggacgactgaggactaccgtgaccctatgtgccgtggacggcggcgaccggcagcatactgactccatgaagctgtctgcacgcgaagcacgccacagggagctgcggaggaaggagcagccagggacatgacgcgtagtgaatccccggtggtagaatgagggacgcacactccccgtctaggccctcagtgccaaacgggtccagtccctccgtggcatccagaacgcagagacccttaagagagaagngctggaagacgcgcataagaggtctgaccaacggagaacgcatgctgaaagggacacgaagagagagatccttggacgatgtgttgatgcccgatgggactggagctattgatggtcatggtgacaggggatgattggcgggcagagggcaagttaccgtcatcgtatagtgactcgagtatgaaaggccctgggcgtttggaaagatgagaggcgtactggggaaggttggtggcgaagaggcacattgtccttggagcgaagctgcaccattgaaggccagcacgctggcagtgagcaaacaaacataccagcaactcgcgtggctcgccgatggggaccgatcacgtaatccgccataccatcggtcaacctcaaatagatgcattctaaaggggcgcctactcgaacacattttccacggcgacgcttgagcatttcacagtagacgtcaatgtgccccgtggaaccgtacaacagcaggggagggcacttacagcacgaatcgccatggggccgacagatttcaacgggtcgccaagggtgcaattccacccagaccgaatatccagatactgcgccccgtgccccttgttgcatactggagcatcccagaaaagcgccgggtgccatctaggggaccagaaggacaa

SEQ ID NO: 720751 - DNA, 418 bp, Homo sapiens
tatatcgttctcacgtaacgaggacggtacgataccgatggctagtcgggaattaacgcctgtagagagccatgcaaacgatagtagccttttggcgaggtcgggttcgttgaaacaggaacactctaaaaatataggtttgtctatatttttagtagcaggacatataatggcagtaactacaactctaaacgtgcatgggggttctcgtatgaaccgatattatgaaggcgtaaaggatgttgaatgggaaaatgaaaaaggacgttatatcattcgcaatgttccttttcatgtatatgaggaatacacaaatgaagccgtgtatagctctgatgtgacattaaagctgttacttctgaaagaattaatggaagagaacgaaattccatctgaaatcgattttatgaaagcaaag

SEQ ID NO: 720752 - DNA, 479 bp, Homo sapiens
cttgccaagagatcattcattgctggtgcaatcacaaaatggtaccgccactttgggagacagtttaacgctttcttactaaaactaaacatactcttaccatatgatccagcaaacatttccttggtatctacccaacaagtttaaatcttgtgtccacacaaaaaccggtacgtggatgtttataatagctttatccataattgccaaaacttggaagtaatggagacgcccttcagtaggtcaaagttgataaacttggtacatgcagacaatggattattattctacactaaaaagaaatgagctatcaaaccatgaaaggacatggaggaatcttaaatacatattactacatgaaagaagtcaatctaaaaaggctacatactacatgattccagttatgtgacattctggaaaaggcaaaattatggaggcagccagaaggttgccaggaagtgggggaagggctgaatagg

SEQ ID NO: 720753 - DNA, 411 bp, Homo sapiens
tttaaagttatataaaaaaaatattaataaatatttaaattttggagaaaatatttataaaaaaaaattttaagaggagcacatttaattatcgccttgggttccgtgtttttgctaccctggggggcttttcctgccctgcggttttttggctcccttctctttttttgttttgccgggttttggggcctttttccccggtgcccctttggggggccctttttttggccctggggggggtttttccctgccccgcttttggcaaacctcggggttccccccttttggccctttgcgcagctcccctgtttccggggtttcggtacttttctggggtccctacctggggggctttccccgggttgtcccctctattggtccctcgttttccgccgggggtaacattttgtc

SEQ ID NO: 720754 - DNA, 134 bp, Homo sapiens
  misc_feature (30)..(30): n is a, c, g, or t
  misc_feature (41)..(41): n is a, c, g, or t
  misc_feature (111)..(111): n is a, c, g, or t
agaaactgaagcagctgatggagcaggatnctcctcctacncgtctgctcaggtcattggtctgaagaacgccctgtcatccgccctagcacaaaacacagatcttaaagnacacttacgcagaaatccatgcc

SEQ ID NO: 720755 - DNA, 851 bp, Homo sapiens
  misc_feature (522)..(522): n is a, c, g, or t
gaagcatgataatcgcttgaacctgggatgtggaggttgcagtgagctgtgatcatgctgctgcactccagcctgggtgacaaagcgagactctgtctcaaaaaaaaaaaaaaaatttttttcccagggaattttttaaacgtggatggttaaacacaggccattattaaatactaaatttacattaaacttaaatgattcagaaacaaagttactaatattaaaaactcgtaactttctaattaatttactaggttttatggtctatgctctggaggttacttatgtctatggtatgtgtatagaagaaatactatgtatcagggggcgggggtacatctcttcccaattctacatttcaaggacttcacattgggtagatggaaattggactgggtagcagtatggcagtgttggaaataagcaaacgctacaaatctgggctgatttatgtggtggtttatgtccagacgtgagaaagtgctggacgacaatgtatgatgcagcttaaacttgagatgnttgactgtagctgtgactgtgaatagcacaattaattgggcaaataatcttcccaagtttggaaacctattatcagattcagcaataacgtcttcatatggtggttacgttggcacagacacacacacacaaaaaaaaaaaagtgggggggggcccgcgcacccgaaaaggtctcaaaccctcggggcgcgcgcgccccagggaaggaacaggccaaccgcccaaggagaaccgggcgacagggtggggttccccaaaaaagcccggcggcggcgggtggaacccagggcgggcgcccggctaacagcagcgagcccgccgccgcgagg

SEQ ID NO: 720756 - DNA, 1303 bp, Homo sapiens
ggcgcccgcgggcagagcgaatcccgtcccgcgcctcctcaccctcttgcagctgggcacaggtaccaggtgtggctcttgcgaggtgcgcgggcgtctgcaaaccaggtgacagctggcgagtggctgcatgcatctctggccgctgctgcagtcgcgggcgcagaagagggtccggtcccaggaaccccgagcaaagcttccgcgatgcgaggggaccgggcttctgggggtcctggaaatcacaacgggagctgggcgcgggaggggcccaggcttggcccctcctggaagcgcgggctctggtctccgaggggaggccccaaccgtccggcggagccctccaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggctgtcgccggctcttgagccaaacactgtgtttcgtttggctcaatgacgaatgttgaagatgcttttatgttctgagccacatgcacttggaggccgctggtcacgctgctcaggagtggtgcccagaaaaggaaagggcttggtggtacatgaagtgggggcagtgggcagggtgccctgggggggaggcatagagggccctgggggtcatgggaagcgagcacgcagcaggcgtgcccaggagcgtgtgcatgtgtcagagccatttggtccatcatctcctgcaataaacccatcgcaagaatgaccttcaaagcaaaatt

SEQ ID NO: 720757 - DNA, 1059 bp, Homo sapiens
  misc_feature (57)..(57): n is a, c, g, or t
gggcccccgcactttaagaggctgtgcaggcagacagacctccaggcccgctaggantccgcgccatggaggccgcccgggactatgcaggagccctcatcaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggctgtcgccggctcttgagccaaacactgtgtttcgtttggctcaatgacgaatgttgaagatgcttttatgttctgagccacatgcacttggaggccgctggtcacgctgctcaggagtggtgcccagaaaaggaaagggcttggtggtacatgaagtgggggcagtgggcagggtgccctgggggggaggcatagagggccctgggggtcatgggaagcgagcacgcagcaggcgtgcccaggagcgtgtgcatgtgtcagagccatttggtccatcatctcctgcaataaacccatcgcaagaatgaccttcaaagcaaaatt

SEQ ID NO: 720758 - DNA, 259 bp, Homo sapiens
tgcttggattatagtcgtgagccaccacacccaacctcaatacttttttttttttaaaaccgagtcttgctctgtcacccaaattaaagtgcagtggtggcacaatctcggttcattgcaacctctgcctcctgggttcaagcgattctcctgattcagcctcctgagtatcggggattataggcaggggccaccacacccagctatttttttattttccgtagagacgaggttccaccttggggggccagctggaggg

SEQ ID NO: 720759 - DNA, 1121 bp, Homo sapiens
ggcgcccgcgggcagagcgaatcccgtcccgcgcctcctcaccctcttgcagctgggcacaggtaccaggtgtggctcttgcgaggtgcgcgggcgtctgcaaaccaggtgacagctggcgagtggctgcatgcatctctggccgctgctgcagtcgcgggcgcagaagagggtccggtcccaggaaccccgagcaaagcttccgcgatgcgaggggaccgggcttctgggggtcctggaaatcacaacgggagctgggcgcgggaggggcccaggcttggcccctcctggaagcgcgggctctggtctccgaggggaggccccaaccgtccggcggagccctccaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatagggatgcaggctgtcgccggctcttgagccaaacactgtgtttcgtttggctcaatgacgaatgttgaagatgcttttatgttctgagccacatgcacttggaggccgctggtcacgctgctcaggagtggtgcccagaaaaggaaagggcttggtggtacatgaagtgggggcagtgggcagggtgccctgggggggaggcatagagggccctgggggtcatgggaagcgagcacgcagcaggcgtgcccaggagcgtgtgcatgtgtcagagccatttggtccatcatctcctgcaataaacccatcgcaagaatgaccttcaaagcaaaatt

SEQ ID NO: 720760 - DNA, 604 bp, Homo sapiens
gatggagtctcactctgttgcccaggctggactgcagtggcatgatctcaactcactgcaacctctgcttcctgtgttcaagtgattctcctggcttagcctctcaaatagctgggattacaggagcctgccaccacgcccagctaatttttgtgttttcagtagagacagggtttcaccatgttggtcaggctggtctcgaacttctgatcttagtcacgtgatccacccgcctcaggcttccaaagtgctgggataacaggcatgagccaccgtgcctgggaccacctgcattattcttttgccttctccacttactagccctgaggctgaaagtatttaagatcaatgaagagtgacttaggtcctgagttgcagccttcccttatcctacagaatacgataatatctgcctatgagaaggatacctgagacattgaaataagatgattatataaagtgtatacaagcacaacataactttcttctcacatatccatcacagtgcaaatctaaccccttaactctgtaaaactagattgcaaagaatattgcatgtaatatttttcctttgcctcagaaatgggtaaacaaaatttaagaa

SEQ ID NO: 720761 - DNA, 1128 bp, Homo sapiens
  misc_feature (201)..(201): n is a, c, g, or t
  misc_feature (220)..(220): n is a, c, g, or t
gccttgctaagacgcaaaaaaacatccaagtccaaggctattactccaaagcgactcctcacatctataaccacaaaaagcaacattcattcttcagtcatggccagtccaggaggtcttagtgctgtgcgaaccagcaacttcgccctattggatcttacacattatcattgtcttacagtaggaaatactaagtttgtnctggacaaggtcccctttntatcatcattctattgcgcaaggtcatcatttcattataaacaatcacacacatgtcacagtgcaatacccagctgtctgcaagcaacagcaggcttatccctcaacccatcatttgcaagccatgctctcagctggttcttggctgccctggccatctgcacagccatggatgtagtatctatatctagcgcaaacactgtacataatcatatcatttgcgccactttatccaagcatgccatagcagcacaactgcgaagcacattcccccatcaaggcacaggcatcacacattctgtggccttcacattaggtaacacaaagtcgctccgagcatcagcaaacccagacccaaaccagccagcacattatacagtggcaacgcaagcccaccaaccttctctcgcacactctcaattaaccttgttacacggaaacccaagcttacaagaagcaaagcctttggaccccggcacgcacgcatctcctttggttcccacgccccaacttggccgagaggccaccacccaacctcctagataggttatacacccacaggcaacacttggggccttgctctttggccaggacttccttcacacaaggccagcaccgcggggcatcctcatgagcaccttgccaaacagcagaacttcacaatccatcagctcacccttggtacgacgtccataccagcccatactagggggcaaacccattgaattggcatttggataaacacaaccgttatttgggaaacagcgcctttctaacccccaggggagacacagactacccagtgccatataccctaccacaagggtatatatcaagatcgactcatcctcaacaggaacaccaccagcccattaagcaggcactaccaactataacctgaccttgccc

SEQ ID NO: 720762 - DNA, 428 bp, Homo sapiens
atagcaatggtgatgtgttgagctaaagtggtgcaagtcgagactgcttcaggaggagggctagctagccagagaaagcaaccacatattttttttttaaacgggagttagggctcttgtagcccaggctggagtgcaatggcacaatctcagctcactacaacctccacctcccgggcccaagcaattctcccgcctcagcctcccgagtagccggaattacagggctgtgccacaaggcccagctaactgttgtacattcccagtagaaccggggttacaccatgttggtcaggctagtctcaaactcctgaccccaagtggtccatgtgcctcagccttccaaactgctaggatcacaggagcgagccacagaacttaggcccaaccacatttcaggaggcttggaacttcagcctcacctgctg

SEQ ID NO: 720763 - DNA, 156 bp, Homo sapiens
aaaaaaaaaaaaatggccccggcccttttctttcccctttttttacaacctttttttgggggggggccccttccctcccctggccctctttttccccccggggtggggttccccctccttttttgtgcttttggcgggcctccattaacccccctg

SEQ ID NO: 720764 - DNA, 321 bp, Homo sapiens
  misc_feature (201)..(201): n is a, c, g, or t
  misc_feature (220)..(220): n is a, c, g, or t
gccttgctaagacgcaaaaaaacatccaagtccaaggctattactccaaagcgactcctcacatctataaccacaaaaagcaacattcattcttcagtcatggccagtccaggaggtcttagtgctgtgcgaaccagcaacttcgccctattggatcttacacattatcattgtcttacagtaggaaatactaagtttgtnctggacaaggtcccctttntatcttctttggaaggtcactaatttatttacacaaataaaatgtacaagtgaattccagtgttgacagaaagaggtcacctaacccataatttgaacgat

SEQ ID NO: 720765 - DNA, 123 bp, Homo sapiens
cattactgagtctggatggagggatggtaatgtggatgccagatcattctcagccagattggtggtcctcccagacccctcatgtcatgtcatggggttgctcagaatgaatttaggtggtgt

SEQ ID NO: 720766 - DNA, 278 bp, Homo sapiens
  misc_feature (52)..(52): n is a, c, g, or t
aatttagcggtcctatctacctatggtaccccttttattgttactgaaaccnctaggtttaggctaggtcccgcttctcactgcacagaaagctgctcactgagacagccagtattgctaggctttaattgggtgctgcagcagaggagatgggagatcagtctcaaatctgtctcctcactcactaaagataggagtttatacagcagaaatgtaacaacatgcaggaaaacggcactgcagcctggtcagtcttttgtgggtggcatcgataaaca

SEQ ID NO: 720767 - DNA, 337 bp, Homo sapiens
ccacaggctcccagacgaaccgcacctgcacgtgggcgcacacacacacacacacacacaggggaggccacaggctcccagatgaaccgcacccacacgtgggcgcgcgcacaccacacacacccccacacaggggaggccacaggctcccagacgaaccgcacctgcacgtgggcgcacacacacacacacaggcaaggccacaggctccaacacacgctccagacagtgtctgttacgagtggcctcggtttctccccgtggaaacggcacgatgggttattttgtgtttaaaatcacctgctttccataatatgagaaatacatgaactatctt

SEQ ID NO: 720768 - DNA, 484 bp, Homo sapiens
  misc_feature (392)..(392): n is a, c, g, or t
tctttggggggccaaaattcaatcccctaatccatgttagtaaccatgcagtgttccttcttatttctatgttgacctttgcagctctttctatttgatgtatatttgggagatagagtttcaatcttgttgcccagggtgcagtgcatttggtgcaatcttggctcagggaacctccgcctcccaggttcaagcaattctcctgcctcagcctcctgtagtagctggtatgacaggcatgcaccatcagtgcccagctaattgttatatttgtaagtagaggcagggtttcgctgtgttgccagactgtctcaaactcctgatcttgggtgatctgccctcctcagcctcccaaagtgctgggattagaggcgtgagccactcatgcctgnccagctctttctaatgtacacacttaatactaataataataaccaatagaagatgatacgttgcgaatagaaggcatctgaactaaaagtaa

SEQ ID NO: 720769 - DNA, 177 bp, Homo sapiens
aggtatcagagaagtcggtcaggccctcaaattctgtacatttcctagttcgcaattatatatctggagctgggaatagcctgtctgaatatacggtccgcatttttcatgttcccctgaggaagcataaaatttactccaccagtccacgatttcttcccccttttccagaggcta

SEQ ID NO: 720770 - DNA, 310 bp, Homo sapiens
gggtccacagtgaggtagatgctgcgcgtgaagaatttgctgagaggcagacgttgggactgtagaggctgacaggaggcagaggttgtgcctggaggggccaccaagatgcatgagctgctccttgagaggtcgacttgagaaagttcagggtctgcagagaaggctgggaggcagtatctgggtctaaagagtccattgtaacgatgaagctgtgcctgtggaggctgttgtgaggcagtagcctcatctgcggaggctgccgtgacgcaggatatgcgtgctaaataggccattgtgagtcatgagc

SEQ ID NO: 720771 - DNA, 433 bp, Homo sapiens
  misc_feature (39)..(40): n is a, c, g, or t
gggggttctccccctacccccccgggccggtttttcccnncggggtttcccaggggaaaaaaggggggtggggtggggttttgcccccccgggggggggcttttcccccccaggggggccaggggtccccccctaggggtttttttgggtccccccccccatccgggggtcccccctttggttcccccccgggggttaaccgggggggcccccggggggccctaaggggttcccccccccccttcccctggaagggggcgggcccggggggggaaaattccctttttggggagggcccccggggggggggtttctcccccccggttttttttttttttccccgggccttttttaaaatttttttttttttccccccgggggcctttttttttttgggaaaaaaaggggggggggtaagggtttcccccctgga

SEQ ID NO: 720772 - DNA, 1100 bp, Homo sapiens
cttgtgtgtgtgtcgttgagggggctttttttcacaagagtgttgtatccgacggagggttctttgtggcactcgggagcaagtgtactctccgcaagatggggggcgccgggacacactgcatgatcgttgccgcccgattgggtggtcaccgagcggttctcacacaccacaaacagggaggcccggctctgttggtgttgtcggcgcgtgatctggacgcctcgacctcagaagtgtgattctgctcggcgcagcagaaggtggcgcagaacttctgtctctgtccacgcttggatcctctccgtggagggcctttcgggtgacaccccaaggggagcgccgcagtagcccgcgcacatttgtttcacagcgggggagtccaccaccagcggacaacagcacaccacacgcgttgagtcccacgctcgctgtcccgcagattttttcactccgcgccaactcctcggccgatttactttcgtgcaaccacttctcgctttgttctctcgctctgtgccgcgtccacgaggacatctctcccggcgagtctctgtccccagagtgggcgcgaagatttctctgtgtgcacacactgtgtggcgcactctagggggcgccggcgcgcgcactctcctcacagccgcccttcttttcgtggaggacagccacccgttcgcccactagtgtctcgctcacacgcgctctctctctctcactctctggacccggttgtgtagatctctcgctgcacctttgcggggagcaccgacattggcgccacggccggcgtgtgcgcccccacgcacaccgccacttgcacccttctctctctgcgccctatatatctccccaccccgagcctatgtggggcccgaccactcttttctcctgtgacctgactctctgagacacattcctccgctttgcggcctgtttctctctgtgaggggcgcccggacggcgcgcgcccctgccaccaccacctggtttatgagccacccgtgtggctgagccgccgggccacgccccccccctatggcccttgaccttcccccctgccttttgaggggccattaacccggacccaatttccccca

SEQ ID NO: 720773 - DNA, 124 bp, Homo sapiens
gacggattagcatgttacaacatagtgaatcaatcaggactggtgattcaaatgaagattttaaacgcaaaaatgggtcgaggtggcagtgtggagagttgggttctccagtcaggagctctta

SEQ ID NO: 720774 - DNA, 837 bp, Homo sapiens
agcggggtggcggaggctgctgctgccaggtggggcgcgggccggacgactagctgaccgagacactcggcgggcgcggcgggactgcggcccgttggcggcgtgcgcggggacctgcgtctgactaggtccggggaagtttcctgactttctgagaagcccgtggtttccccaatagaagtgatttctgatagaaactctgaaggtcatcgtccgaatgaaaagaagagatctatgtatagtcaataagaattaagagacacatgaaggtttccaatcggtccctgcgtatgtggtatattctggtcagcaatgactgcatgtggaaactacactatgcagattttattgcttcaggaagaacgcggtagaagaagatgcgatacatgatatcctggttccctctgcaggatggcaacagcaacatgagttagccttgacatttagcaggtcttgatttcaatcatagtacatgacaggtgaagatagatgcacaatcgaaggttctacagaagcaaagtggggaagcccagggagaagcagcaaaatctgaaatgctaacatcgccactttgatcctcgatcatacctgaaaatgtctcaaatctccaggagtatctggaatgcatttgtctgccatgtagtgagtaagatggtagattgaaattggctgtgctgcattgcaggaacctgctcatgatcatgttaactcatgagggcagaggctgtggctgcaggcagactttgtcctacctctggcagtgaccgaatgggttgaacatcatgtgggttgtgttgggcgttcattcgtatgggatccttccattggatccttgac

SEQ ID NO: 720775 - DNA, 156 bp, Homo sapiens
agcggccgcctactactactactgctcgaattcaagcttctaacgatgtacggggacatgagaattgcttgaacccaggaggcgaggtggaggttgcagtgagtcgagattgtggactccagcctgggttacgaagtgacagtctgtctgaaaaaa

SEQ ID NO: 720776 - DNA, 453 bp, Homo sapiens
ggccggggggggcacggctttatgttcttttcacattgggtccggcgtgttggccgggattgtagaccgcccggctccctgggaaaaacgataatagtgcacatgcacggtgatcttgcaggaaaggggagcagaaagagcattaccaactaccggcttctattaatgttatcaagagctgttggggcccaagccttattaggtgacatacgaaaggacgcagagctagcagtttaagctgaccggcagatgctaaacttgaaaaaggggaaatgatgactgttctaaaagaacttatttaggcagggcaacgggggggcgacaactcgcgctgatttacgacgagcgcatgttaacactatctgcaatttcgccagtccctgccaattgccctctttcaaaaaggggcgcttatacggctgtgttccttaaacaatacacggtacgggcccg

SEQ ID NO: 720777 - DNA, 910 bp, Homo sapiens
ggagccagattggtggctgatcccgggcgaaaattctgaggtgtacaccgtctaggaaatgaaagactagttcagaaggaagcctgtatagtctcttacaaatacgtaggtaattcaccatgaggtagcgaagcctaaagagggtatatctcggagctcaatgctcaaggaaaggcctagtgagaacaatgctgcgaggacaatcagggccggcagcggtggatgtggggcttgcctatgcgataggacgcaagctgcagtaagactcagaagaagcttggattggacaagaccgctataaatgtacctgcaatgtgacaaagagttgacctgtctgagttcaacgtcttgtctccaacacggagaagatgccatactggatagagatagtcccgtaattggtgatgatggtgggaacatgtggcttgtcagagtcctaaggcctcattgcagcatgctgtgggatccagtacgggggaaaaaggtccctaaaagatgtgatgagtgtggacgaaggcgtgcaaacaggagtaaaatctcattaagcaacagagaatacatatgatgaaaaagttatcagtgtgatggagtgtggcggtgtttgagaccaggagctcccaactgattcagcatcagagaaccgcacgactggtgagaaaccctaaccagcgcagtgaatggttgccagggtcaggcgagagcctcaatcggaggcgcgccataggggcattccaagaccgcatgcctgttaagaccgggccaaaatagggggagagtcacattcccttggaaacggttaggaagaaacgtgggcgtccggacaaaatagagttgagggcgtgggggacccccaacataagtgcatagaagcggctaaaaaagggggggcacatacgcgtgccgacgggtg

SEQ ID NO: 720778 - DNA, 827 bp, Homo sapiens
tatggcatacagtaccgcgcagcgggcacggagggccccgtgtcaggaggtggatggtgtggccaccaaccgctacagcattggcggcctcagcccatttctcggaatatgccttccgcgtgcgggcgggaacagcatcgggacgagggccgcccagcgaggcagtgcgggcacgcacgggagaacaggcgccctccagcccaccgcgccgcgtgcaggcacgcatgctgagcgccagcaccatgctggtgcagatgggagcctcccgaggagcccaacggctggtgcggggataccgcgtctactatactccggactcccgacgccccccgaacgccgtggcacaagcacaagcaaccgacgcgggggctcctcaacgaccgtggggcagcgtgaaccctgactatgcgtggcagtgggtgcacccatgccctacgtgaagtgggatgatgggggccgaggagctcaccaaggaggatgagatgccagttggacgcaacgtcctggagctcagcaatgtcgtacgctctgccaactacacctgtgtggccatctcctcgctgggcatgatcgaggccacagcccaggtcacagtgaaagctcttccaaagcctccgatgactctgtggtgacagagacaactgccaccagtgtaccctcacctggagactctggggaactcggaagcctggtaacctactatgtgcattacactataggcgtgcgcgtgcttgccttcaaccgccgtgggcgatgggcctcccagacccacacatcaggccagacgcagcgggagtgctggccagccggggactcaggcaaagtgg

SEQ ID NO: 720779 - DNA, 153 bp, Homo sapiens
cacaggttgatgtgttaaaacaaataaatattggctctctgagaataatacttctgagcttgttctcgatattacagaacaaattatttctgaactcaacaccatattctttcaagcaccaaaatttattgtgtggataattttcctctgcag

SEQ ID NO: 720780 - DNA, 441 bp, Homo sapiens
aaaaccatgtattgaagcatactactaaagaaagttgactttttgattatcgtctctgcatagaacatctgtaggaatatttctttagtaattttcaaatcttcccatggcctctctgttcacagaaatatcatctttgaaacaacttgtgtgagttacttaactaaatcaaaaattgattcacatgaccatcttaccataatcaccaattttaacagtctcctacatattttctatatcacttttcttgattactaaatgtctgtaataagaacacgctctttatataacagaatattttattacatcagtttcccatgaacacaccagagtcacttaataattatattggccatttccactgatcggcaggaggctcttccactaatggctcccatagtttccattccctcatttttcttgcccgatttagttcatgtc

SEQ ID NO: 720781 - DNA, 308 bp, Homo sapiens
attagatgacccttggtgggctttgattagatcagatgcttgagatctgtaattactctgtcagaaatctgtatttatagcagtgccctacctcttccatcaatgtctgttggaaaactgcacaaatagaaagacaacactgatggaaacttctttattagcttagggtgtatatagccacttagctgtgccacctcttcaagggtaggagtaatacagattccttgcactgtttctaaggcaacgtactgcaaaagtgtgttctcaagaccagatgtcagtcttaaaaagaaaaaaaatcaaagaga

SEQ ID NO: 720782 - DNA, 134 bp, Homo sapiens
cttagcaccattcatgtgacactccaaatatgactatgaaagactctcgtcagttgagaaagctaggagcagctaagagaacaagtgagatgacctctttgatcggaaatttggtgatgctcaaagatcttaga

SEQ ID NO: 720783 - DNA, 796 bp, Homo sapiens
gggctgcgtcgggctgctggagaagatggcggtctccaacagggagttaaagttcctcgtaatgtgtcgcttgtggaaagaacttgaagacggacaataaaggagtaggcgacggtacagttagcgtggggccattgaagatgatgaagatatgacagttagaaggtagacaggcatgatgactgggcgaccgaagggacaaattatgaaaataagaatatatagcctgaaagtagaatgtggacctaaatactcgcagaagctcctccgtcgagtatagattgtgtaacgataaaattaatatgaacggaataacataattccgagtgggatggtggatgcctcggagcataccagtgttaggaaaatggcgggaaattcgatataggcattaacagttgtatcttcaagagctaagacgtctaaatgagtgtacaaagacagaatatgaagcttccacatgcagcagagggacaaacttgcaacaagtaatgttagtggatcgtcagagtgtgtcttaaatcaacaagcttctagctcatgttaatgtcttgattaagtgatcacaactgtctgaaatacacatttaatgtagagagatttccagcttggtaaacatgactggacattggtaagaatatatgtaactatttgtacacccataatgttttcaggtaacaggagggccactgcggcgaaatttcttgttcttgaagggcactggtcattgtaaataaactgggttcgtccaatgcgatccgggtcccgatgaaggcgctgggaagtgcagatgtcg

SEQ ID NO: 720784 - DNA, 741 bp, Homo sapiens
ctttaggggggaggtgtctaaaggcgagtgaacaaggggttttgtcagtagttcataaacgaggagagtggcctgcctatatacaatatgtgttcgtctccacatttaaatttgccaaacttatttaatcaagggctgtttcttttgggttttccagtggaaattaggctccctaaagaatttgtcattaaaggggattttggccaacttatatggccaccatatggtttaccttgtgtatgtgttgcgatatatgtgaaattccgcaatatgccgcgcagtgacaatttcaggtcagatctattgtatgatctgtatgcacgaaatgctttttattactcctaccaaataggccaatcaagtcgcatttcacatcaggtagcgcccatgctcgtctatcgaacagcaggttcgctggattgaatcacaagcaagaactgcagatgatccattgctatccttctgataattgggcatgccaattcaaactgtctgtgagaagacagggacaagtattgacatagaatatttcaggatatctcccccgagcatttcccgatttgggattttgccatcaagtccacatctaggagtgatgtcacaaaagggcctttcaaaataacagagcagttgttctgtaaaccacagagtgatccgtgtgtaggagactttcttaccggacgtgtaaatgagcatcttgaacatcgcaagatatccaaatgcattgaatgggccactacc

SEQ ID NO: 720785 - DNA, 378 bp, Homo sapiens
ctaggaaaggctctctgtaggaggtacatcgtgaaggtggcctaaatgacatgaagggtgagcctgcgagtgttgctttctggggaagagcatcaggtcgaggaaacagcgacagagggagccaaagagggagcgtgtagataggtgatcatgggcctgacaaggtagaacagccatgagaaggttcctgggggcttggagcaggacgtgcaagtgagtttaagagtgatctctgacagctgtgcccagactgcagtgtagggccctgaatggaaatgaggagagccatggggaatccagtgcaactgtccaggaaggagagggatgcttccacactctgaccacggacggcacaaaaagcaccaggaaagaaccaca

SEQ ID NO: 720786 - DNA, 191 bp, Homo sapiens
agtgagctggcgacacaagttggagaaactatttagcattccttctgtgggccatcactttttttttttgggcagggggagggtcacgggggatgaaaaaatttccctcttgttgctcagtctcgctctgtcgccaggctggagtgcagtagttacgacctcagctcactgcaacctccgcatcctgggct

SEQ ID NO: 720787 - DNA, 364 bp, Homo sapiens
tcggcacccagaaaagatgccccagacctagcaactgatgttatctctagattatataaagacattgtaaaacttcccggtctgttctatttcactctgaccaccgttgcatgcagcccctgtcacgtaccccctgcttgctcaatcgatcatgaccctctcacgcggaccccccttagagttgtgagcccttaaaagggacaggaattgctcactcggggagctcggattttaagacactagcctgctgatgctcccagctgattaaagccactcccttcactatcttggtgactgaggggttttgtctgcggcttgtcctgctacatttcttggttccctgaccaggaagcgaggcgattaa

SEQ ID NO: 720788 - DNA, 140 bp, Homo sapiens
gataaacagcctcaccagtacatatcttcctaggataaacatagtgaggcactctcccacgaactctacacaacatattttgtcagtcaagacccgtacttctaacctccctgttcttatgaattcgaacagcatacccc

SEQ ID NO: 720789 - DNA, 218 bp, Homo sapiens
gaaaaggagaaatacggtaacttcgcacactctgcctccggagctgagggagctcaacgactatgccggcgcctgcaccctgcgagttatctgcgggaacttgggcgaagtggagcggcccatgggtccgcgtgcttgcgggagtagctgcggtttctcggggtgaagggcgcatctcttctgaggtctggatttcttcttggtcttgactcatttcc

SEQ ID NO: 720790 - DNA, 521 bp, Homo sapiens
  misc_feature (390)..(390): n is a, c, g, or t
catgtcgtggccagtggcagcctaatggtgaacgggattacagatagcacatactgttgctttcagaagaaaatgggtaattcccttaaaatgattaggtatatactgtaatttgatttttggctcccttcaaagatctctgtagaaataacttatttctcagtattctacagtttaatcaaattactgagacaggacttttgatctggtatttatctgccaggaatatacttcattcactaagtaatagactggtgctgtaactcaagcatcaattcagctcttcttttggaatgcaagttttgcctaaacataaaaaaaaaaatcctcagtatagcttgccatttagaccttgatcacagtatttaagtgtttagcgttttatacctnaggtcagtgctacagccatctagcatgaactaacccagattccacctccataaagttacctcgagttgttgagttggaatatgttctggcatataccttacctgccaatcattagggagaggcacaaggta

SEQ ID NO: 720791 - DNA, 906 bp, Homo sapiens
tatccgtcatctactctaccatcttagcgggcacactcatcacagcgctaagctcgtcactgattatttatacctgagtagggctagaaataaacatactagcttttattccagttctaaccaaaatacaatgaaaccctcgttccacagaagctgccatcgagtatttcctcacgcaagcaagaccgcatccataatccttctaatagctatcctcttcaacaaagtatactctccggacaatgaaccgatagaccaatgaactaccaagtcaatgactcatcattgaataatccatagagtggcgtatagccagataaagctaggaatagccccagttgcactgctgagtcccagaggttacccaaggctaccgcctctgacgatccggcctgcttcttctcgacatagacaaaaattaggcccccatctcaatgcatgatgaccgaaatctctccctcactgaaacgtaagccggtgtctcctcactctctcaatcttatccatcatagcaggcagtctgaggtggattaagccaaaaccagtacgcaaaatcttagcatactcctcaatgtacccacataggaggtgacctaatagcagttctacggtactagacccctaacattaaccattctttaattttacactatgttatatatatgccgtaactactaccggaattcctactactcaagtgtaaactccagcgaccagcgaccctactagctatctcgcgccgtgaaacaaagcgtaacatgatgatcaccctttaattccatgccacccttcctctcctgaggggagggctggcccccggtaacgggcttttgtggcgcaaagggcgcgtatcggagaaattcccgaaaaattagggtgtgaaaccccaacataaaggggcaattc

SEQ ID NO: 720792 - DNA, 117 bp, Homo sapiens
ccgctgctgggcttggttaatagagtatcttgcgtccttttgtactcttctgactaccttcactcatgttttagcacctgccagccacagcccccagatgcgggggtaccgagctcg

SEQ ID NO: 720793 - DNA, 81 bp, Homo sapiens
aaattcattttgtaaaaaatttaaaagggctattttgtttggatttgaaaatctctgggaaaaaattctctctttggtcca

SEQ ID NO: 720794 - DNA, 1391 bp, Homo sapiens
  misc_feature (137)..(137): n is a, c, g, or t
  misc_feature (725)..(725): n is a, c, g, or t
caatatactctccggacaaggaaccataagcgaatactcagcaatcacatagctcatcatatagataatcataactggtatactcagacaagtatagaacataggaagtaagctcccctttgcagcgtatcatgagngtcctcgagagcgtataccgcgaaggggcgaccaccgatctgatcaatccaggctctgctctgtacttactcacaatgacaagaagactaagacctcaccatatcaacctacagtactgccaacagtgctcgtcgccttcacgtaatcctggtatacgccctttcttccgtcaccgtctgctcaaagtctctaatgcgcaatcagtagtgcagagtcagctcgagtgcatggaatgtaatagccaaagaccgcagtgtatcgacaagacaatcatgtaccggggtaccgtccaatcgaatgttagcccagcatgtaggggagtgggagtacatgtatgccaaggtatactagcacgatagaagacgcgccgtaaggcagtagatccaagtgtcttctacactattagatcgtagatataacatacttaattcccgtaacataacctacccgtcgatcccctctacagtacgtcgaacctctaagacttcacaagccactcatcgcaccactcacttacctatcctcgacgaccttgccaaaaacaagggctaacagtgcacgtagacaaccccatatatagttcccantcccatgcgctgctcttctctccataggaagggccctgacccccgcagacttaaactccgtgcgtttattgtgcccctaaacattggcgccgatttagtcgacacgtagaatttcccacataaaaaagcaaattaagcactacatacaataccacacaagacaatgccataaagacccaaaccaatacaacccgcttccatttaaaaaccattcctaaactataataaaaacttaaccgcccctaaaattcttaacttccccaaccctacaaaattcaacaattaaacatacccgcgaataattccaaacaaacggtaaaaaagattaaaaatggacaagttggaacagtttctcgaagaaaatcccaaacacccaagttgttcgtgccccggtgaaaatcaatcggggcccatttaccaaggccttaattcgtaacctaattattcccccatgtagataggaagaaaaccctatgagaggacaaaagaacaaaagggggggaacggcacagaagtatcccccagggggccacgaaggggaaacacagagtaagagaaacagagggccccaaaaaggagagagaataagacacggacgggaggcgatacacatgaggaaaagcgcgagaggcaacaaggacaaccacagagtggacaaagaaaaca

SEQ ID NO: 720795 - DNA, 353 bp, Homo sapiens
  misc_feature (39)..(39): n is a, c, g, or t
  misc_feature (77)..(77): n is a, c, g, or t
  misc_feature (96)..(96): n is a, c, g, or t
  misc_feature (248)..(248): n is a, c, g, or t
  misc_feature (266)..(266): n is a, c, g, or t
  misc_feature (337)..(337): n is a, c, g, or t
ccggaagataactaaagttccaccataactctagtcagnccaggcaaacctgagagtccagtactgatcatcacacncgcatttgttattcttaancacatcactaaattaaggccgactttttctttcttttcctatttttttgagatggagttttgctcttgttgcccaggctggaatgcaatgtgcgacctcagctcactgcacgccagcctgggcaacagagcgagactctgtctcaaaaaatnaaataaaataagacacangataacaagtattggtgaggatatggagaaaaaggaacccctgtacactgttggtgagaatgtcaatcagnacaaccattatggaga

SEQ ID NO: 720796 - DNA, 1508 bp, Homo sapiens
ttccttgttaaccaagttacttttaaaaagatcctttttaaactgattcttcctcagctgttcttcagccctctatactttttcataaaagtcaccagtgactgcccagttgccaaatagaatgaatacctttcagtgctcagctgtcttgacctctccgcagcatttcacaccacccaccaaccctcagtgaaacaacctcctcccttagcttttatgacaccacaagtctctggattctcagagaatccagaaaaacaagtctctggattctctcctcttacctctcagcccacacaggctgagctgtccttgaaacctagatgggggaaatgtctgtggctgtctgtggtctcttcttttcaggagttgggtagggaggaagaatcacagctgctcctgcttcctctgtctgtctctctatttcctgagtcccttccttttcctgaactcagttctcctcatgccaaccatgtttatgagctcctgctgggaggacagcatctgtgagtccttccctctgtctctcccagacaacacagaggttttagcctgtttgctaagagaccccatctaagtcagcccaagggtgtggattaggttttacagcatccaggccgcagtctggctaaactggattaccaggctggtgggcagctcctcaccatgatcctgcaccagttagagcctgctgtagttgggaaggagcctgggattgtggtaagatgtgtttccgtgcatgtcagtgctgctaaccaggaggagaacctggcagggtgggtgcctgctgctgataacattcggatggagggagactagggagcgcggtggctgctcccttgctggggctcagctggagtcagcatgactccttatatcagggcctttcccacctgtgctgatcaccaccacctgcttgctccagttgtttctggagttggaggcagctattggttgctttcttggaggtaaggaggtatatactagaaagatatctgatttgagagtctgaacaccaaaatttttggctctttccattatgagctgtgtaaccttggatacagtttcctcatctataaagttgtggtgggagaatggctgagaacagtgatctctcagctctccagctgtaaagatgttaattatgattttaactctcaagatcaggccacataaggaacaggggaattccaggggtgggacacagctgggggagtccagaccagggcagggaaaggagactcacaagccaaacagagctgctttggggaaagttcttatcagctggtgctgcttcctgagccatatgcccattcctcaagctgtacccctttcttggctatgtaggatgagttcctcctaggcccttgttaggagtggctattggattctaagcggttggggcatgagggaggatattttaaagggaagtatagctgattttaaaagaacctatacattcaagaacaaataaaaaacagcacttttctttaccaagaaaaaaaaaa

SEQ ID NO: 720797 - DNA, 1154 bp, Homo sapiens
ttccttgttaaccaagttacttttaaaaagatcctttttaaactgattcttcctcagctgttcttcagccctctatactttttcataaaagtcaccagtgactgcccagttgccaaatagaatgaatacctttcagtgctcagctgtcttgacctctccgcagcatttcacaccacccaccaaccctcagtgaaacaacctcctcccttagcttttatgacaccacaagtctctggattctcagagaatccagaaaaacaagtctctggattctctcctcttacctctcagcccacacaggctgagctgtccttgaaacctagatgggggaaatgtctgtggctgtctgtggtctcttcttttcaggagttgggtagggaggaagaatcacagctgctcctgcttcctctgtctgtctctctatttcctgagtcccttccttttcctgaactcagttctcctcatgccaaccatgtttatgagctcctgctgggaggacagcatctgtgagtccttccctctgtctctcccagacaacacagaggttttagcctgtttgctaagagaccccatctaagtcagcccaagggtgtggattaggttttacagcatccaggccgcagtctggctaaactggattaccaggctggtgggcagctcctcaccatgatcctgcaccagttagagcctgctgtagttgggaaggagcctgggattgtggtaagatgtgtttccgtgcatgtcagtgctgctaaccaggaggagaacctggcagggtgggtgcctgctgctgataacattcggatggagggagactagggagcgcggtggctgctcccttgctggggctcagctgggggagtccagaccagggcagggaaaggagactcacaagccaaacagagctgctttggggaaagttcttatcagctggtgctgcttcctgagccatatgcccattcctcaagctgtacccctttcttggctatgtaggatgagttcctcctaggcccttgttaggagtggctattggattctaagcggttggggcatgagggaggatattttaaagggaagtatagctgattttaaaagaacctatacattcaagaacaaataaaaaacagcacttttctttaccaagaaaaaaaaaa

SEQ ID NO: 720798 - DNA, 983 bp, Homo sapiens
gcgggagcgaggggcgccggtgcggtgtgtgctcctgagctcttcagaaaccaggctgcttcaggaacatgctgtggattcccaggcctattccactagaagcaagatggtgaactcaatactcatgtgaatgtcaaggaaaagatctatgcagttagatcagttgttcccaacgcaaagcaataatgaaatagtcctggtgctccaacagtttgcattttaaatgtggataaagccgtgcaagcctttgtggatggcaggtgcaattcaagttctaaacgaatggcaatatgacaggaacacccagcacgcacaataaacagaccaaagaagcaagtccaagcagcatcaaggcaacaaagatgctaaagacaaggtggagaggcctgaggcagggcccctgcagcgcagccaccactagattcaaaacggcccatgaaatggctgcgagaaggacagctcgtgacgaaaacagatctcgatacttgaggacccttcaaaggcacttcgtggggtcaccacggcccaaatattgcgaacctcagtgacaggatttgcaaccgctgcagcgtttctctaactagatatcgcgtccttgatttacggaaagcaagtggctagtcccgtgaacgacgatcacaggctgctgttggtgaatttacccaaacttgcattcatctgcacaacagacagtttccttaactgggccgcacttggctactgttcacagcaacgacagccctggcaatcctggactggttcgtcacaaaacaaagcagacaactaaagaaacatcactgactcgccagtcagatggcgcagtgcacttggcgcacccaggcagcaaatagccttttgccggaccgtcaatttgacgcgcagccgccacagtgccggtcttggcattgcagtgaggccaccttctcgggggataccttccaaactattcagatcccgacgccggtcgggaggcacgcttgaca

SEQ ID NO: 720799 - DNA, 367 bp, Homo sapiens
gaaaaggagtggggtggtgtcaaaccctggaggccccaaccctgtcctcccgagctccttttccatgctgtgggcccaggggtgggaggaaggacttccctgtgtagtttgtgctgtaaaaagttgctttttgtttatttaatgctgtggcatgggtgaaaaggaggggaaaaggcctgtttggcctttttgtcctcttttcctcttcccccaaaattgagctttttgcccttgatcagcccccccctggcctagaccagcagacaaagccaggaaagggtcagctgcattccgcagcccccccccccaaggttttccaacatcacagcccagccccccccctgggtaataaaagtggtttgtggga

SEQ ID NO: 720800 - DNA, 853 bp, Homo sapiens
gagcgtgcgtgagcgggccggaagactgaccccttcctttcgcagctgcaccaggtgcaggtgccccgatgtgccagcagatgatgcacgcctgcgcacatcaactcgcaccatggaccgctgatctgctgcatccacaccggcggggcacagcgagagcccagcgagccaggtgatcgccaccgaagaccgagaggcacgcgggcccaaggggacacatcgaccagaaccgagagccatagcaggcaggcggcctgtcaggaagacagcatcaggacagctgacatgcacggacaaggacgaccaccggagcggacagagcgagaaggcacgacagaaggcggccagaagggctgacggaccgaggcaccgcaaagaacagacagagacaacaagcacaccgaagcaaggcacgccggagaggccaaacgccacgacacaccgagacacaagaaaccgaagagcacgacaagaccaccggacaacatcgaataacacccaggaaagaaataaaccacgaggaggcaccacagcaaaaaccagtaagacggccgagcacgagcacaacagccgaaaaaccgcgagtccaccaagggagggcacacacagcagaggacccgagctacagaggacacaaggcaccagagcaccgtgcacacgcgcacgctaagataaagcccacacacccaatgacactcccacgtcgtagcccacacaacagacgcgtaagacgacacgaccacagacagtcggcaatcggtcacgaaacacggggacagagccaagcggacccacggaagaagccagagaagacgagaccacaacaaccagccggcaaacgacacgagacaac

SEQ ID NO: 720801 - DNA, 361 bp, Homo sapiens
gcttaattggaatcttgccttacagtccttggcccttccttcaccttgtatgtaatagctgtctccccacactttacagaatgtaggttaggggtgagtcatctctgtttgtctttcctttagagcccctctcccaccacccttgggaaaggagagtctagaggcgttttcttaccaggcctgccgacccctgcaccatggctcggtgctgctcctcagcaacagcagcagcaacagcaacagcagcagcagcagcagcaggcaccgccggcttcacagccacagcagcagccacagacaggccctctggttcccccacggcaacccacggttggctctccagcagagtcagatgagggaa

SEQ ID NO: 720802 - DNA, 946 bp, Homo sapiens
gcggtcgcgcggagtgtttacttgcggcgggctgcgtgggtgtcctcgggacgtccctttgggcccgtggtacaatttgccggacccgtattttggcccctccgtgtgtcgcgctttctgcgtgactgtgggcatattcgccttggggagggtttttgtgtcgtccggggccaccagtttttccggtttatcgaagtatgttacactgtgctccgccgtccgtgcccccacccgtgtgctgccgtgccagtcggccccgcatttgggtgtctagaaactagcgtttggtagttgacgggcaaaagcgcctttccctgtggccccactttcagttgttgcccgctgatggggagcgcttcgtgccagctaacccttacctgaagtctgtctacgttacaatctgctaaaaacacatttattctttccggcccacaaactgtaattttgcgtcttttagaaaaaatctttttgtctgcctacaaaacgccccccacatgcaataaattggtctcccctaatttccgccctgatcaccccaaggaggtgaaaatagcagtttataatacacactgggtctaccgactcaaaaggcatgacgacaatatttttactgaagacaacactctgttattacctcaccttattccctcgcttctataatacttctcaaattatatctcccccttcacaaagaacccttccttaaaacgggataagacatctctgaatgagatcatttggtgcgcatatcgtcagatattcaccccgccaaaatgtcttttccccctaaacctcgaggtcattacatacacgccccctttttgtaagacaattttccctcattaaccccatgttccctcccttggataacaagatggagataaatcccttgtatagcctctaaaatggtgtaccctctttttttggtaataacgaccacaaaaca

SEQ ID NO: 720803 - DNA, 246 bp, Homo sapiens
ttccggcgccagaaactttgccgctccggccgaatacaaaccaacagactgtagccattttctgatcactctcctagatcatgtgaaggcacaggttcagagcctccaggagagttccaggcgccccggcagggggactgggagtggggactgtgcccagattgaaggctcgggacaaaggcacgatgggcaaacgcgtcaaggtgtgggcgtcgagtgaccgcgggcggagatcgccagcggccg

SEQ ID NO: 720804 - DNA, 713 bp, Homo sapiens
  misc_feature (64)..(64): n is a, c, g, or t
  misc_feature (166)..(166): n is a, c, g, or t
  misc_feature (183)..(183): n is a, c, g, or t
  misc_feature (203)..(203): n is a, c, g, or t
  misc_feature (218)..(219): n is a, c, g, or t
  misc_feature (231)..(231): n is a, c, g, or t
  misc_feature (251)..(252): n is a, c, g, or t
  misc_feature (300)..(300): n is a, c, g, or t
  misc_feature (303)..(303): n is a, c, g, or t
  misc_feature (337)..(337): n is a, c, g, or t
  misc_feature (349)..(349): n is a, c, g, or t
  misc_feature (367)..(367): n is a, c, g, or t
  misc_feature (378)..(378): n is a, c, g, or t
  misc_feature (380)..(381): n is a, c, g, or t
  misc_feature (404)..(404): n is a, c, g, or t
  misc_feature (422)..(422): n is a, c, g, or t
  misc_feature (430)..(430): n is a, c, g, or t
  misc_feature (432)..(433): n is a, c, g, or t
  misc_feature (442)..(442): n is a, c, g, or t
  misc_feature (456)..(457): n is a, c, g, or t
  misc_feature (462)..(463): n is a, c, g, or t
  misc_feature (480)..(480): n is a, c, g, or t
  misc_feature (503)..(503): n is a, c, g, or t
  misc_feature (509)..(509): n is a, c, g, or t
  misc_feature (520)..(520): n is a, c, g, or t
  misc_feature (530)..(530): n is a, c, g, or t
  misc_feature (558)..(558): n is a, c, g, or t
  misc_feature (596)..(596): n is a, c, g, or t
  misc_feature (598)..(598): n is a, c, g, or t
  misc_feature (624)..(624): n is a, c, g, or t
  misc_feature (628)..(628): n is a, c, g, or t
  misc_feature (630)..(630): n is a, c, g, or t
  misc_feature (633)..(633): n is a, c, g, or t
  misc_feature (637)..(637): n is a, c, g, or t
  misc_feature (640)..(640): n is a, c, g, or t
  misc_feature (660)..(660): n is a, c, g, or t
  misc_feature (666)..(666): n is a, c, g, or t
  misc_feature (668)..(668): n is a, c, g, or t
  misc_feature (682)..(682): n is a, c, g, or t
cgcctcaaaggggtcattgacctcattttgagaaggccatttcagagcccaacttctctgtggnctatgccaacatgtgccgctgcctcatggcgctgaaagtgcccactacggaaaagccaacagtgactgtgaacttccgaaagctgtgttgaatcgatgtcanaaggagttgagaaaganaaagatgatgatgaggtttntgagaagaagcaaanngagatggatganagctgctacggcagaggaanngaggacgcctgaaggaagagctggaagaggctcgggacatagcccggnggngctctttagggaatatcaagtttattggagagtngttcaaactganagatgttaacagaggcantaatgcatgantnntgtggtcaaactgcttaaggaancatgatgaagagtccctngagtgccntnngtcgtctgntcaccaccattggnnaagannctggactttgaaaaagncaagccccgaatggatcagtatntcaacncagatggaaanaatcattaangaaaagaagacgtcatcccgcatccgcnttatgctgcaagacgtgctggatctgcgagggagcaangngggtgccacgccgagggggatcaggntccnangancatngancagatccataaggaggctgngatggnanaacatcgagaggcncatcaagtgcaacgccgcctccatggcccag

SEQ ID NO: 720805 - DNA, 199 bp, Homo sapiens
taggagggaagatcatggctgtgaggtcaggacgggggtggtgggagagatgctgaagcactgtgaagaggggtctgtctctactttgcagagagagaggagccagtgaatatttttcagcagctgagatgtgtgatcagataaggttgggaagagataaatttttccctggctgatacgtacagagcacactcctagc

SEQ ID NO: 720806 - DNA, 403 bp, Homo sapiens
cgatcaccggggtgctgatgactgctgcgccgagctgccgatgtcatcatgaccttcgcacagtatggtgactatcctccgagccgtcgagctgtctggagaagcagcgagcagctggctgccatctatgccgtcctggagcagcttccagaagccaagcacaactccctggagagactcatcttccaccttgtcatggtggccctgctcgagactgtcaagcgcatttcgccttggggcgctggccataatcttcgcaccctgcctcctgcgctgccttgacaattcggacccgctgaccagcatgaagggaggtcctcaagatcaccactgtcgttggctgctggagcagccgcataaatcaggcataccaaggattgccctggggaactaacgacgataa

SEQ ID NO: 720807 - DNA, 206 bp, Homo sapiens
  misc_feature (11)..(11): n is a, c, g, or t
  misc_feature (27)..(27): n is a, c, g, or t
  misc_feature (41)..(41): n is a, c, g, or t
  misc_feature (105)..(105): n is a, c, g, or t
tttcaccttantggtcaggagttccanaccggcctggccantgtggcagaactctgtctctactaaacaaacaaacaaaaaaattagctgggcatggcggtgcanacctgtgatcctagctaatcgggaggttaaggcaggagaatagcttgaacccgggaggtgaaggttacagtgagctgagatcgggccactgcactcctgcc

SEQ ID NO: 720808 - DNA, 205 bp, Homo sapiens
ggcccccccttaaaagtgggtttgttccttcaaccaacaaaatttgggggtccccgtagtaaaccccgtattaatttttccccgtttggccctccaaaaaaatcccggaggatatttttaatggggggggttctaaatgaataggaatcccccccctgggctgttttttagggccagtaataaacataaggactgggttcagtta

SEQ ID NO: 720809 - DNA, 489 bp, Homo sapiens
  misc_feature (451)..(451): n is a, c, g, or t
  misc_feature (467)..(467): n is a, c, g, or t
tggtgctgggcaaagggagaggaaatgccactgtggaaattgtggacggttcagggagatgagatcttgggttgtacacgcagcttatatacagagcctggttcataatagacactaatagttctgttatttcctagaagtttcccctgcactgctcatcttgcatcatctggaatggcgttggagattagccggaaggagcgcaggagagagtgtatatatatatttatacatatataaaattgaagggatcttgcagctaaacaacttaaagggatgattttacaactcatttttttttaaatttagtgttcttaaatcaatccagtaaatattaatgtatatagatttatgaagcctggtgtaatgttgtggcttatcttcatgatatcatatgcctaaatcaagccaatcaacctggtctgttcccactataagaaaattatcaccnaatatatatatatatntatatatatatatatatatata

SEQ ID NO: 720810 - DNA, 1664 bp, Homo sapiens
gtgatctgtagcatgagggctgcgccatgaccagggcactcgctggaacgacaaagctgaggagaataagcgataaaggacgagaagagaaagacaagtagcttctgagatgtggtacaagctctgccgtctggtccccgaaccttcaccaagagaccaaacagcagaacgtcatactcgaggcactcaaagcagttaagtgatggtgaacaagctgcctccaggtatctccgatttcctgatctgaggcacccaagctcacctcagggtcaagagcaacagggaccaaagaggatgaagtggtcttgagtggaacgggaccaaacctcgccagagaatcacacagcgaaatctatacgcagtcacaacactccgattgaccggcgcgcatgaaccgtggatccagaatagcaccacgatcaggattgatacggaagcacccatgccagacgatgatgtacacgaactaccacactggaaccaaacacaacaataagcacagataatacaacaaaagcaaggaaacccaaaagaagcaataaaacagaaaagcaagcaccggcagacatataacaacacaatagcaagaacaaacaaccccccaagagaaacaaataaaaagacctcgaacagaggaacacgaacgagtacaactagaacccaggcagcaatagggaacaataaacaacagaaaacaacacagaaagcgacacacaaacgaacgaaacagaatcacaaacaaaccaagacataccaaaaaaataccgaaacaaaggccaagacgagaacaacacgaggaagaaaccaaatacaaacacagacaacaaacatggacacacgcacacacaacacaatggatcatacaacagccacaaaaaccacaccaaacatagaaaaagaacaacacacacgaagtggatacagcgacacagacaatgcaaagcgacaagcgaacacaaaatgagagacacataggtcaaagatgaacacacaaacagaaagcataccaaccaccaaatactactacagcacacacacgaaacaagagtagacaacacaacacagcaaacggcactaagcaacacgaggaacagaatgacaacacgcatagaacaacaatagcgacaccatagaacacacaactacgtggacagtacaccaacaccatcgacaagaacaaagagagaacaatacaacaagacacaaccaaaacacaacgggacaaaaaaccgacaaacaacaaccaacgaccaaaagcgagagagacacaaagtcacaacaacaaacaaaaagaaacacaacacaaagatacagacaactaccaaagccgaacaaaatacataacacacgcacgtcacacgaatgcaaacgaagagaaagtactgaagacaaaagcaactgacaatcacaccagtcaatcaagcaaaacacaataagagagacaagaaacaagaaaaaatacacgaacaacaagagacagacacagaaagcacaacaaacatgaaccacgcaccacaacgacaacatcaacgagacacagaagtcgaaacgagcatcactcctatcaaacaaacgacagcacaaaacataaggatcacaaaaatagctaacaaaaacggaacacaacagaaggcgagcagaagaagaggacagcgaaaaacgaa

SEQ ID NO: 720811 - DNA, 319 bp, Homo sapiens
aataacataccagtccttctgtacctcatgtatggcagagatatctactctgaagcctttgtatgggcctgggtacgtatgggagacctgagatggaactgaagctggggctgcagcctgggcacttgtgttttgataccatggcactatggcctatggcctatggcctttggcactgtgcacagcctgagccccttgtgcaatactgggcacgagcacgcttcccaagcttgtgtgtgggcaatgtaatgcaattcgatcgagcttgcggcttgacaacctaaggtatcttgggcttaaactccttgggcttcacgat

SEQ ID NO: 720812 - DNA, 265 bp, Homo sapiens
  misc_feature (72)..(72): n is a, c, g, or t
aaaaactttccaaaaaaattttcaaccccttttcccccttccttggggggggagggggttctgaggggaccnactttccccggccccggcccctttttaaaccttttcccccctgcccctttgggtcccaggggcaaaagaaacaagggatttttttttccccccccccccggggggccccccccggtggggtttttttttaaacccccaaggggggttcccgggccccaaaaaaaaaccaaaattttctttttttccccgggga

SEQ ID NO: 720813 - DNA, 302 bp, Homo sapiens
tccagattcatgattgtaaaaggatcgcgagtctgacatgttcaggttggtcctgatctcggaagtgtggtagtctgtaggtgtggatgtggtatgtggatgtgaagtggtgcatagtgctctgggaagatgtaagcctggcagcaggggagtgtgtgcaggagcagggctacgggtggtctgcgcagtttgtaacaggggcctggccaatagctggggttcaggacacagttcagattagcaggggagggatcccggggatggccagggtagatgacacttccaagcacttccgagtgagt

SEQ ID NO: 720814 - DNA, 115 bp, Homo sapiens
  misc_feature (4)..(4): n is a, c, g, or t
tatnctgggtataggtggaagaataatgaggcaaacaggacatgagtcagacgctggagccagagaccaagaaacagtttctgactcatgtcctggttgcctcatcgggtgatga

SEQ ID NO: 720815 - DNA, 283 bp, Homo sapiens
acccccccccccccttttttttgggggggggggggggggtcccccccctttttttttttcggccccccttttttttggggggaaaagggggggttttaaaccccccgccggtccaccccccccggggggggggggggtttttgggggccccccgtgtttttttttttgggggggggggggttttggtttttttttttttttccccgggctttttttgggggcccccccccccccccttttttcccccgtttttgggcccccccctaaggggttttggggggga

SEQ ID NO: 720816 - DNA, 1500 bp, Homo sapiens
cgggccgtacagcggcttgcggtgagaaatgccccttccgggctaggagcgacggtgccgtgccgctatactcgcaccacctcccacacctcccgcgctgcgatgaaagctgctgtataggcctgccgtggcctccgcagagtgatgagcgctcgtataacaccctgaccgcacatctgaccatgtgctcggcgaggttctatgtgggagatctagcaaggaaccattcgtattcctgagaggtacctcagtggcacggcaagactgagagagtggatccgagcagggatgcctccgacgatccatggctagcgtatgcgatcctccgagatttacaagcgatacacgaccacttctgagcctagggaccaagtctctcaggagactcttgacacagggcaacgtgtcatccgcttccgcgatctgtcctgagatattctacccactttttccctagtgcattgattgagaacccaggggttccttcacgcctaagaaacgactctcgtaggacaagcaacaaacacatccgccatttactgattaggctaaattgagtacgacgaagaggtcattacggccgctaagtcgatcgtatctcccaggtcggtgttaccctctgtgtgaattctggtagccaatacagcacacaattgtcggtattcaaaccagccactatgggcctagagacgaggatttgtcccaccacccgaagatgagtacacgtagagtgagagagaatcgagattcttgctagtggtttgacaacaagtagggggtacttagcaacggagccttaggtttccacaaagcaatctttgtggcggcatttgacccaaatagataagtcaatttccatagtggggttggtcaaatattccatatcagtggtgcatcccagtgaaatttccagcacagcattttgggaccttacctattccaaaagaaaggaaacgcattggacaagacgcactgcccattagggatcccatcctgaggaagtggtgtttgacccatcctccccgaagttgggtgcacctgcgtctatccaacgaagaaactgcgtgtgcagttccacaaaaaaggctatgcacagaaagagttgtattcacggttcgaaataccctttgtattaacgatcacgtgcacacgaccgtggatagagcatttaggagtaaaagggcactaagcaatcgcaccaatgtaatagtggagaccatccataggtccagtgcgaaacgtagtaaagaccctttgcggggacagattattatccaccaatgcgcacacgactaaacactctacgtgtggcgcaaccagatctatccaatgcgggccccatattagatgctagccttgataggttcattcaccatttcaatgggcccatcgcaggtggtgagccccattagtgccatgtaactcgttcgcactccaatatatcccgccattgtggtattaccgcatattgagaatgggacattgaagcgtgacagatcc

SEQ ID NO: 720817 - DNA, 327 bp, Homo sapiens
aaattaccaaaatttgggggtgaagcctaaagggcttgctttttgccccttggcccaaaaaaaaaaaccatttgccttttttaagcagccagggggttttattatttttccccaaaaacgctcctttttgggaaaaaccaacgggttttttaaaaaaacccggtttttccccaaacccccttaaagggttttaaaatgtttcaaatccgggccaggtgagatttttaaaaacctccttttttatttgtaaaaaaaggttccccctttattttttcaaaaaagtcccccaacccccagcccccgttaataaaggtttttaatttttta

SEQ ID NO: 720818 - DNA, 398 bp, Homo sapiens
tcatcgacgaggagtggagctggagcggctcatgtggcggcggccggcggggaccgtgatctccggcgcacgggggagcatgcgcctcggggagcgggaccttctcctcatccgtggcggagacctgcgccacataggcggtggtggcaacattcccctgggagggatgaatctccatggggggtggcctaggccagggggccagcacggcggtggcagtgatctcctggccatcaatttgtcctccatccatgtgcttcagcgccttctcggcttcatctggattctcaaactctacgtacgcatcgcctttggacagatggggatgcatcctttccacgggcatgtcaatcattttaattttcccataggtggaaaatatctccatgatgtgatcg

SEQ ID NO: 720819 - DNA, 1039 bp, Homo sapiens
gttcttctcttctcgtttgttctttctctctgttcttcctgtttttgcttctttcttcctcttttgttctttttttgtcttttttttttcttggttggtttttttcttcttgttgttgcctttgcctccttctttctggtatttttgttttttcttctctttttttcatctcttgccttcatcagatcactgtgctgtttcgcctttctcccgtgtcttcgctcccctcttgtgcccgttgttgtttaacctccccttttttgaagcccttgccccgttgatttgtgtaaacattcaagacctgcgagcgctctgggagttagagtattatacttggaaaatcccgatttttgaaggaataataggtatcttgtgctttaataccttatgcacggattgtactataagccaatgaattaaaccgctatgtgaatcataaagaaaacttaaaatgaacccaagtgaaaggataacttcccgccagtatctttctattggaacccgttatttaaggaaatactagtgatttcttctaaataggatgttaaacttctttccaattactcttcctcagtcctgcctgcccagaactccagtgtaactgtgataaaatacacctttccccaggtatattggccaggtatgtgtgtaatctccagaataccccaggtgacatagatatgatatgcaccaactggtaatggtggattccatttcaccattgtttcaccacattctttatgcacccaggcccttaagggaaggtccagttttttaaaaaacccagtagtgtcttcctacctatctcccagataccatgtccaaaaaaagaaaggtgtttgtgcttcccttttgtttctgctccagtaattatagtccagccagtttgttcccagtgaccccttgagctgtgtatcccatttttgtttatttccaataaaaaataatttgtattatttgtcccttccatactatcccatccataccacactatcttctgtatcaggtagtctaatagaaaaatacctgttttgttcta

SEQ ID NO: 720820 - DNA, 1673 bp, Homo sapiens
  misc_feature (1)..(1): n is a, c, g, or t
  misc_feature (92)..(92): n is a, c, g, or t
  misc_feature (1069)..(1069): n is a, c, g, or t
  misc_feature (1236)..(1236): n is a, c, g, or t
ntctctgagcatatatattttcataatgtttacattaccatgcgttgcttcttcttgtctccacgtagagtgttgggttctcgtctggtgtnttgggctagcctttgttgtttggtgtgttgatcggttggtacacgttcttttgcttgtcatgtgtcttcctctcggtggtactcttgttcattctcctgttgttgtggtaggctctttttttctactattggttcaattttgatatcccgctgctcctcgtcctttccgccgtggtttttccaacacaacgtggggggtatttgtggccatctgtctccgtggtgcccctgtgtgggcactccggtggttttctagcacccgctcggtttgttggggtgccacaccgtcgggtcatccaagtacagtccgtgtttgactcctcggggtgagttgaatgattcttgtgttcgggtgaatgcgcctcgtctctgtgacgcgcttgttgtgaatgagaacgttctttgtccgctggggggaaccacaaatgatggggcgcttcccaaaaatgtgccagaagagaatagtgtggtctgtgtccaaaagagggaaatgtttctgtttctggttgcgcgaaaaacacatttcttgtgggttggtacctccgcctctgagtaagtggtgctgcccgcaccccaaactgggggaagctaagtcttggtgcttttctatactgtggcttccacaggggttgagtttattctccttgggacccaattctccagggcgcccaaatattatggcgcgccccggcgttagttgtcccccccctggttaattttggggagttggcgcacaaccccgcggcggtctaacccaatttggcatatggccagattgtttggcgtggagagcttgtagaagcgagacaaaagagttttgagtgtcccccgctgtttcttgggtataaataacgcgctgggagatagagatgggccccctctgaaatgtgtctctgagagagtgctcggtgtgaatgactcgccccactctggtctagaataatggtctttctcttgggccacaaggccccacatgntgctgtttgaagaggactgttctcacagagctatatctcaccctctgtgggggtacgcgcttgtgtctcgtttctctgtgaatatatgtagggaccacagacacacacgttgtacgcggtgtgggtggttcacatccagaagccacgcggggaccacaagaagaggnctcgcttggagagactggccaaaggtgcaccccaagttctgccccacgaaaggctccacgagaagggctataatgagatatttatttcccttaatagcctcgccacaccgccacctgtcttaaatccacgctggttggaaagagaccggtgtctccacgagacctcgtgttgtgttcacaattggccacatttaaagtttaagtatgtataacagagactgggtataatgagtaaccacaatgcactcgtataaccgtctcacgagaaggaaaaggaggaaatgttttgtggagccacctttggttttcttttttgcgtgtgcgcagttttaagttattagtttttaaaatccagtgactttttacacatggagaaccacattgagccccaaaatgttgtcaccagaattttgagaccccatttaaaaagtttaatg

SEQ ID NO: 720821 - DNA, 223 bp, Homo sapiens
gggagggagggaggccgcgggagctggaagtgctggcggaagctgtgtcacagcgcgcccctgcgcccaccacccagacaagagagatctaagtcaggcgttgggcaggagatggagctgaggcaggagactcgcttgggcccaggaggccgaggttgcggtgagccgagatcgggccattgcactccagcctgggcaacaagagcgaaactctgtctcaaag

SEQ ID NO: 720822 - DNA, 272 bp, Homo sapiens
tgctattattagaacactgacaaacattcttagagctaaaatctttgcacacatccatgtttacaaacttagagtaaatccatagaaatagagttactaggacaaagatcatgcaaaatgataaggcatattggcaaatcactctccagaaaggctgctccagttcattcttccaccaatagtacatcacagtgtttgttccttgaatccctgtcaaccctatacaatgtaaattaagaaaacaaatttaaaccaatttaatcaggtcgacg

SEQ ID NO: 720823 - DNA, 107 bp, Homo sapiens
  misc_feature (32)..(32): n is a, c, g, or t
  misc_feature (73)..(73): n is a, c, g, or t
  misc_feature (75)..(75): n is a, c, g, or t
  misc_feature (100)..(100): n is a, c, g, or t
ggcacaaaggccagaccgtaaaggcccgtgtngcgttttcatagctcgcccctacagatacaaaatgcctaananaggtggcaaccgcgactttaaatcnagcgttc

SEQ ID NO: 720824 - DNA, 214 bp, Homo sapiens
actctagcaggatccccctcaaaccctgtcatcaaaccctaccctgtgtattacaatggatgcctctggtgagtggaatactaaatccaaaatactcttcaatagcagccaaagtggtatttctaaaaagttcctaaagaccccagtgctatgtggcacaaagaacaggaatgataaaagcagcacttgtctgaatcagtgagggtttcgatga

SEQ ID NO: 720825 - DNA, 438 bp, Homo sapiens
ccacatatgttggctgggtgaggtggctcatgcctataatccccagcatcctgagaggctgaggcaggaggatctcatgaagcctggagtttgagatcagccagggcaacacagtgagattttgtctctacaaaattttccatgtgtttgtgtgtcaaacagggtcttgctatgttgcccaggctggtctcgacctgctgggctcaagcaatcctcctgcctcagcctcccaaagtgccgggattataggcgtgagccaacatgccccgtctctacaaaaaaattctaaaaatcagccaggcatggttgcttgtacctgcagtcccagctacccggaaacctgagacgggagaatcactcaagcccaggaattcgaggctgcagtgagcaatgactgtgccactgcacttcagcctgggtaacagaggggacttcatt

SEQ ID NO: 720826 - DNA, 1133 bp, Homo sapiens
agcgggccgagacagctgcacgcaactagtggctccggatctcttcagtctttgcggtgtagcccgagtctgtggtcagcaccgggatgagctcgagctagccactggtctgaagcctccagtagctgaaggcgcggcgtgcactgccgtatcagtatcaagatcccagcgagcatgatactgcagtgcattgtgaatgacatcacttccgtgggagcatcatgtgctcggtctggacattgattcatgcgacctcgatcgactacgtgccgtgaacacttggcgatcactcatgtagccatttggctccatgcttcgccgaatcagtggatgacagtatcgaacggacagatgatttaaggtcgtgagaacgtgaattgtcgagcgtcgatcatagaagcgttctcgtcagtgtgaactcagtgcacggtaccaatgcaggataatctaacttcaaatgaactcgttggcagcaccagacacgacgcgaataggcgatagtgactttacttgatccacgcagttctcttcgtacgcagggcaacctcgattagctgtagcgcatcgtaatgaaccacgtgaaaaagagacctctagatgattccccggaatctcgtgggacatcgatcacacggggggccatggccagcggacaaccgtgaacaggaacgtgattgcgaacgcatagcacaccgtaccaccggcggtagcgcgaacattcattcctaatcagattcaaccttacgttagtggaattataagtgcgcataacgaatggccacccattgcgttgttcggcaccgtaggcaaggcatttccttgttgggacattgtgcaccttagcgaaagaagctgtggacttccattggcggaacctgcttgtgtcttggacgacggattgctggaccaaccgccagcgtccaatacgtacccgggttggcgtcgttggagtcgcgaggcctcataatttgccagtcaatcgcaaagcggttggtaaaggtcgcatgcacagcatgggttcgcctctggtaacatacacaccgtatgtgcctggaactcggacggctgttgggacgaccaacgaatggaatgcgcaatccagttggtgtgtcgccccggcgcacagtacacgc

SEQ ID NO: 720827 - DNA, 187 bp, Homo sapiens
cacaacaccccagtcaacccactcgactgcagacaccactggccaagccaaacccaagatttctcaagcattcttcagccaaccctgctctccttatggacctcagcttaatcacattggtcttagcttcaaatgggcacaccacagacagcacttctggaccatgacagtcctccgtgattccttg

SEQ ID NO: 720828 - DNA, 1193 bp, Homo sapiens
cggcagctctgctggtgcgtgggtccggcgagcccgggatctgagtctacctgtcggccgagtcgccgccggtcaccgcctgcaccgcctttccgtccgtcctcctgcgacggtgggcagtccctgcgtgtctcctctctcagacgcacggaccctgcgtgaccacggacgccgtctgtcgtgtccaggcatcttctcgagaaagaccacaaggttgctcgactgaatcgggcctgttcctaacacgctcatagcctccgacgtgggcacgagtattgactcgaggtacgctctatccgttgtctagaataataaagcacgctaggtcgtcgtaagtgaagctgacgcttcgaagctagtgccgttaatagagaagcttcgagcacgtgtgcagtagtcacccatgcgcttcggctgcgaaagtgtgacagtaacgcctgacgtgaagccttgactcaatcgtatacgggtagaccgttgcatggcctcccaatataatccaggttgggatgcagcatgggttataatttgagcctgggatacctcactcttcatgggggacgacatttattgagaccgcccttaatacaagcgactaaacatgtacttggacatgttccccccgaatccggtggcataattatgccggtggcgttgacaataaccctaatgaattgcctggataactgccctttgggcctttgaccccgtgtaccaatgtgtgttgtcctgttactcctatacatgggagagttccatgcgagttgtccatgtggagagcccattactttgagttaaaccacaccatttggagtggccattatcggttggacagtaagggccttccaaatataacccgttaagcacagctttcgcggccgttccccttttgcccgaccattcctatggaccccaaacttatggtcccccgggggaacacaattattccacatttggggatttacggcgcgctgtaaacacggaagaagactttggcccttatatgtcgcttaccacagtagtggccttacctcagcgaaatgggggaagccgccttatcaaagcgccccccgttaggagagcgccacagtgcgccttttgcaaataggagagaaagaaacctttaaagactgtgggccacacgtttaccccttgggagggggtttcaacatttaaacaccggaacacttagg

SEQ ID NO: 720829 - DNA, 972 bp, Homo sapiens
aactggggagtgatgaagatgatattgatgaagatgggccaagcacatcatttggcagcattctggctcaagccaggctgcacagcatggagcatgcatgcaagcattgggcaagcacagcatgcatagctgaagcagcactagctctggcacaggctcattcctaccaatccattgcatgcatgcacagcatcaacccgtggttgcatgcagtcatcgagcatcatttcaacagctcatctttcgaaacgtcattccaaaatcggtcaatccatgtagtggtcatcgagggcactgactacacggtacttaatgcaacggaaccacaaggacaaacacagagtacacgaggcactatcagacacactcgtgcgctagcatccaacaggacagcagccagcccaatgaaatcccaaaaatgcatctgagcaagccatggcaggcatcaccaacattacagtggctaccagtatgtagccaaagtatcttatcaacattatacgggcaggcccagacaaccagaggatgaattagacgttaatcctacttttctattacactggctagtggtgctatgtaagtggaaggaagcattggtgttatccatcctaagtacgtgggttccagaacactgggttcaatggttaactctagttcgtaagactacactaactcaagtacgattgggacaacaacgaacgcaacagaaagcccaaggcagactggggaccatggatccatgccaaactgggcactgggacccacgacaattaagcgaggaattatggggacggtgaggggaggcgatggggcaggtacctttaagagcggacgtattaaactctacattcgtacggaagcacagtaagattcctggacttctgaaagctatcaagtgacactgaggaaaatctggacacgaggggatgtcatgacgtgaggttagaactaacctgaggaaacttaggatgc

SEQ ID NO: 720830 - DNA, 195 bp, Homo sapiens
  misc_feature (1)..(1): n is a, c, g, or t
  misc_feature (5)..(5): n is a, c, g, or t
  misc_feature (104)..(104): n is a, c, g, or t
ncccngtgcgaaggataggagtatggtggggtgttgattgtggtaaactttaatagtgtaggaatctgaataatttatgaaccagaggggtcagggtttattcncaaagaacctattaccactaccaatctctattactatttttacaccaactatactatgttcaaccattaactattactaatcaactcccat

SEQ ID NO: 720831 - DNA, 394 bp, Homo sapiens
cagcagagaggaagggagaaataagaaatcaggactcggaggagactttgtcctgttgctgcaccccttaggtcatccaagagagctgcggaagtatctcccgagggtttctgaaagccccagaggaactggcagtggtgcgttgcaagtggtcagaagctggaggagttgaaggcagaggagccagataacttcagcagcaaagtagtgcagaggggccgagagttctttgacagccacgggaagtacctgtacagaatttgagtcggtgcttgcgcttatggagatgcctcgtgaaacacagctgggcgagtatttatgtgtattgaacaggctggatttctgcatatggattagccaccttggaataggaagaggtgttgagcctggactg

SEQ ID NO: 720832 - DNA, 228 bp, Homo sapiens
ggggggggaaaggggccgggaggggggggccgtcccgcccgtttttttttccctgggggccgccccccccgcccggggggttgggacccaatggggttaaacccggggggcttggaagagccccgggggtttttgttttggggcacccatacttttatttctttaaagtggttttttttgtaaaacttgcaaagatttagaacaatgccccccttgcccggaatttga

SEQ ID NO: 720833 - DNA, 197 bp, Homo sapiens
  misc_feature (34)..(34): n is a, c, g, or t
gtgctgggtatctaaggatccgtgggtgaggccnaccgtcatctatctacatcttgcaggcacactcatcacagcgcaagctcgcacgattttactgagtagctaaataacatatagtttatcagttctaaccaaaaaaataacctcgtcacagaactgcatcagattctcagccacgttggctcagcacggtacga

SEQ ID NO: 720834 - DNA, 676 bp, Homo sapiens
tggaggggacggaaagaggggagtcggagatttggggcgagagggaaaggggtttacgaaaaggggcgttgtggcaggcgagaaggggtaaattgggcatgtaaagtttgttaaagaggtaggtgttggggaaaggtaaagagagggaggggatgtaaagagcaagaagtgaagtggttatggaaagtatttgtggtaaaaagaaaatgcgggaaaggataggggaataagtaaagataataagggaaaatgcaataattgcagaaagagagaatttgaaagagggggggtgaaagtttttttggaaaaaggtgttgtagaagttatttagggcaggttgaggaaataagagggttttgcattaaagagggagtaggaaggtgattgagtattggagaaagtttgaaaaaagaggtggaataaagtgaagaaaggaaacttaattgaggaagaggggtaaatagttggtgaaggagttaaaatggaatggggatagtttaggattatttgtattatgggggtgggccctgaggggaaggggattatcttcgaacatgaggagtggggatttggttttatttttttagggaggagaggattactttttaaaaaaaccgcctgcaattttgaataagaaacagagaaagaaaaaaagggtgtagggattaataaaaaa

SEQ ID NO: 720835 - DNA, 190 bp, Homo sapiens
tatcagtcagtcttctttcttatttgtttggccagtttagctaaagttttgtcaattttgtatgatcctattcaaagagccaactttaggtttagtatagtgttctctgttatatttctattctctagttcattagttaattaatgtaggttaattaattaattaaggtttgacgttgctttttttgttc

SEQ ID NO: 720836 - DNA, 254 bp, Homo sapiens
acgctcaacataacctggtgggggtattcgctcaacctacttcttccctaggtcaaagccactatcatctgatgtgtaagggatgggtcctgattggcagaaattaatcagctcccaatggggacaacggaactaagtagggtcccaagaaaaaaaacgggagctattctcacagagctgagtttctgccaaatttcattcctcaaacctttagtaggagggttaatttgggcgggtaccgaggctcgaaattc

SEQ ID NO: 720837 - DNA, 96 bp, Homo sapiens
  misc_feature (12)..(12): n is a, c, g, or t
attcggcacganggagaagaggaaacacaagaagaaacgcccggtccacctagacccccacgtttggagattcaaaacttctgtcttcgtcctctc

SEQ ID NO: 720838 - DNA, 902 bp, Homo sapiens
cggagtagccgggcacctgtaattccagctacttgggaggctgaggtgggagaatctcttgaacctggggggctgctgtgagccgagatagttccattgcgcttcagcctgggtgacagagtaagactctgtctcaaaaaaaaaaaaaaaaaaaaaaaacccatccctggacaattcaaacagtttcccgggaaattctggcccagggggcttaccaatttggagacccattgggttcgtggttagcattccccttttcatttaattattaccttactccattcacttccttctctaatatttttagcaagtttcacttagttagcaagttggttttgccgggagctcacgtggaggacctttatttaaaaatgtgcgggctctcgtgaatccaggggagccgtggggtgtgggggcccttgagaagttcgtgcatttctcctcccagggcctccctgggtttgctgccaggtggttgcttgcctctgagttaccaaggggggttggggaatgtgatgtattggaccccgtccatttatttactcccattcgtgacaaattgagttcacagaggccctttagggataacttggagggggggacccagggctcgtgattctctgataaggctggtgttttctcagcgccacaacattttacttggcaactgtgggaggtagcggtaaccttaatagaaggtccctttataacctttgctggggagagggtttgaattgaggctcttaagaagtaagggggctccggaaacccccgggtaccgggcccattgggcctgttcgggaaccagggccacccgcagcagggatgtttgacacggggggggggtagagcatagcagaaggctaccatcgtgtatgttgtaccaggcaattcccccaatg

SEQ ID NO: 720839 - DNA, 158 bp, Homo sapiens
tataactaggaacagtagcaccctggccttcaggtacctgtttcccccaactgttcccatcctgaaccagcaagtatgtgcccaattctactgcatagtcctggccctgactcagatttccacatgcagactgtccagcaccactccacccccagact

SEQ ID NO: 720840 - DNA, 873 bp, Homo sapiens
acttcaattagaccgtctaaggtgatctccgtgtctagccatgtcattgcacttccactccctaacgctcctcatactaggcctactaagccaacacacgtagaccatataccaatgatgttgcgcgatgtaacacgagcaaagcaccataccaacggccaccacacaccacctgtccaaaaaggccttcgatacgggataatcctatatattaccctccagtaagctttatttcttcgcaggactttttctgaggccgtttctacacacgtccagcctagcaccctacccacgccaacttaggagggcacatggtgccaccaacaggcatcaccccgacgtaagatcgccctagaaggtcccagcgtcctaaacacatccgtatgactcgcagtcgaggagtagtccaactcaagcctgagctcaccataggtctactagacagagcaaccgaagaccaaataattcaagcacgttgcatattacaattatactgggtctctattgtgaccctcgctacaagccgtcagcagctacttcgagtctcccgttcaccatagtccagacggcactctacggactccagcattcataagtagccacaggctgtacacggaacttcacgtacattagttggctcaacttccctcactatcctgcggtcacccgccgaactattacttcactgatccatccaacgcatcgactttgcgtccgaaggccccgactgagtactgccattttgtacatgtggatacgacctatgactgtatgtctcctactatgtgcggtctcaaagcactgacaccccccgagtaccaaaaccaaagaggagcaaaacacgcgaaacataggacacacaccaaggacaca

SEQ ID NO: 720841 - DNA, 266 bp, Homo sapiens
tgactctatgcaatcaccgtttcagccttccaaagtgttgggattacaggcgtgagccaccatgcccggccaattttttggtattttttgtacgagacggggttagctatattgcggtgctggtcttgaacccctgggctcaaacaatttacccatctcttcctccccaaatagctgggaggtgtgagtcactgtgcctggcccagattgctatatagccttgacttgtgaaggtctgttccccctttggcttaatctgatttggt

SEQ ID NO: 720842 - DNA, 1002 bp, Homo sapiens
gaaacaaggtcaggaaggagtggcccatgaagctggaggaatatcaggcagtgtggcattctgcaagccaagtgaagaaactcttccaaaaaaaaaaaaaaaaaaaaaaaaaaaaaattgttggggcgccgcttcggcctcgggaaaaggtttttgacgaccattcgtgggggggggggcgccccataggttagggcgacgtggccacaagggggtgccaaggaagacccgggccgaggaaacaggcgctggggttctcccccaattaaaaaaagcgcgcgggggacaccggggcggtctcggacacaatcccagagaggagtcccgaaggcacaacggggtctctcacccggggctccacgaggggggctcggatattaaatttacgccccggcggcgtggataccacacgcaagacacacgagacagataagagacaagcaagcaggacacagaatggagaagcagcaacgaagagaagcagagacagtaggagacaacacagaacaaaccacgagacagcgaagacaacgaagacaaagtagcagaagatagaacagaacgaacacgacacgccaagcagacgaatacgtgaaacacagagtagcaaggtagagacatcataaaatcaggcagaaaccaaaaagaggaaggaaagcgaggagaagaggaggagggaagagagaggaaaacagaaacgaaaggacgcacaggcagcaggacaacacacaacaacgacgaaggcaaggacaagaaccgacacagggagaaaaaacacacagacggaccacaagaagaagaagacgaggtacggcaacaggaaaagcaaaaaaggagaaagaaaagaagacgaagaaaagaggcacaacgagagggagaaaagaggacaagaacaggaagaagacagcgagacaacaccaggagagaaacaacagacgagaaaagaagcacgaaaaagagagagacaggagacagaacaaggaaagaagaaaagagagaagg

SEQ ID NO: 720843 - DNA, 931 bp, Homo sapiens
tcctttaatgacaattgcccaggggaaccggggtgtggaaagggaggagctctatcactaggcccttttgtggagtgggaggggcctggaaaaaagggaccagtgcccaggctagaggtaagatatggccaatctctaagctgctgggagatgcttgtttacccacaacccttggtgccattccccgctccaggggaggatgctacaagggcaaggggctgaaaccatcaagggcgagtgggcaaggctgggtgtgaggaagaaacagaagcgtgggcggttgagggacacagcgtgggtggtaaccactagtgggctattcccattctagtaccaagagtggcaggtgggcatcggagccaataacaaggatcccagaagtcaggcaaccgctgagaaacacctcccatgcggggcatcatcgagggaatcaagggaccacgtggcaccaggccagaagtgccccgaacacggtgctacgcccaatattaccccattacgtgcctcccagagggtgggggaaacacaagagtgtggggccaagaggaaagagcaaaagggcccaacaaacttagccagcctcgtatacaaccaatggggcgagcctaaagggcgccaaagaccacaaaagcaaggggagaatctcgaagaacgccccaagaagggggcacacacaaacaagttactcacaggtgaaaaggaaaacgtgggggatcccaaggcaaataacaaggtggacctcccaaaattggataacacacacagagacacaaacgggcgttttgacacacaaacaagggaaataccccccgccatacaatggggcaagacagaatcacaaaaattcgaggggcgccccctgtgaccgtggggaaaaagggacaggaggatcaagggacccaagggtaagcgaccaggactacctcctagc

SEQ ID NO: 720844 - DNA, 853 bp, Homo sapiens
  misc_feature (315)..(315): n is a, c, g, or t
gggagctgaaaaccaacgtgttcggtgacagaccccagcgccgactgagcctctaaagcgacttcagctctgccccaccaacaccacctgcgctgccctgggaacagcctgctccgggaagaaacctgatggggactgcggggggcacgagggacagctgagggaagggaggacgcgagagaaacagctgctgatgcactgctgacgggcctgggggttgccatgtgacgaggtggcccgctgtgaccctgcatgagcggggagtgaacggtccgggagaacaacggggctgggacgtgaggacgaatccgggantcgcctggcacgaaaacacgacgaacgggacgtttctgaactcctgggacacgacggaggcgtgggtacgggaccgcttagcccgagactccgaccagcacggggaaccggagcgctccgaggcgcgcaggggcttaatgctgcggcgaagggcatgtcttaacaacgcaggaagcaagcttttaaattcacgacgatcgcgcgcaaggctgaacgggcaattgcttatgaaacgcggcgacgcgcgagcctggaacgtgtaacgcacggtcacctcacttctagaaccacgctagcaatccggcgaaaatgccggtccgacagcaaacttcccactttccataccttccactcctggtcatcccatcttcccaacatttacaaacccatcccaatattctccattacatcacaaaacagctataaaacacgcgcactctcccaaacgtatttgcccaccagactcaccactgcataccttacctccacactaaaataaactcacttcttacatcccgaccacacacagaaaacacac

SEQ ID NO: 720845 - DNA, 739 bp, Homo sapiens
taagggacagtgtcattcaagaatgtgtgcagtttctagagcactgtgaactttatggtagaaacattccagctgttatagaacagcccttggaggaagaaagaatgcacactgggaagaatacagtcacatatgaatcaagaaagttgagggctctgatttatgagataattggatggaatgtgtaattaccgctgacaatttgtatcatgatgactttctatgtacattttcagtttttcctgtatctagcttttgctatttgtatttgctacttgtgagactttgtacactttagtgtaacaaaagcactattcgatataacctgcacttttaaatcctgtcaagtgagattgtgtaagaacccaggccctagaaagtactttggaacttttaaaactgagaaagatgttgtttctatcatgttttctccatttttgtttggttttgatgtatcttggacaacctttgctattatgttatccagggaccagacactaagttcagaacttagtcgtccataacgtcttcttgtaatcactccaacgactgtgttttctctttgcacaactccccatgattttatagagaatttagagtgtttgacagttttccaatacagatataataatttgtacagattaaatttcttaggtaataattggttttgctagttttcaagattcagtaaattcacttaataaacactaataaataaataatcactaataaataatga

SEQ ID NO: 720846 - DNA, 192 bp, Homo sapiens
ttacccggaaaacttgcccccccccaaatccccccccttttgggaaaaacaaagggttaaaccgggggagcccgccggcccctttaatgggttaaacagttcccccccctttgagcggggggggagggaagggcctttaaattgtgggtgggaattttgggccccccaataaaaaccggtttttccccccca

SEQ ID NO: 720847 - DNA, 403 bp, Homo sapiens
attcacatagtggtgcaactatcatcaccatccacgtccagaattttttcatcaacccatggtgaaacgcctgtaaccagaaacatctccctattccctccacctccagcctctagccaccaccattcgctttttgtctctgtgaatttgcctactccgggtatctcatataagtggaatcacacagtattgtgttttgtctataaagcgactggcttattccacttagcataatgtcctcaaggtgtgttcacccatgtagtagcatgtggcaggattaccttccttttcaaggtagaataatcactgtatgtctatgccacattgaacggacatagcagttgattctacctcttggttactgttagatgttgttgtcatttcgttgggttttgttgttgtt

SEQ ID NO: 720848 - DNA, 321 bp, Homo sapiens
cacgaggtcgagctcgaacgtctcgccgttctcgttcagcgcgcgcacgcgcacacggtcggggcgctcgacgcgatcgtagacctcggggaccgacaggcagccctcttcccagaccttgcgggtgtcgctggcccagacgatctcgggattgatgaagacgcgcagcccgtcgcgggtctccgatatgtcgatcacgatgacctgctcatgcacgtcgacctgggtcgccgccatgccgatgccgggggcttcgtacatgggttccgccatgtccttgaccagctgttgtatgcggtcgtccacctgcgcgatggtctt

SEQ ID NO: 720849 - DNA, 459 bp, Homo sapiens
caggcactcatttatattgctctgaaagagctttccaaagtatttaaaaataaaaacaagttttcttacactcaaaaaaaaaaaaaaaaaaaaaagagaaaaaaaacattgtgtgtgggcgggcctctggggcccctgggagaagagactttttaaaacacattgcggtgtggggcggcgcggggcccaagagagaggggaaaggtggaacagatggggcccaaagaggggttccccaaggagaaaacacgggggcaagagagaaaaggggggggggattctctctcacaccaaaataaaaaagagccgggggggaaaccgggaggggttctgggacaaaattcccagaagtagggattctccgggaggcgccatatccgggggactctttcttaacaagagggagctcccaaagggagagcccgaaaattcaaaattagcgccccggttatgggggag

SEQ ID NO: 720850 - DNA, 287 bp, Homo sapiens
  misc_feature (219)..(219): n is a, c, g, or t
tcaggtagcacagtcagcaggttcaaggcagggtgcatggtggctcatgatggtggggcatgcatgcaggctcattgttttagtgaattcttcgataatggccccatttgggcacaaaagccgtgttcagcgggggccaggcctctctagggcacaggcagggtggcatggcaattcaaggtgtgttcagtccattgttagctatgtttcccaggtgcngcagcatcagtcagtcagggtccgtggtagctggcagtttcaagtttgcagtcagtcaggcacatgcg

SEQ ID NO: 720851 - DNA, 303 bp, Homo sapiens
gcaaatttggattttcccccaaattttgaatttgtagacaaacttggaggctcccttgccccaaaggcctcctttgtcctcatttttttttcccccccaagcagtttttttttacagccagtaaggcagctttgttgggggagcaaatggtccccttattttagggttttcctctttgtatgataaaaaaaatgtgttatgaatgggggctgtcagccctgctgtcagccctttttccccagcaaataaaatgtatgcccaaagcgggtagaattaaaaaaaagtaaaatgggtgttgaagca

SEQ ID NO: 720852 - DNA, 112 bp, Homo sapiens
tggacatgggagtcacctctatttctggcaaggacagtggtgctgagtgtctatgataagggtccgttttccctgggatctggggggaggcattctttcaggaccggttcag

SEQ ID NO: 720853 - DNA, 351 bp, Homo sapiens
attagagtagacagtagttcacttttaactgcatacttttgaattatagtcctaatagaagggtttagctaatatctcggaacagctatgcgaccctacatatcactcgatcttggccctcgtagatttatttcaaagtcctagctctttttccttcttacactgtttcagtattgcagactaagaaaacctctccctctgtcacactgagaattcccactgcagtgaatgggaggtccatgtattaaagcccacgtagagcagtggcggttcaagcccagagaaagaaggtgttgagttgccttggtaaagaatttttatccccatgtgttctcaggttcttgaccggta

SEQ ID NO: 720854 - DNA, 153 bp, Homo sapiens
  misc_feature (2)..(2): n is a, c, g, or t
  misc_feature (102)..(102): n is a, c, g, or t
  misc_feature (128)..(128): n is a, c, g, or t
gnatgacacaaaaaaatagtaataataagtattatcaataatagtaataaacgatgcaacataataaactatgggagagggctctgcaacatcctcctcccngaactgggtggggcacatttgtattncttagtttccaccattcattttcag

SEQ ID NO: 720855 - DNA, 1617 bp, Homo sapiens
ctcacgctgttcggtgcgcccgcgagtgaatcacagcagatgccgcacggtcgtggggtgttgtaggtagtgagtgctgcggagccgtgcgagaattcgtcgagcggtccctgcacggcgtccactcgatcgcgcgagtcacttgcaccggcacaggccgatcggatcaacgcagctagactcagccacaggctcggcctagaccaccagcgctagtactgcatatatgagacatcacaatggtgcaagaaatggttgtggggatagatgtcagactcgtcatatccatcgatgctgttcggccgctagagcgcaattcgtgtggccaggttgcctaataagccatagataccctgtagagatggcgagagcaagacaacgtggtgtgggatcgcatcgtcggcaagtgtatcgaaatggtgatggatagtaagtgtactagtgcacgcagagaccaggacagtcggttgcccatgtgccataatcatgatcgatatccaccgcaaagtggggattccttgcacggagaccacgaatcggtacgtgcatcgatggtacgggatggacactctggcgtatagcctcggtgaaccgagcagagtcgcgcaacataccgagtgaaaaattgctggaatgcaaagcgaagtgcctcgcacaattgggcctacctagcataggtcgtattctagcgcggaaggtcccccggaaatgggagctatctacatgcgcatgaggggagtgtgtcacccgcaactggagaattgtgcccttgggcgttgtggctgggaacgaggtggccgaatttgccaatgaaaacggcatcacatgaagagaggcggcagtaagagaagttaccgggtaaaacaatgcttcctagaaaccaggttggccacccctaggggaatacccaccggtggttccatttgtaaccatttacaaccctggagagcaagtgtgcagtacaaaacgtgggaacccatacctgggagtaaaggacgccacagcagtgggaagcgaacccggacacgatggataacaagggagaacgtgtaaaaaggaggacaccccaaccacatgacacgtggtgagcacaaccgcatccaaagagaggataacacgagaaaaagatggggggcacccatacaaatagggacagcgccgcggagagacacccgtggagagccaaaggacaaggacgaaccaccatgggccacggatgaaaacaccccagggtctaaatgaacacataaggagttggcaaatcccccaaagaagaggcaccacacaccaggatagcaatgacacaggaaaacaggcaccactcaccgagtagaaagggagcaacgaatacaaaagagaggagaacacagcaagaggagaacaactcagaacgagaaaccagcgaaagggcacaacgacgggaagcaagcaaaacacgcgatacggacggcaaaacacagcccgagagagatagtcgacatgagagagaacaccagccaaacaaaaggaggaccgaagacaagtatacaaagagagcctgaaccagccgacagaccgcccaccccaagatacaaagccgcgaagcggccacgagcagaaaggaagaaaaaaaacgga

SEQ ID NO: 720856 - DNA, 118 bp, Homo sapiens
ggctactgacaacttccgtaccccactgtcacactcttccttcgctctccctccacagaagcacaggatttaaagtgccagttctatgtaggtaaagacactgggattaattacattg

SEQ ID NO: 720857 - DNA, 339 bp, Homo sapiens
tcgagctcggtccccaagtttattagaaaaaaaagaaaaaaaaaaaaaaaatttagcggggccttgggggcacgcaccctgtagttcccagctactcgggaagctgaggcaggagaaatcgttggaacccagaaaggcgggggtgggaatgagccgagatcacgccacggcactccagccgggcgacagagctagactccatctcaaaaaccagaaaaccaaaaaaataaaatcaccaatcagcttatttggtaggggtgtccctcaggcttagcgtggtttgtcccctcttttttttttttgtacaattttttgggttttttggggtaaaaatggggt

SEQ ID NO: 720858 - DNA, 948 bp, Homo sapiens
tgcggagcgttcggcatgtaaagattgatcatcttcacgtgggctggtatcagtccacatactatggttcattccgttacccgggaactcctggactcttcaggtttagtttaccagcatgccatatgcaaggaatctgtcgattatcatttagtgatcccataaacaacatgtcccaagggatctctctcactagaggctatacggacgtgacttcttatactgagtggaagtgtgtaaatgaaataggattatttcccgcatggaagtcattgataagaagtaaatatcaatactttgatgatacaatgtttgtagatgaagatgtacgcattgtaattaaaagattcacatttgatcaattgtcctaaatgtgggaacttgaaaagaagtcagtctgttgctagatgaaacaagtgaatatgcatctagatctatgtccgagcaggcaattcatttggggaagtaatcttacagttgcctgatggactgagtggatgaaatgggccaagatatagttacattttgggacaacatacatgagtgaatactagtgatacaatcagcagtagaaacatcagtgatcgagctagcgtcgcacgatgtgggagaatgatgccatggcgcccagatgctctgagggatgaaacccccggtccctgcagtgagcgaccctgtccctagactcggttcaaaccactcatcaagcccgttctgcctagtggagttggatcttcagcttgctcattatgcaggccgagataaattcacttacttgccagaaaacatcaaggagttcactggccaaaactttagggcaagctcttcatgggccagggtcctttcacgaatacaacaacttcagaaaaagggaagttcccgcaaaaaggaagttaaccattgaactctttgaactcacacccagggcgactctttggaagaaatttt

SEQ ID NO: 720859 - DNA, 175 bp, Homo sapiens
gataaggaccgctggcaatcgacagattcaaggcgagcgtcgacctggagttacccgccctgcaagaagatcgagagtgctctggaggaggtggaacacgcgagaaccaggggcttaaggtctcccggcgggaaatggagggcgcatgtggagtcacacctataaggacctccat

SEQ ID NO: 720860 - DNA, 1099 bp, Homo sapiens
ggtttccggtggcagggtctggggaagcggcggaggcgcatgtccggccgcgaaggtggcaagaagaagccactgaaacagcccaagaagcaggccaaggagatggacgaaaaaaaaaaaaaaaaaaaaaaaaaaaaaatgggggggggcctggccgaaaagagttttctaagacccttccgctgtggggggccgcggcgggccccttttagttacgttgaaatctgggccctaagagctcgtgtcgccaagaggaaggatgctgggtcatatgcattagagtgcttgggtttcttccaccaattaaaaaaccgcccgcggggcacaccggagctgcgttcggaacaaattcccagatagggagtcccggaggccaatcacgggcttcctatcacgggagttcccagagacgaagcactcgatataaattacgcgccccggccggggtcaggcaaagaagaaagaagggggaagaacacaataaaaggagcatctggccagcaagtgagcgagcaacacaacaaagcagaggcaagaagagaagctaaaaaacggcaaggcaggactaacagacaccgtcagagacgaggggggcaataacaaattccgcacgtacggaaaaaaacggggaggcacaaacaacgtagcaacgcactgcgacccggtaaagcgacaaaacacagggaaaacacatacacaagaagaatggggaggaacaaacaaaaagaatctcaacacaaaacccccacgcgaaacccggccagacacaccagaacaggcaacaaaccgggtaaatattgacgtaaaccagcagcgcgaacaaggagggagatcaacaaccaagagagagaacgtgcaaagttcgcataggaaacgggggaaaagggaagaacagcccaagacgaaagagacgcttcatggcaacaaaaccgaagagaagcacagcgacgaaatgaaaaaccgccgaacacgtggaatcgatagctaaaggcgaaacacaaaagcggaaaagaacgacaaggaagaacagagtaccgaccgacacatcgaacaggacagccaccaacacagagataagcagcaacaacatagacgacag

SEQ ID NO: 720861 - DNA, 101 bp, Homo sapiens
aaaacaagcaaacaaaaaaacacaaaaaaacctgagaaaatctgctgccagcgagatgtgcatacacaacaaaatactaaacgggaacttcttcacggtag

SEQ ID NO: 720862 - DNA, 159 bp, Homo sapiens
ttgttttaaaggaaacaggttttcgatgtgggtgggattacacgcacgcgagccgatctatgcactgggtaaatatgttgtatttttggtagaggtggagtttcaccagtgttagccagactggtatcaaactgtacctcaagtgattgttccccgcct

SEQ ID NO: 720863 - DNA, 876 bp, Homo sapiens
  misc_feature (133)..(133): n is a, c, g, or t
ggtttccggtggcagggtctggggaagcggcggaggcgcatgtccggccgcgaaggtggcaagaagaagccactgaaacagcccaagaagcaggccaaggagatggacgaggaagataaggctttcaagcaanaaaaaaaagagaggagcagaagaaagtcgaggagctaaaagcgagaggcgggggaaggggcccttgggcacaggtggaattaatgaaatctggcaaaaagtaagctgttccttgtgctgaggagatggtgaccctttatttcatctgtatttaaactctctattccctgccataacatcttttgccacgtatagctggaattaagtgtggtctgtggagctgtgtgtacaatttaagaataaacttgtgtaccccagaagaccactcttacagtggctcatcatctctttagttttgtgtttcactaaagtcgttcctaccataactgtgaacttacaagtaacaaccagtcaagaatcttgccagagtctgtgccttgtggtccttgttctaccctaaagttgtgtatcacctgaaattagaccaactcattttgcaagaatacagataagacttgtacaagaaggcaaactttgcgtggcggcgtcgaccttagaaagaattctcgacaaccctcgtgttggcggcggacgccaccatgtagtgagagcccggcgaagactggggcgaggagacccgcggccagaataaggggggggtgccccagaaaaaaaagccccgggggaccgaggttcgaacaatcacgatgagcgtcggggctactgggttaacaagagcagcagccgttagccggcccggtgagaacgcacacaaaaacggcacaaacacacaacacaagagaa

SEQ ID NO: 720864 - DNA, 116 bp, Homo sapiens
tcacaatagcaggcgcagcagggtagccagtggcaacacagtcctggccatgcttgtgcatgccatgggcacatggtgcccagcgcggcagggcagcaggcataccacaggcacac

SEQ ID NO: 720865 - DNA, 102 bp, Homo sapiens
gatctccagcggagatgtacggggcaagtaccagaccacccttcttccgtcccctctacttagctcctctttggccttgggccatatgactttcaacggggc

SEQ ID NO: 720866 - DNA, 375 bp, Homo sapiens
gggcgagatacatcctacatcacgtgaagatgatgtggtctacagaccaggagacggtgtgtatatcgagagtgggaggccaaacacacggtatttcatctgtagcattcaagacttcaaacggtgaaatacctgaaaaagaaagaagaaaaaaaacatgatggcatcaaaaatatgaaaaacaaggaggggcaagatcggtacatggaaaaactatggaaaatattaaggacacaaattaaagaagatacaaataacgggaaagatatcatgtgttcaggggtgggaagaattagtattattaaaatgcccataatacctaaagatatctgcagattcagtgcaaactctattaaaattctcaagacatttcaa

SEQ ID NO: 720867 - DNA, 148 bp, Homo sapiens
tattttgactgcagagccatgtacattggagcccgttcccatcagatttacttacttggagagacatatgtctgaatatatggagtgtaattaaatgaactagaatacatagtctgcgtgccttaagagagacgctatctgcagaaca

SEQ ID NO: 720868 - DNA, 1014 bp, Homo sapiens
gtctcttcataattgaccccaatggagtcatcaacgccattctgagcgctcaacgactctcccagcctgggccgaagccgtggcaacgaaaccctccgctatggctgaaggcgttccagatatgtagaacacacatggcagcaacgtctgcccagcgcaactggcacaccgcgcacttctccctacgactcaacgccacagctccacgcctgccttccacaacgagctacctcttcacgcaaggctcaacactcacgctagcactcaccccactgctgctatactgcacgcttcgtcaagcgtgtagagaaacgaacccgacgacgctccgcacacactcctgccctctcctcattcaactcttctctcaaacgcactgcgctctaactctcagctacgcaacagtgcacaggtaaaccaaagttagtgcaatttgcctctttttcaacttaccaccgctaactatcacctccttcacacccctgcttccccggctctctcctggccaccacctcccctgcgccctcacccccaccccctctccctacacacccacctgcgcccctccgcccctgccctacgcctatccacccgcgccacccttccccctctcctacctccggccgccaacaccccactcccctccgcccctcgcgcgccctctgcctcccttaccgcgcccttccgccgctccttcctagccccgcctccaccccacccgcacccctcccaacccctactctctacactcgggcactccccttccccttaagctctaccgccaccatcgcgggcaccataaacttccgccgcccgctcctccgccgcagcacgtctccctcaactcccgggggcccctctcccctctccccccgccgcgcaccgcccctccgccgctcgccctccaactcaccccgcccgccccgccgttcgccccctcttctcctccccctttactcgttctcctcccccctcctttctcctgtccctcccctcccccctcgctccccgctt

SEQ ID NO: 720869 - DNA, 334 bp, Homo sapiens
  misc_feature (258)..(258): n is a, c, g, or t
agtgaatggctggggaagctgaggaaacttcctattatcattattttttggagacagtctcactctgttacacagggctgaagtgcagggcacaatctggctcactgtaacctccatctgtcaggttcaatcgattctcctacctcagcttcccgaacagctgagattacaggtgtgcgccacccgcccggctaatttttgttttttcagtagagacaggtttcgccatgttggccagactggtcttgaactcctganctcaagtgatctgcccgcgtaggtctctcacagtgctgggattacaggtgtgagccattgcactccggccgggtac

SEQ ID NO: 720870 - DNA, 162 bp, Homo sapiens
ttttggattaaggctgggggatccaaaaaaaaccaaatggccaggaggttaaaaagccggggaagggccggaaggaggaaacctaggaggaaaatcatggctaaaggaggaatctgaccttggattgtattggaattaatctaataaatcatccataggatc

SEQ ID NO: 720871 - DNA, 278 bp, Homo sapiens
ggtttaaggaaggtttaccctggctcaagttggaggttttgattaatctctcggattgtactttctatgactgaatttggagtttgtttttgagggtggacctgcttatagcctaagaatacactgaacagttacagggcctgccatggctgtatgtggtggcaggagaaaaatctctctcaatgaataaaatttacaaggagtagaaggaaatacaaaccaaagctttgttttgatcatgtcacttgtcttcttgtcccacaaaccaggtaccagtg

SEQ ID NO: 720872 - DNA, 448 bp, Homo sapiens
  misc_feature (15)..(15): n is a, c, g, or t
  misc_feature (78)..(78): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (106)..(106): n is a, c, g, or t
  misc_feature (112)..(112): n is a, c, g, or t
  misc_feature (115)..(115): n is a, c, g, or t
  misc_feature (256)..(256): n is a, c, g, or t
gaaatggaaagattnattgggagtggtagggtggaaccatttgggggagatagaagtttgaagtgggaaaatggaagncanaantncgggnagncgaagnaaagantagagnagntagggaaattagaagataaaaacatacttttagaagaaaaaagataaatttaaacctgaaaagtaggaagcagaagaaaaaagacaagctaggaaacaaaaagctaagggcaaaatgtacaaacttagaagacaattggangatagaaacaagatagaaaatgaaaatattgtcaagagtttcagatagacatgaaaacaagctagacaagtattggagaagtatagaagctagaaaaatataacccttaacggatacatagcactgaaaaatgagcgaaattattggtaaccaatttatataaaaagcccatcaatttaatttctggtggtg

SEQ ID NO: 720873 - DNA, 104 bp, Homo sapiens
attaaagagaataaatcagtgaaggagaaagaagaggtacaaataaagcaacaaaacctaaagtttggttttttgaaaagattaataaaatcagtcttggccgt

SEQ ID NO: 720874 - DNA, 322 bp, Homo sapiens
accttctgtacaaatccacaaaactgaacaaacatgtaagaaagcacaaagcaacatgctttttcaacagtaaatattgactatacccctaaaatatctaccataatgacttacaactaaaactatggtctttggctatataaaagaaagtcaaaaattttgactttaatgactgcacattctaccagagccagtgtttacctggtatcttttgtcacctgttgttgacatttccctgctactgttggtgaaacagaattctacagtatccaattctgtatattgtctttcaaggtttgtcaatcagactcactactactgc

SEQ ID NO: 720875 - DNA, 1051 bp, Homo sapiens
ggtcacaatgcatgcattaccttttaaaagaatgcgatattgataccgatgcttacttttttttttttaaactactgggtttatattcctttccagaaaagttatagcccgccttttcatatagcatagtttctcttatagggtggaagtgattcctataagaatttctcattattaaatcagtgcattttctcaagaagtggaactcaaatattggattataatctaagcgtgatattcctcattgtggttagaagaacaacctacagtgctagaagagaagaggaggaaatatacccagcgaccacacagccgagttagctatccagtggggtgcgtggacttccgagccgagggtgttccgtggccctcaaggggtagcttaaaagtggacttttctagaaaagaggttacaatttttatcaaagaaaataattctatctaagtatatattccgtattaaaacatttttaagaggggtaaccgagcattagaaagagtggctctaattttgtctccaattttccaaagaggttaaaagggcttaaaggcatgtgggttaaagtataaatgggaaaggcgagttaactttcggggactttgagatatttgtggacaattttctgtgaaagtttagatctctaaaaccctccatttgggccacatacaatgtgtgtggctcctctccccttggggggacaatcacggggggacgcgcactatgagacgcggatttgtgggacaatatgtaagagcaagcctacgaaaggtggccctgcgggccttaagagcgccccgtgggggagaaacgccccgaagccgtactagacaaacagacgggccattaatatatgcggggacgtcggtcacgggagcaacaacgaagggaagacaaccttggggggcgcccaattgttgtgcggtaagagagcagtacacttcacttaacaagggggacgagaaagatggggtggacacagacaatgtgacgccccgagcagagacagacacactcactaacaagagaggggacacaaaacagagggcgcaa

SEQ ID NO: 720876 - DNA, 563 bp, Homo sapiens
gatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaa

SEQ ID NO: 720877 - DNA, 153 bp, Homo sapiens
tccatgcatgctcatggcgctccagctgaacagcaaggccagatgagggcagacatcgcatcagccgggatttatagcattattccaagcacctaacacggccaggcaggttataagtgctaaaacttttctttttttttttttttttttttt

SEQ ID NO: 720878 - DNA, 308 bp, Homo sapiens
aagctctgtacagccgtgtggggattgatgagtggccctgggccagatccctatcatcgccgaggtgctctcaggtcctggggaaccccaagagtgatgagaggaatgtgatggtgctggactttgagctctttctgcccatgctgcagacagtggccttgatcaaggaccagtggcacctatgagcgattatgtcgaagcgacttcgggtgtttgacaaggtcggaaattgcaccgtcgtgggtgctgaaatccggcatgttcttgtcacactgggtgataagatgacaggaaggtggctaggtgta

SEQ ID NO: 720879 - DNA, 206 bp, Homo sapiens
ttaggtggtttccaagtttctgctattacaaataatgctgtagtgaataatcttgtatatatgtaaagatattgatgtggaatttatgggtcaaggagtacatgaacttgaaattttgacagatatttccaaattgccctctctagaacatagaggttatattcccatgagcaatgtaatgtatataaactgagcctgaaaaaaaa

SEQ ID NO: 720880 - DNA, 129 bp, Homo sapiens
tgaacagctgccaggtggtagaggacaccctcatggaaggttccatatatgccatgcctctgctgctatgcccaaaagcttacccaagcccctaacacgagatactgaccaaaaatagggtctggctgg

SEQ ID NO: 720881 - DNA, 397 bp, Homo sapiens
ctgaaaaaaggggggcccttttatttccccatttgccctttggcaggattacctcatctatttcccctttaaatagtttggaggcagaaaaaatttggcccaaaaattttttttatggttcccattggtctccccaaatgaatattggaaaacctggaaaaaaaatattgcctattgattcaagcccccggagactggatgggttttatgacgccccttttccgtttttcttttaggaaaggatttttccgcaaggtttaatggtgctggaaatgaaatcagttttccccctttcatgtaggggacccccagccctttttttttttgtaaaaaagtttttttggataaagcagccttttgccccccctttggaataaaaatgggttttattaaggga

SEQ ID NO: 720882 - DNA, 678 bp, Homo sapiens
  misc_feature (23)..(23): n is a, c, g, or t
  misc_feature (72)..(72): n is a, c, g, or t
  misc_feature (348)..(348): n is a, c, g, or t
  misc_feature (556)..(556): n is a, c, g, or t
gcggcggtgttgaggttgggtcngggatgcggggtctttgactgaaggggtaggccaagtggaggtatcagngacgtcgcgcggcacagaagaggaccagcctggacgccggggacgctgtcatgtacggcgcgatgctggtgtgtgcctgctgccaagaccctgatgatgtgaaaatgctgtgctgctgaatgtgagtgatgtgcctggtgccatgtgctgtgtgcctgtgctgtgtggtgtgtgcatgcctgatgtgtgagctcttggttttctgtgctatgcctgcaagctgttccgtgtgacgactgatgctgtgtgccctgtgctcaggaacagggacagcanctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggnaagaggaagaatacaagcgattgatgtgaagcactagccagagtgatgggagctacaatgccgtggagtcacttacggtagcgactattacgacccgtcagagccgaacggaggaggaggac

SEQ ID NO: 720883 - DNA, 650 bp, Homo sapiens
  misc_feature (23)..(23): n is a, c, g, or t
  misc_feature (72)..(72): n is a, c, g, or t
  misc_feature (320)..(320): n is a, c, g, or t
  misc_feature (528)..(528): n is a, c, g, or t
gcggcggtgttgaggttgggtcngggatgcggggtctttgactgaaggggtaggccaagtggaggtatcagngacgtcgcgcggcacagaagaggaccagcctggacgccggggacgctgtcatgtacggcgcgagcgggggccgcgccaaacccgagaggaaaagcggcgcgaaggaggaggccgggccaggcggtgcccggcggctggggggcagcccgagttgggaagctcctggggatatccgggttaatgccggaaaacgcggtccccggacacagacagagcggggcctctggtctcaggaacagggacagcanctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggnaagaggaagaatacaagcgattgatgtgaagcactagccagagtgatgggagctacaatgccgtggagtcacttacggtagcgactattacgacccgtcagagccgaacggaggaggaggac

SEQ ID NO: 720884 - DNA, 239 bp, Homo sapiens
acaaaggcaatattcgtgaagcgtaataaagcgaagcatgataaagtgagatatgcctgcaactgaaaaacattccttctcctttcgagtctatagctcatggtaaggagagggtatgggagccaagggtgagtttcatcttagctcagtgttaggctctggtctgagccgccgctttaaccgtccgacactctcacttgtatggctctgagaagctaaggttcctgagtactaaaagt

SEQ ID NO: 720885 - DNA, 521 bp, Homo sapiens
ccctgctggccagctgtccaatgtccccccgtacctgctgaacatcgtgtgattgaggccaactggtctgactggttactctggatgctgctggacggactgtcccccaggaccttctggtatttctggacctcctgtgtccccctagtcctgctgcgaaagaagggcttcgtgatcctcgtgatgactaggatagaattgagcgaactggagaagtaggtgcagttggtccccctgccttcgctggtgagaagggtccctctgcagaggctggtactgctggacctcctggcactccaggtcctcagggtcttcttggtgctcctggtattctgggtctccctggctcgagaggtgaacgtgttctaaccaggtgtagactggtgctgtgggtaaacctggtcctcttggcattgccggccctcctgggggcccgtggtccctcctggtgctgtgggtagtcctggagtcaacgggtgctcctggtgaagctgggcgtgatgggccaccctgggaacgat

SEQ ID NO: 720886 - DNA, 288 bp, Homo sapiens
gacctggaatgagctgctgctgtgtagccagtggctgatccctggtcagcacttccctggctcaggcatgcctggaaggtgctggcccccatccagctgagccactggggcctggccagatggcaggcagcaatgcaagagctggctctaagccacaggcctggctgtgaaaactgagcaacgggtggcccaagggaggcagatgccctcagccacctagggcagagctcaggtgcccagccccatcctgctgtggctcaccagacttagactgcaggtccactgagt

SEQ ID NO: 720887 - DNA, 1152 bp, Homo sapiens
agcgggccttccagcctcctcattcccacttttctcactatgtaggctttcgtttaggtctctgaaccctccaggctacctctggccacagacttgaccacctggctagctccctctgccatacccctagccatcatgagagcctttctgcctcctctgatgaggcaccaatcccctagataaatgatcttatttacaacagtccgaccaaatagaggctacgaatgcatattacaaacacttaaaaatatctggacctaaatttcattaatctctacaataaatcaactgaatactcttaattctcaaacgatgcatatatagccgaaatagatccaccatggcacattcaatcaatctatcgtcaagcaaatctacacacgatatccaaaacaacattaccacaactacatgaaccacactaatgcacgaatccgaaatacggtataaaaccttcaaaagatcaaatcaaatataaacccactctcaaacaactaccagataaccttgcaactcggcaatcgtgcctcgatgcaacatacctatacgaaccccaccgcgacctacgatatcccagcaaataaatactccatccatggaagaccgcgataattaaacgacacggcccaggaactggcctaaactgactaggaataataagccacatcattacgaatcaagggccagaaacccgccaccaaaacaatcccctccacgcgaatcataatcccaagcaagccattcgccccctacacgggtaccaaagcgtccgcactatggcacccaaacaatgggcccattcaaatggaaaaatgtcaaaaaacaacacaggagcactcaatgcaagaagcagcgcaccttaaacacgcttcccaaaacttctgtcgcgcccactttcgatttaaaacgctatttccgagagaaccttggaatcacggcaactggaacttggcccccgctggctccccttagccttaataaccctccctgggaaaaacactattcacagcatcccagcccaatcgcgggaaacccgaagacgccctcaactggctcccgtaaactaccactttaacttacctctcgccctctacaccccctgaggaggaacgactcacatgacggggacgggcggcgggtggtaaccagcgg

SEQ ID NO: 720888 - DNA, 219 bp, Homo sapiens
  misc_feature (106)..(106): n is a, c, g, or t
  misc_feature (133)..(133): n is a, c, g, or t
  misc_feature (138)..(138): n is a, c, g, or t
  misc_feature (188)..(188): n is a, c, g, or t
  misc_feature (216)..(216): n is a, c, g, or t
agccccagccccagattccggggcaggcagaagggctccctagagggaagagaggttctgaaaggccggccctggatcctgcaggactcgaggaactcagcagtgncaagggcttcccactcagccctccctntaatnccatcccttggcacaacctgacaggcaggagtagggcccagtgtccacangcccaggcttgaccaccttctcttctcnagc

SEQ ID NO: 720889 - DNA, 613 bp, Homo sapiens
  misc_feature (16)..(16): n is a, c, g, or t
  misc_feature (65)..(65): n is a, c, g, or t
  misc_feature (71)..(71): n is a, c, g, or t
  misc_feature (151)..(151): n is a, c, g, or t
  misc_feature (163)..(163): n is a, c, g, or t
  misc_feature (196)..(196): n is a, c, g, or t
  misc_feature (261)..(261): n is a, c, g, or t
  misc_feature (270)..(270): n is a, c, g, or t
  misc_feature (275)..(275): n is a, c, g, or t
  misc_feature (282)..(282): n is a, c, g, or t
  misc_feature (286)..(286): n is a, c, g, or t
  misc_feature (289)..(289): n is a, c, g, or t
  misc_feature (311)..(311): n is a, c, g, or t
  misc_feature (315)..(315): n is a, c, g, or t
  misc_feature (343)..(343): n is a, c, g, or t
  misc_feature (350)..(350): n is a, c, g, or t
  misc_feature (361)..(361): n is a, c, g, or t
  misc_feature (387)..(387): n is a, c, g, or t
  misc_feature (440)..(440): n is a, c, g, or t
  misc_feature (444)..(444): n is a, c, g, or t
  misc_feature (502)..(502): n is a, c, g, or t
  misc_feature (516)..(516): n is a, c, g, or t
  misc_feature (529)..(529): n is a, c, g, or t
  misc_feature (575)..(575): n is a, c, g, or t
acacgtgatgctcggncacaaacgggacgcagctctgcagcctggccacacacccttcgcgtatnattttnttttttagggtttatggggttgtgtacagagactctttctgctgacacgatgggcacacgcccttcgtgtatgactccantcctcagggttnacggggctgtgtacagagactctttctgctganacgatggccatatggccttcgcgtatgactccactcctcagggtttgtggggtttggagattttnttgatatgntattntagatantttnttntttttttgtggttgctttttgnatgntaaaggggacaggattaaagttcttgtntgatganaaaaactctanacgtgcaaaataaaactaaaaaaatnaaataaaagagctgaaggtggtctagagttaggtcttggcagaggccgcagtnctgngagactgaagaaactcataggggtcgtgggtgacgtctggctgctccccgacactcangcgagaagggcttnccaggtggtgctngtcctctcggaggcgttggacagggagctgaggttggacgacggcngagagccgccgcgctccgcctgtgcttcgtgcaggtct

SEQ ID NO: 720890 - DNA, 272 bp, Homo sapiens
gctaggtgtgtgcagcatcctcttggtctgaggggccctttacattccagcctcactggcttatggagcgcccatagccactcgggggcagaggccgcagcacgcgcacagcacagcttctctcccaaagcatgcacagcctgcttcattaagtcggtcccgtatctgttcctcctcactgggtggcctctccaaaccaggttctccagccaatcccaccagtgttctccagcggacagaggtttaaaaacttcccaagacaggccgggaac

SEQ ID NO: 720891 - DNA, 232 bp, Homo sapiens
tgcctgagcatgatgaacctcatggttcgcgatggcaatgagaagctggacctgctgaagatcaacatcctgtgccaccgcatccggaattacctgtacatcttccggaagtttgacctggataagtcgtacagcatgagagcctacgagacgcgtatggccattgagcacggctggcttcaagctcaacaagaagctgtacgagctcatcatcacccgctactcggagccc

SEQ ID NO: 720892 - DNA, 445 bp, Homo sapiens
cgctacttcccaacctcttttctgcagaacgtggtacagtggtgtggtcaaagaatattttcaaaggggctctgtggttgatgatgtggggaaatactacaaaaagcaggactcgtagtgctcggcccagcaccacatgacgcttcacgttgtcattcatccttggtccccccgctgtgtggtgctccttagcatcctgcagagcgcttggtgagtccttgctcaaaaagtgtggttgctgcacccccaccttcactttagcagacatctgctaatgaaaggatgaactgcttttcttttttttaaattcagccaaattcaaaaagagccgtaacactgggattagcttcttgagagcaggagccacattcattctttgtgtttgccctgtgattatccagggagtagttggacttcctcataataaagaatgttgtgatagcca

SEQ ID NO: 720893 - DNA, 539 bp, Homo sapiens
  misc_feature (391)..(391): n is a, c, g, or t
gggaagagttccccttatgataacacctgcaactgcgatataggattttgtgttaacgagaacactgctgctattagagtgtggcgacgctagagttctagcgaaatattccagagcagcgacacataagatggcgaccgttcattcttgatgaaagacttggacataaagtttctacgactgagatcaatcatataccgattgtagtaacggttgtagaacactcactcactgcacagagagtgtcttaagacatgccgtatatctctttgttttccaaatgttcaaccaattgcaattttcacgcaaggcgtgatgatgtttagaagaagagagaatcgttcaatgagcgggactacatttgttgagttaaacgaacctctcaccaggnccactatatttgatccaacggtggccctttagaatttggcgtcacatttgggaaccaatgatgaactcacctgatgagtggacttattagacgtcctttttactatcgctgacccacaggggagcccattatgggttgttcagtgggc

SEQ ID NO: 720894 - DNA, 408 bp, Homo sapiens
aagtcactcagaaagaagagatcacaaacatatgagatacttagatttctctttcttttaattcctatattaaagtatatacatacattttctgagacagaatctcgacttccctgggctcaggtgattccccctgcctcagccttccaagtagttgggattacaggcacaccaccacacccagttaatttttatatttttttgtagagatggggtttcgccatgttgcccgggctggtcttgaactttttgaagccatccatctgcctcagcctgccaaagtgcagggattactggagtgagcctccacgctcagcctatattaaataatttataaagtattaatgctgatagtcatatcaccagagattggtaatcctctaaaatagggttctaagttatttctct

SEQ ID NO: 720895 - DNA, 389 bp, Homo sapiens
  misc_feature (189)..(189): n is a, c, g, or t
  misc_feature (228)..(228): n is a, c, g, or t
atcatagaagacctttcttcctctcccgttttctttttctttcccttgtattttgtaagtgccacttataaacaagataccaggactcaggacgttgaaaatgccacttcagaaaatgtgtcggccatccatccctctgtccttttaatgagatgcatccgggactgcaggaaaccaagactgctgcgnaggcaggattgtcgttgggcaaccaagcatccttccagntgccccagaaagaatctcacaatgtcctgcaatccctggtcttctcaccacctcagggggcggtccttgaatccacccccatccttgttccaggctcacaagttaaatttaccaggagctgatattgcaaaatagattgctatttcgcaactgaaaaaaaa

SEQ ID NO: 720896 - DNA, 108 bp, Homo sapiens
catgcagaccctgcctcaagtggcatcacttcttaattgaaaagaggccgaggcgaggcgggaatgaaggccacgttgaagccctgcaagaacaggggtgtgtgtgtg

SEQ ID NO: 720897 - DNA, 554 bp, Homo sapiens
tcatgtactacactgcatactatcaacatcactcaataaaatagacacaattaacaaaaacatgtgacaaggctgtactataaaacggctctgctataaatagtatagaatatacagaattacaacgtcaagtattacattatcaaaatatacacccctccctgaaactaacacaagctatcaacattttaaatgaatacaattatcgaacatatttgcaaaattataaccacatgtataaatattctgccatatttacttaggtctagaattatcagcatcacaagtccacttaaaaaatatccacatataagggctgggagagagacatcactaacaggtaattttatattaggggttaactcgaatcaaaatgactagaatatacagtaatgtctatgattcatattattacctgataaaaccaattagtggatcataggattgcttatacaatattctaattatcacttcacaaatgattttcgtaagccctatgtgactatctctttaataaaacccaaatgaatagtgtagggtgtacatatatacag

SEQ ID NO: 720898 - DNA, 746 bp, Homo sapiens
tgcatatggcaaatctgtcttgaattatatcatttctctccctctctctctctctctgtgtgtgtgtgtgtgtgtgtgtgtgtgtgtgtgtgtgtgtgtgtgtgtgtgtgtaggtatgtgttgggggtagtagttgtattaatgataataaaattctattaataaaagatcgtgtggtgataagagaagagtaatcatcgtcgagtagtaccgtagttcgtacttactcttaataatcaatcatcagagtgtgttgttatcactacaataatataatcagcagtactaataataaggggatggtatgttagttgtagtatgtgtttgtgggtcgcactattattattaatattattgtgtatggtgatgatgttggggtcgttgtgctgatgtttcatcagcagagaaattactccaatatattgtgtgtgtagaatcataactactatactatatgttgatttactaaaatgctgtgtggagtgtgtggggatgagatgagagagtagagcggggagtgattatagtagtataggggtctctcagagatggtatattttcataaagagtgtgtgatgagagtgtgtgtgtgagaagaacatgagagtgaaagcagaaagacgtcagtgtgtgttttttatatacagaacacagagtatgtgagaaagatgttgttgggaacgtgtgttctcggggagagattatcttgtgaatatggaggggggtcccaatatattttataaaag

SEQ ID NO: 720899 - DNA, 1608 bp, Homo sapiens
ggcccagcagcccagccacagaggagccagcgaacctctcccggcgcctgtgctgggggctttctgttccagcgtcaaggatggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctgcctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactttaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggggcggagctcctgctggccgcccggctactcggggccctcgctgcccgcagtggggcggcgtacggccccggagcgcacggggaggaccgcgctggcccccagagccccagccccggcgccccgcccgctgccaaacccgcccggggctgagcgcacgccccgaggtccgagaccgccacgcacagggatacagggggcgcctccgcccggctaaaaagcgctgcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctggagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttcaaaaaa

SEQ ID NO: 720900 - DNA, 829 bp, Homo sapiens
gatgctggtcatggcgccccgaacgtcctcctgctgctctcggcggtcctggccttgagccgagtaccttgggccggctcccactccatgaggtatttcgacaccgccatgtcccggcccggcgggggaagccccgtttcatctcagtgggcgtacagtggacgaccacgcagattcgtgagggttcgacaggcgaggccgcgagtccgagagaggagccgcgggcgcgggattagacgcaggaggggccggagtatgggaccggaagatcacaggatcttcaagaccaatacaccagatttgaccgagagagcctgcgtaaacctgcgccggtatttagagactctatgatgcagaagggccggggttctcaaaaatcccctcttccacgaatgcatttgtacggggctggcgaacgtttgagggcccgggacctgggcgcgccttccccttcctggcggggcatttaacccaaggttagggccgttaacggaagggcgcacgcgcatttacattcggcgccttggaaaccgagggaccccttggcgcttcccttggacacgggcggggggaaaaccggggggggctcaggatttaaccccaaggccggccaacggtggagaagggcgggccccggttgtggcccggaattcaaggggcagataaggccgtaaccttggggaggcggccacccgttccgttttgccacgggtggggttcccgacgggaattaccttgggagacaccgggacacgcgcctacgccttggaaacgcggcgggacccctcgcaaaagaggaacacgtggtggcccaagcaaccccaattct

SEQ ID NO: 720901 - DNA, 603 bp, Homo sapiens
  misc_feature (581)..(581): n is a, c, g, or t
ctagtgtgttgggtggtcatgcccccccgcccggccagccgccccgtccgggaggtgaggggcgcctctgcccggccgcccctactgggaagtgaggagcccctctgctgcggccaccaccccgtctgggaggtgtgcccaacagctcattgagaacgggccaggatgacaatggcggctttgtggaatagaaaggcaggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctcgtgaaacactgtgcgtgtgtccactcagggttaaatggattaagggcggtgcaagatgtgctttgttaaacagatgcttgaaggcagggtgctcgttgggagtcatcaccaatccctaatctacaagtaatccagggacacaaacactgcggaaggccgccagggtcctctgcctaggaaaaccagagacctttgttcacttgtttatctgctgaccttccctccantaaagctcccgggccctgccaa

SEQ ID NO: 720902 - DNA, 112 bp, Homo sapiens
tacaagaaggcatagctggttagaatgtccctgtgtttctccaaatatctgcagtttcctagacgacccctccctcaggagtgtagcgagagctggctggtgtctgacagcg

SEQ ID NO: 720903 - DNA, 139 bp, Homo sapiens
cccgagttatgtaatgtggaggggtcggtgcagtctggtgtgagtgcatctccaggaggtcttgggaaagaggggcattccttcctgaggccatgttggttctgttctgacttcattcagagcagaactgccaatgtcc

SEQ ID NO: 720904 - DNA, 517 bp, Homo sapiens
taaaaatggtttatttcatggccattgtaaaaaataatgacctgatgagtaaatattggcttaaggcatatagcagagcatctcgcttcctctctaacataatgtgtaacaaggtggagagccagctgctctccaaggataggaggttaaaccattacgtccattttgaaatgctactatatatacacacccaaactactacatacatatacaggacttaaaaacaacaagcccagctcagaatgcttacagcctggcacctaagccttattcacacctcaccataactttgcagggtgacacctcgaatgttcccaccacaaaatttctctgtactggcttttaccccgagaaaagcaaaatgtgaaaatgttggtaagagagttggttgggaacttcagttgccgggttttttcatgttaaaaagccactttaatgggagggctttcattaccttttgcgggaagaaggtttgagcaccattaaggccccccaggggttgagggtgggggaaaat

SEQ ID NO: 720905 - DNA, 996 bp, Homo sapiens
ggcccagcagcccagccacagaggagccagcgaacctctcccggcgcctgtgctgggggctttctgttccagcgtcaaggatggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctgcctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactgcctctcaagccttgctcttccccagtaagacctgtggaccattccagaagcctttgccagaagttccatccaacctccccggtccaattttactttctcaatgacgtcagaggctctgcggagggaggtctcttattcaatgcttggtggtcccctttaacgtctccttaataatctcctgtgtaagaagcacacctatcgggagcgagaagttgcgggcagggatcgtatgaagc

SEQ ID NO: 720906 - DNA, 256 bp, Homo sapiens
gctctacaggatccttagggctgtcgggggcgggcgggcggttgctccccgcggaggtgtgaaccacatcctgccccaggccactgcaggagcgaacctacccctcagagacgcgagagaatgagtagcaacaaagagcagcggtcagcagtgtacgtgatccgtctttgcgctcatcaccatcctcatcctctacagctccaacggtgccactgaggtcttccattacggctccctgcggggccgtagccgccga

SEQ ID NO: 720907 - DNA, 271 bp, Homo sapiens
ccaggcaggattctgttcctagtgggaggtaccacagctgacagaaagtgacagcggagtccatgccttgcggagggggcttgaacacagcacgggggcaaggacccagaaaggtcacccttgattgtccacatgtgattacgagccatcatggggaagagcagccaattgccttgagactccaaaatgggtttcattctgccctatttggtcccagattgcctgcattatgccaggttcttccaaatttcgtacccatttcgaagatggg

SEQ ID NO: 720908 - DNA, 264 bp, Homo sapiens
  misc_feature (2)..(2): n is a, c, g, or t
tngggtgccatagagagtagaccagtttggagatggaaaggttagcagtgacttagcccatatgttctgtgttggaatttgtgctagcagtttgagcactagctctgcgtgcctatgaactgaatgctgcttgtcccattcccattttatgtcatggagaaataattccacttggtaacacaaaggctaagttaatgttattttctgtacagaaattaaattttacttttagccttttgtaaactttttttttttttttccaag

SEQ ID NO: 720909 - DNA, 457 bp, Homo sapiens
  misc_feature (130)..(131): n is a, c, g, or t
  misc_feature (192)..(192): n is a, c, g, or t
  misc_feature (203)..(203): n is a, c, g, or t
tcaaatttagataatttaaaaataaacatagatcacagaaggctacactatcaaccttctctgtccagacgctgtactctcagttcctagataaatcacagctacattttttttcatttaaagatgtaanngtgtaacctggggtttagtaaactacagtcctaaaacatccagccagccacctggttttgnaaataaagttncattggacagaagccatgcccacttgtttacattattgtctggctgcttttacactacaccaaactgagtcactggggcagagaccttatgtggtgcaaagcctaaaacactgtaaatcttcacttaatatcatgacaggttcttgaaaattgtgaccttatgtgaagcaacgataaaccacttttttctcatcaatgttataactaaacgttaaaggaaactattattggaggacctgctgtatgtcattatg

SEQ ID NO: 720910 - DNA, 114 bp, Homo sapiens
gcggccgcctactactactactgctcgaattcaagcttctaacgatgtacggggacatgtgaaataaaactcagtattttaataaagtagcacggtttctattgactcaaaaaa

SEQ ID NO: 720911 - DNA, 303 bp, Homo sapiens
aggcattccagccccgaagctgctccaggatgcagtggctcattgcctgtaatcccagcactttgggaggccaaggtgggccaactgcttgagcccaggagttcaggaccaccctgggaaacatagtaggaccctatctctacaaaataaccttagccaggcatggtagcttgcacctgtagtcccagctacttgggagacccgaggtagatcacttgaacccaggaggttgaggctgcagtgagccatgatcgtgccactgcactcccgtctgagtgactgacagaatgagaccatcttaaa

SEQ ID NO: 720912 - DNA, 203 bp, Homo sapiens
agtcatcttaaggcttactggggctggaggatcctcttccaagatggtgtactcaaatggctggcaagttggtgttggttgttggtgggaggcctcaattcctcctctatgtgggactcttcacggggttgagtgtccttatgacatggcagctgcactccccagatcgagcgatgcaagaaaacaagacagaagcttcagtg

SEQ ID NO: 720913 - DNA, 161 bp, Homo sapiens
ggagaaactgaggcttgctagtgtggagtgaccaggttcccttagagtgcagtgcgtacaaggcctgacttactctgttccctttccccaggaactcttggtcctcagaagcccctctggattgtctacctggtcgtaacccataccacggtgctattacg

SEQ ID NO: 720914 - DNA, 330 bp, Homo sapiens
  misc_feature (310)..(310): n is a, c, g, or t
aatgagatggagtttcactcttgttgaccgcctaggagtatgcagtggggcgatctcggctcactgtaacctccacctcctgggttcaagtgattctcttgccccagcctcctgagtatctgggattacaggtgcctgccaccatgcctggctaatttttgtatttttagtagagatggggttttgccatgttggccaggctggtctcgaactcctggcctcgggtgatcagccaccttggcctcccaaagcgctgggactacaggcatgggccaccgtgtccaagctgggaaatgctttccttgacttnagtgctaggaagtaggatgg

SEQ ID NO: 720915 - DNA, 331 bp, Homo sapiens
atccccccggtaatgtagatgctgtgtggtgggattgcgtgagataccatgcggtacaggatggtctggtgagaaaggaaggcttagagtctctccaggtatgatcggcgaacccagaactccatctttttacagatggaacgtttctatggtgcttatgcacgcagacccgctactgctttaaaatcgtacatatgctggagatccaagttcgacgctctcaacctttctcccgttgtcctccagcgtcatctcccctcttggtccttgggttgttctgcacttcctgcgtatttacatgcattacacatgttatctatcatttccgggg

SEQ ID NO: 720916 - DNA, 100 bp, Homo sapiens
ctactggctcatgggcgccaaaaaatactggatctgctgaactgaaggctcagcccgatgatctccgcagatcttcagctgcattgggcccgaagtaagg

SEQ ID NO: 720917 - DNA, 457 bp, Homo sapiens
cccgacgccgacgaccgatatgcctatgagtctggtttcggagcccagcgtcaccccagacccggcatggagccgatcatggcggcgctgcaacggcaggacggttggtatcgagcttacctcgccaacatgaccaaggcagtgtccgcgccagacctcgccgaactggcagcgctcctgtcatgcgagatgccgctggatcttgccgttcagcgcggcaagacggcgctgatggtcgccgccgagctgggccaccaggccgtcgtcgacatgctgctcgtccacgccgaagagcatggcatgcggcagttgaatctgggcgcggcggacagcggcgataccgcgttgatgctggccgcctttcacgggcatgttgccgtcgtggagcgcctgctcgccgcctctgcggccaccgaggtgccaagccagtgcggcgacacggcgctgatggcggccg

SEQ ID NO: 720918 - DNA, 125 bp, Homo sapiens
caccagccattcaaagtacaaatgaagaataacgatctaacaggattcttgtgagacacattatcagactaatttaatccagttaacacatgaataaagatttagagtttttaaagaaatacagt

SEQ ID NO: 720919 - DNA, 155 bp, Homo sapiens
agacctcaggccaggataggggccatactgcccctactgcaacaccacagagctcagctgcacttccacctgccttcagaagcccaggaggtggcccttagtggcctataactcagctcggaccctactcgccgaacggggatcctactagagta

SEQ ID NO: 720920 - DNA, 152 bp, Homo sapiens
ggcgcgagtagccgacagccggagcgcccggcaatggcggcctcgacggcctgcgcaccggcccatcaaggggatcttgaaggacaagacctctactacttcctttatgtgtggcgtcgggcgacacaggccccaagggaatgtccgcacga

SEQ ID NO: 720921 - DNA, 302 bp, Homo sapiens
ggcggcatgattgaatgcagtgatttcggtgcagattggtgcaatgtatctctatggaatgaagtgtattccatgcagcttggtgtaattgataccgactgaatgcagtggattccatgcagtgtgatagaatgcactggattccatgcagcagtgtgaaattcatgcagagtgaatgcagtggattgcatgcagcttggcccaatggatcctgattgaatgcagtggattccctgcagcattgtgtaattgatacaaatagaatgcagtggattccatgcatcaagattcaatgcagtgga

SEQ ID NO: 720922 - DNA, 304 bp, Homo sapiens
  misc_feature (44)..(44): n is a, c, g, or t
ggctgctctgaggattacttcgattggcgggcactcacatgtgnattagtgtgcgtgatctaggccaggcatggtggctcacactggaaggatctcttatggagatgggtcccctccccaatagagaaaatgagggtatcatgcctccttgcctcaatttggctgataaggagactttgaggagacacctacatacctgttggttcccaggcacttggcgacagggtgacctgcaggagcgtcaagctgcgtgtgtttgggtagcacaacaaaggcaaacaaggtaagttgcccgccaatcgaa

SEQ ID NO: 720923 - DNA, 207 bp, Homo sapiens
  misc_feature (135)..(135): n is a, c, g, or t
tcaagcttctaacgatgtacggggacatgcacaaacggtagttttgtgtgttggctgctccactgtcctctgccagcctacaggaggaaaagcaagagcttacagaaggagtgttccttcacggaggaaagcagncactaaaagccactttgtagtcaaagatgagcgggaaaccatctcaataaacacattttggagaaaaaaaaa

SEQ ID NO: 720924 - DNA, 337 bp, Homo sapiens
tatgtgagctggtcaggagggaagtagtgcagcagtgccggatgtagtcgagtactgcgtgtgcagtggtggaggcccaggtcacgcagtcagcccaggtctgtggtcgctgcagcaccaggctgcgctgaacagcctccagcacctccaatggctgagtgcctgccagccgcggtgttcgctccacaaacttggggtctgtgaggtactggttgacattttctgctggctgcttgaagaggcctttcaaactcatcccgagcccactgcaggatgtgctcgatggcattagggaagttcttcagggtacagatgggggatggaccttctcaggtgg

SEQ ID NO: 720925 - DNA, 638 bp, Homo sapiens
atctctccagggttgaagcggggcaatgccatcttcaccttcccaaatactgcagtgaagtgtgctgcagccccgtagaagatcatgtacttatcagaagcctactggaggaagacagggaagcgatccaaggccaatatcattttcaacacttctattttttccgtggtgtgggttaagaagtatgcagatgccctacaggagatcatccaggagcggcacctcactgttaactacaagaaaaacctcactgaaggccgagccgttaaacaagaggctgaatttgagaacctggacataccaggagagacccaagtggtttcttatcgaattgcttcatgttacacctccaatgagccccaccatttgtcctcacgaccaggcctgagccttatgcttctgaattggtggatggggctaagatactcttcaccccggcggtccctaaacagttttgggtgtgtcccctgtccatcctttgcctgtaatatccgtgtcgccgtacttctccacccccctttcctccccgtgacattttttttcttttggccactactcccggcccggggattttcgttcgttcccatctcgtcccttttgccccttctccaccgtcttgccctccagtggaaaaaaaa

SEQ ID NO: 720926 - DNA, 286 bp, Homo sapiens
cctgtggtctcagctgcttgggtagtgctgggacagtaacataatctcttgggcatgaggggtggaggctgcatgtgggaccgagattgagccactgcactccagcctgagtgacggagcgggactctgtctcagaaaataaataaataaataaaaatgaataattggctcggtgtggtaatgcatgccttggtcccagttacttgggaggctcccttaggcctgggagtttggggctgtactgagccgtgagtgcacatcagcatgcgtgcctggtacgagcacc

SEQ ID NO: 720927 - DNA, 186 bp, Homo sapiens
atgtgaggagctcaagacacttctgacgtccagcaccttcagactgcctgcattcctgcgctgcatgaactcctttcaggtggcctacatgcggatgtgatgtgacatgatgtcatcatcttattgggtatgaaacatgtgaaaccaacacattaaatacctttttatataaaaagtaaaaaaaaa

SEQ ID NO: 720928 - DNA, 398 bp, Homo sapiens
agggcaggcgtcctgggtggtggtgggatggtcccctgtggccccgggcacagggccgggcaggcagcctggtgccggaaaggcggtgcgtgctggtggtggtttaaatgcccagaacagccccagacagcgcaggccgggcagggtggggggatgggagcaaaggatcaaagctttctttttttcaagtgcaataaatctatcagggaactggggcgggaacaaccggcactccgggacccttctgtcccaggccattggagggtgcgcccttaaaggccctacagccctttgggggcgagtggcatgggtgtgggttagggtgggcaaagggctggggctactcccgtcggggcaactctgttccccccttttttaataaactggggctgggttca

SEQ ID NO: 720929 - DNA, 902 bp, Homo sapiens
ggagccttaatgcttcaaggtgtagaccttttagccgatggctgtggcgcgttacaatggggccaaagggaagaacagtgattcatgagcagagtcggggaagtcccgaacagtaagcaaagagatggtccactgttgcaaagtcaatgacttaaaagataaatacaagaacatggagctaaacttgttcaacgatgtgccaataacacaaatgaaggaagctggggatggcactaccactgctactgtactggcacgctctatagccaaggaaggcttcgagaagattagcaaaggtgctaagtccagtggaaatcaggagaggtgtgagtgttagctgttgatgctgtaagttgctgagacttagaaagcagtctaagaccgtgtgaccaaccccgtgaagaaattgcacagggttgctagcgatttctgcatagaagggagactaaagaaattggcaagtatcgatcatcgtgatgctagagtgaaataggaaagttggaagaagagggtgtcatcacagtaaaggatggaaagaatactgaatgatgaattagaaattattgaaggatggagaggatcgaggatatatttctgcgatactgttattaagtagatgcaagtaggttcagaagaagtggagtcgcgaggatagcataatgtggctgtggtagcgcagagagacacctagcgacggtagtgccacggcacagggggagcgtgcctcgttgaatctaggcaaatgtcacgaaacgccctttgggcaataagtcggttgaagatcgtgatgggagaaggcacccgatgtacacatcggtcgaaggacagtaggctaaaagggggggcgtcagggttgaggcaccggaaggggccacgggctcggagggaccgaaggaacagga

SEQ ID NO: 720930 - DNA, 351 bp, Homo sapiens
  misc_feature (89)..(89): n is a, c, g, or t
  misc_feature (112)..(112): n is a, c, g, or t
  misc_feature (148)..(148): n is a, c, g, or t
  misc_feature (150)..(151): n is a, c, g, or t
  misc_feature (156)..(156): n is a, c, g, or t
  misc_feature (159)..(159): n is a, c, g, or t
  misc_feature (171)..(171): n is a, c, g, or t
  misc_feature (205)..(205): n is a, c, g, or t
atcgttaacgtgcacgatcccctgtcccttgatctagcctatgatacctggcagttcttatagtgcatgattcacatttgtgaactganaacactaaagatctttatggtanagtcaaacctacactcagtgaagagtagtgtgactntnncttcngcnatagttgtggcntgcttttgtataaattcttgcgaacttctaacantagtagtctagttattctcagatctatcttctatccttcaagtattatctctgctctgaattatgcagtgggcctgtgaataggaagggcttgtgtgtgtgagcttctatggctgataaggcagaggggattccgtgcacggttaa

SEQ ID NO: 720931 - DNA, 105 bp, Homo sapiens
aaacgagctcttacaggacaggatcttcacccgggagccccagcatacctaccactacctgcccttcaacctgccccaccggaggcctcacttattctttccctg

SEQ ID NO: 720932 - DNA, 647 bp, Homo sapiens
  misc_feature (154)..(154): n is a, c, g, or t
  misc_feature (272)..(272): n is a, c, g, or t
cctgcaagcgctgtttctggtccgcccaccccctccacgagatttctaaaaattgtgtcataattgtcattcgtggtggtaattttaataatataaaaaattgtatatgtagaaatatgtgaaagatattctcgccacggggaccacgagaacncccaggccccgaggctccacgggcacacctggtgctgtggtgagcttcttccacggaggccacccttgccaccccactttcttcgccgtttcttaactttgagaccactaaagggtgnccacggttctgggtgaaaagggataacttttatgcacaccactaagacccaacttcctgagaaatgcccagtgcctgcttagtagctttggaaaaggtgccctctatgtgaaccactttctatgaaaggggtggctgggtcttcaaggatctcctgtttttttcaggctcctaaagtaacatcagccactttttagaattggttctgttttcgtaccttcccacctggcctccaagtgagccacagaaaccctgcctgccctctgtctgtcttctcctaattctgccaggtggaggttgctagtttagtttcctttttgagatactattttcatcttttgtgagcctctttgtaataaaatggtacatttctata

SEQ ID NO: 720933 - DNA, 203 bp, Homo sapiens
tataagcagagcactttcaggattaggtatctccttctaggaactgtccctaaatcataccaacccccttcatcctttgactatttccctaagccagggtcaacccacaagccagggtcaacccacaagccagggtcaacccacaagccagggtcaactccaaaagccagggtaacccaaaagccacgggtcaacccaaaagc

SEQ ID NO: 720934 - DNA, 918 bp, Homo sapiens
agtatattgatagacggaccagcgccgtcttttatggtgagagaggcacgaatcttgaccgcccttgtgtaatcgtgctgtggagctcaatactaagtgttgtttcatcagtgtgtgtccccaggatgtgtgtccccacgcccaaggggtcctgtgtgccccgggtgtagtgaagacaactttgttgccccgggccccgaggtgtataactgttcaggccggggggtccaccacaagctgggttaaagatcattatcccttcgtgaaccttcgagggcttttatcgacagctttgggaagaattagtccgagagcaagggatgttcgcccacgttggccagaagctaatttttttcagccccgggggactcccctgatcgcccgtctgcgaactggctgtctcttaaaaaccggcagttcttcaagtgggagcacacagcacccgggttatataccacgtgggattctctctgcgcggcgccaaacaaagaatcatggggagtttaggttttaaataaataatcggctgtaagcgaacatcataagatgcactgtggctgccgacaaaaacggctcgtcaaaacgataggcgacaaccaacacgagatattcttgaataacaactggtagattcaaacattgttaaaaatccgcacagaaatcttgaaataatgcagtctttaaaggcaccgaatttgtcccgaccacttcttctacaggcggaacaggattcagaactcatgacaaaattcagtaggtggggtggcccagttgctgtaaaaattggtgaagagggtgctcgaaaagagcggacaaaagaaacccgcttttgtttgcaagcaacgttggtaacgactagtcttccccctcttaaaaagtggaaaaaaacatgttgagaccttcttctccacaaaaaca

SEQ ID NO: 720935 - DNA, 455 bp, Homo sapiens
ggatgatcccatcgacattgccctattattttattagataatgttaacagatacggactcggttatcaaccacttggtgtagatactgacatccttcaaattgaacaaggtatgttacctaattagtctttacgtattcctcccacacttaatggataatttgtcaagcccagggaatctttcctttactttgacttcccgagttgttcattcatccattgacacataaacttattctggattttgaaatcttcctcgatttccctcacaaacccgacgtatcttgcaaggtattattctcaagataccgataccctcatcaaaggatttgttgataagtttgtgctagatcctcatgatttaactcctccaatcggtcttcccaagcaccttggaggactcattatcttattccttctctccacctatatgagaaacaatagggcaatgtcgat

SEQ ID NO: 720936 - DNA, 497 bp, Homo sapiens
gcaaaagaaactaaccccggagcagttttaggtcacaagagaaaagggaagggacccccctttcagtgggatctacttgaataacaaggaagcaggaatgtatcattgggtgtgttgggacagtccatttttcagttttgagaaaaagtactgttttggcactgggtggctttcgttttccgaggctcatggtaggtctggttttgatgaaagccacacagggatcttgagaggtttggatacctcgttaggatcagctcgcacagaggttgtttgcaagcagtgtgaagttcatttaggtcaggtgtttcctgagggaccggggcccaatggtcagaggttttgcatcaacagggtggctttgaagttcaaaccaaggaaacactgcccattttcaagagtccggttcccttgccaccccttcaggggcaccctcaatttccacaattcacttgaatgacttgttttatttgcaataaaactgggctgaatttgca

SEQ ID NO: 720937 - DNA, 159 bp, Homo sapiens
cttctctccgagtggtcaattgctgagaacattttgtgctgaattcatcgaagacagccctgtgttaattcatatttagacaccccaaccatttccccccagaagcaagcacagctcagccaaccagccagccagcacagcaggccagcactggccaat

SEQ ID NO: 720938 - DNA, 357 bp, Homo sapiens
  misc_feature (7)..(7): n is a, c, g, or t
  misc_feature (58)..(58): n is a, c, g, or t
  misc_feature (108)..(108): n is a, c, g, or t
  misc_feature (238)..(238): n is a, c, g, or t
  misc_feature (320)..(320): n is a, c, g, or t
  misc_feature (348)..(348): n is a, c, g, or t
ctgcaanctccgcctcccatgttcaggctgaggcaggagaatggcgtgaacccgggangcggagtttgcagtgagcgagatcgtcacttgtactccagcctgggcgancagagcgagactccgtctcaaaaaaaaaaaaaagaaaataaagaaaagggatgaggagttcctgggcatttttatttgtccccttttctccctctctaggctctattaagacaaagctttttcagatttncacttaaacatttaaccatagtttaggaaatttttaattatgcaccctatggacagaaggtaccctttcttgggtacataantttcaagctatttaggggatttttcttncttgcattt

SEQ ID NO: 720939 - DNA, 377 bp, Homo sapiens
  misc_feature (74)..(75): n is a, c, g, or t
  misc_feature (101)..(101): n is a, c, g, or t
  misc_feature (117)..(117): n is a, c, g, or t
  misc_feature (126)..(126): n is a, c, g, or t
  misc_feature (163)..(163): n is a, c, g, or t
  misc_feature (210)..(210): n is a, c, g, or t
  misc_feature (226)..(226): n is a, c, g, or t
  misc_feature (281)..(281): n is a, c, g, or t
cggggaggaggtctctggcagagaaggatgtccgttccaggagcacacggccctgcccaatcctgggccttaannctctgctagggctcgggcgctgtggntcctgcattgatgaancccgtgtcntgcccttgatgaagcctgtgccacctgcaagtgccancctgccccatgccccaacccccaccgaagagcccctgagctcaggcntgagccaagccacctnccaaggactttcagtgaggaaatggcaacacgtggaggtgaagtcctgttctcanctccgtcatctgcggggcttctgggtggctcctgcaatgacctcacctggcatgctggctgtggaaggcctaggacctcaggctggggaggaggaa

SEQ ID NO: 720940 - DNA, 323 bp, Homo sapiens
  misc_feature (303)..(303): n is a, c, g, or t
gcactgtggtccaggatggattctcctgccccagcctcctgagtagctgggattccaggtgcctgccaacacactcggctaattttttatacttttaatagagacggggtttcactatgttggccaggctggtcttgaactcctgacctcatgatccacctgcctccttatccaaaagtgctgggattacaggcatgagccaccgcacccggccacacctgggttgtttttttcttttcttttttgagacagagtctcattctgtcacccaggctggagtgcagtggtgcattcttgcctctntcccccgggttcaagctatt

SEQ ID NO: 720941 - DNA, 354 bp, Homo sapiens
cagggcgggaggggaaggagctgtgcaaacatggtggtggcccttccctgcccccaccttgttgactttggttgtggttgggggatgggctttgatttgggtggcagtgtctgtgcttgggaaaaaatgtcagagaaaagacaggaagcggattgaatgcaacagtgttgggtgcctggggctctttcttgtgtcttccggcccctagagcagatggaacaataagatgctttagggggccgggcgcagtggctaatgcctgtaatcccaaaactttgggaggccaaggcgggtgggtcacctgaggtcgggagttcgagaccagcctggccaacatgaaaccccgtttctact

SEQ ID NO: 720942 - DNA, 758 bp, Homo sapiens
ctgataaagaacctgtggtatacatacaccaggaatactatgcagccataaacaggatgaactcatatcctttgcgacaacatggatgcagctggaggctatagtcctaagcaaattcaccacaggcaagaaactcaagtactgctgcatgtatctcacttataagtgggcagctcaaatcatgagtcccacaggggcccttacaagcatgggaacaatcagcacactgcaggcaactagtcaagcaaatggcgggggcagtcaggacaggccggaagtgtggggctgaaaacatgctattggggtgtatgcttaactaccctgggtgcatgggcctccatctgtacccccaaacatccaccattaccaaacttgtattcccacagtacacaacacctgcacatgtaacccctgaactcttacacatacacaacgtggacattaatttcacgctggaaccaacatacaaaagaaatcacgacaacctggccagtcgattcttttgacaacaggcacgaccaacatttggatacaacctgtagcccagattaccccacggaacacaacaacgttgcgacgaccccaaactacacaaaaatcagactcccaacccaagggccttacacctgataccatggaatacacaaagttactcagacctgtcatgaacaactatactatacacaaaccaaaccagaaaactaaagggaattgttaaattctaagcccaaatacatgttcatccgggagcacccacc

SEQ ID NO: 720943 - DNA, 398 bp, Homo sapiens
  misc_feature (107)..(111): n is a, c, g, or t
  misc_feature (352)..(352): n is a, c, g, or t
  misc_feature (372)..(372): n is a, c, g, or t
  misc_feature (378)..(378): n is a, c, g, or t
  misc_feature (381)..(381): n is a, c, g, or t
actcttaacccaaagctgcccatccccctatgagcgggcgcagtgattataggctttcgctctaagattaaaaatgccctagcccactttttttcccaaggcacacnnnnnggcccctatccccatctagttattatcgaaaccatccagcctactcattcaaccaatagccctggccgtacgcctaaccgctaacattactgcaggccccctactcatgcccctaattggaagcgcccccctagcaatatcaaccattaaccttccctccccccttatcattttcccaattctaattttactgactatcctagaaatcgctgtcgccttaatccaagcctacgttttcccncttttagtaagcctctaccngcccgncancccataaaaaaaaaaaa

SEQ ID NO: 720944 - DNA, 413 bp, Homo sapiens
cagtgaaactttgcaggatcacccttaagccaactcaacgcatcaaaaagtggggtcctgatagttccccccaaccttttcctcccaaagtttttcctgcctcagtaaaaaggtatttcattttcccagttggtcaagccaaaaaagggatcaatttagtttttttgcatcccggatttgatcacaagtcctgttagccctgcttttaaaaaacatccagaaccctgccatttgcccgttttttgttgccatcacggttgtccacaccctccttaccccttgtttgggggattgcggtggtttcccaactgccctgccagggtttgccctggtccctttttttgactatttttgacccagcgcccccatgttaaaaaacaaatttgatcggggaacgcctttgctccctttga

SEQ ID NO: 720945 - DNA, 121 bp, Homo sapiens
tgtgctgcggcgttctagaggaccccctcccaagcatgaggaattgatgacagatcatatagggttgcaaatcggattttctaaaatgagtaggaagttggatttttatgtgcaaaagttt

SEQ ID NO: 720946 - DNA, 389 bp, Homo sapiens
  misc_feature (298)..(298): n is a, c, g, or t
  misc_feature (323)..(323): n is a, c, g, or t
  misc_feature (382)..(382): n is a, c, g, or t
cggaggtaaaaagaaaatataatgagaatttaattttaaaagggaataaaatttttaaaggaaaagcgagttgaaaaaaggaaatagagaaaaggttgggtggattacttggttaacttaagggagaaaaagagtataaaaaatttgagaaagaaatgggagaagagtgatggagtctaaacgttgatatagaggtggggaaaagttaaggacaggagtatattaaaatagagagaaaagagtttgagaagtagataaatatagaaattaagtgtggggtaaaaaaaagaatgtgaantagtttgggggggggggggaaaaanagaaaaagaaatacaacagccgcacacactctctctctctctctctctatcttctctcntcgtgca

SEQ ID NO: 720947 - DNA, 359 bp, Homo sapiens
  misc_feature (103)..(103): n is a, c, g, or t
tcctaaaatgagatgtgcttatgcactcaactgtgcactcagaaatgggtaacagggtactggggactgacttgtgtctccccagaaattcacatatggaagncctaaacagcatgtatggtatttggagagaggcctttgggaggtggctggggttggatggggtcatgagagaagggccctgaataatgggatttgtgcctgtataagaagagaccagagatgctgggcatggtggctcacgcccgtaaccccagcactttgggaggccaagacgggcatatcacaaggtcaggagattgagaccatcctggctaacacagtgaaaccccgtctttactagaaatacaaaaaattag

SEQ ID NO: 720948 - DNA, 413 bp, Homo sapiens
ctcaagaagggcctctttttttacaatgtcttttagggggggcccccttttttccttgggtttttccgccgaataaagaagggggtttcgggccttgccccccgccccattgagattgagattttttcccccccgggggggaaaaattttttttgggggggggggcccctcctggcctttttgtccccctttccccaaatgtgggttagcaaacagggatttaattaaagcgggccttcctttttcccccccaaaaggtttttaaaaccttttttgttttttttttttttttaccccccccttttaattttttttgggattttgccctccgttttttttccaattttttttaaccaaaatttttttttttttccttttttttttttttttaattttaaaaaggggcttgggta

SEQ ID NO: 720949 - DNA, 372 bp, Homo sapiens
ttgcccaggctggaggccagctggtgcaatctcggctcactgcaacctctgcctcccgcagctcaagtgcgtcttccgcctcagcctcccgagtagctgggactacacgcgcgcgccaccatgcctcgctaatccttgtattattcgtagagccggccttcaccatgttggccaggcctgctctcacactcctgacctcgtgatcctcctgccttggcttcccaaagtgctgggatcataggtgtgagcccacccccctggctgttagtcgctattttaaaaaattatgtctacgcatctacaataaggctgtatgtattggattgctgtgccgagtcactgaattcctacatgcaaactacctccaactgt

SEQ ID NO: 720950 - DNA, 347 bp, Homo sapiens
ttttttttgagatagagtctcgctctgtcatccaggctgcagtgcaatggcacaatctcggctcactgcaacctctgcctcccagattcaagcaattctcctgcctcagcctcccaagtagctaggactacaggcatgtgtcaccatgcccggctaatttttctatttttagtggagatggggtttcaccatgttggccaggctggctcaaactcctgacctcagagtgatccacctgcctcggcctcccaatgtgctgggattacaggcgtgacgaccgtgcccggcccatcctgttcgtttaatgtgtcctcggcactagcggttaagttccttcacggctgggg

SEQ ID NO: 720951 - DNA, 227 bp, Homo sapiens
aatagccacacgcatgtggatcagatgaagggacatctcagtatttccccttgcatctacagaaaaatataatccatatgcaacaatagctgcaacaacccgctattccaacgggtacgaatggtgcctctttagctataacgaatgagttttgatccctgatcttcctcatatgaaggaacgggaaacacctgatgtctgttgacatagtgattgctatcgaaact

SEQ ID NO: 720952 - DNA, 958 bp, Homo sapiens
  misc_feature (455)..(456): n is a, c, g, or t
  misc_feature (475)..(476): n is a, c, g, or t
  misc_feature (488)..(489): n is a, c, g, or t
  misc_feature (492)..(493): n is a, c, g, or t
  misc_feature (497)..(498): n is a, c, g, or t
  misc_feature (501)..(502): n is a, c, g, or t
  misc_feature (505)..(505): n is a, c, g, or t
  misc_feature (509)..(509): n is a, c, g, or t
  misc_feature (511)..(511): n is a, c, g, or t
  misc_feature (534)..(534): n is a, c, g, or t
  misc_feature (536)..(536): n is a, c, g, or t
  misc_feature (540)..(540): n is a, c, g, or t
  misc_feature (562)..(562): n is a, c, g, or t
  misc_feature (564)..(564): n is a, c, g, or t
  misc_feature (578)..(578): n is a, c, g, or t
  misc_feature (608)..(608): n is a, c, g, or t
  misc_feature (632)..(633): n is a, c, g, or t
  misc_feature (639)..(639): n is a, c, g, or t
  misc_feature (664)..(664): n is a, c, g, or t
  misc_feature (666)..(667): n is a, c, g, or t
  misc_feature (703)..(703): n is a, c, g, or t
  misc_feature (718)..(718): n is a, c, g, or t
  misc_feature (746)..(746): n is a, c, g, or t
  misc_feature (807)..(807): n is a, c, g, or t
  misc_feature (821)..(821): n is a, c, g, or t
  misc_feature (861)..(861): n is a, c, g, or t
cgtgacctgctggatgaattcttggggtgggtgcctggcaagtacgctcatgattactgactgtggctctttctactgcgggattccctacacttggtttccccttaacgaatctctcctatggaggaactctttctggaacctttccttcgtgacacaactcaggcttgcatagaaggggcatacgtatcgtagattcgggtgtttacaagatgggtcacgattaccgcgggggcgttctcacggtcaaggcatgacctggttaccgggatcgaccaccgcctagtatcctctgtatcgccatccaccacggccttgctcccttgcccctccccacggaagtgtgcttaatatatgagtgtagatatatatgtttagctagtgacattccccagagagccccagagctctcaagctaccttgtctgtacagggtggggaggttcagcctgtccnngtcacctctgaggtgcctnntcggcatcctcnnccnnccanngcnntantaanancattcccttccccatagccatcnanaacntggaccaactggcctcttcctntnccctgggaccaaantttaggggcctcagtccctcaccgccatgncctggcctattctgtctctccttnntccccntggcctgttctgtctctgagctctntnnctccgttcattccatggctgggagtcactgatgctncctctgccttctgangctggactggccttgcttctacaagtangcttctcccacagctgtggctgcaggaacttaatttatagggaggagcctgtggcagctgntgccccagccacanctgcactgactgtgctcaccacacatctggggcagccttncctggcaggggccctcgtggcttctcattttccattcccttcactgtggctaaggggtggggtgaggggatggagagtaacgctgcagaccatggtc

SEQ ID NO: 720953 - DNA, 689 bp, Homo sapiens
gcacagtccacagctgaagagcaaggtttcgtggcatgcacggcccgtgccctcaccctctgtccccacgaggggacccatgggggctgtctttgcaggggcacagatgaccaaagtcccttcctgcttccctgttgtacctggtctttgctccctggggagcacagcgaggggccctgatggagacgtccacctcaggtgcacagcatcaccaggtgcatctgcaggccaccgggctggctgctttgcagcccagggagaaggtcagcgagacaggagtgtatgagtgtggagtgtgtgtgcatggaagtgtggggcaactgggcgtcgtgactccctccccagccaagagaggaaggacccttcacaacccccaatggcgagacaagtcacttgggccgacttgccagtggtttgtcgccaaaaccaagatttcgaaggaacatgagtgggccagcgccaaggggcccagggccatggtggcctgtggccgcaggccttcaatggtcacctgtggtgcggcgggggtgcgcggtggccgcgttgggcaagcagggattcgccagccttgaagattggcttccacttttcctttctccttgtaaccaggactttgtgcacacactttggtgcggtttccatccaggctcctggtccctcaaagtgcgcctttgtggctaagggtgccc

SEQ ID NO: 720954 - DNA, 888 bp, Homo sapiens
gacgtctctctcctcgggtctgcgcgggccctgggcccccaccagacgggactccccgccccaattggcggcgaagagtctcctcgccccagagtcatcttcgggacgcccaggcccgtggtgatttcgggctcgccgcggcccgggtgattgtggggtctccgtgtgccgcggtggtcgtaggtctccgagaccgcggactcccgtagggtccccgtggacccgagttgtagtcgggacaccaccggacggggtgatcgtcggagtctccacgcgccgggtcgcatgacgcggatccggcctcggcgccttctcagggcgcctgcaaggcgcgcaggcaggatgaacattctggcaaccgtgcggagggatcgcgtcctggcggagcctgccccagctgcctgaggacaaggaggccgcttagcacgggcacaaagacttccaacacccgcgtcacctgacgccctgccaggacgcaccgagacaggctaccgatggtcatgtaagatctccaatggtcaatcgctggtggggagacctgtcggtgccgaagactcgcctcataacatagcgttctgcccagacaccttgcatcacgaatcttacttagcgcccaaccatttgggccgtggcactctccgaagacttcggcccgcattctgcgggtgcctgcgccttccccgcttcacgcttggcccctctgggattcccgctgcgccaacgcgaccgctcaaactgcattgccttccacactactactaacttgcgtctcaagccatttatcattgatctacacactggactgctgcggctactcgcaccatacacacacccgcagcaacgacctacagacattaccctccactgcactctcctccgtccccagct

SEQ ID NO: 720955 - DNA, 128 bp, Homo sapiens
tcgagctcggcaccccccgatagcctcggagtcatgacgctcgccgtgtaccccggaaccttcgatcccatcaccctgggtcacgtcgacatcgtgcgccgcgccctaaccgtgttcgatcggatcgt

SEQ ID NO: 720956 - DNA, 1842 bp, Homo sapiens
  misc_feature (161)..(161): n is a, c, g, or t
aacccattaagtgaacactaacctctcgctccgaatagtcaagacgtaatacagcggcatctcagacactgttgcagaacactgagctggaagcagatgacccttatcctggggcgagccactacgaaggagcacaatacatcaggctcgaggtatacccnatgatgcagctgagcttaacccccgctaattaccctgcgtagattgattccgtcttccagctctctacgtaagattatatgacacatgcgatcactcgtgagaatacattgacccgacgcggaaatagacgaagccagaacgtcatgcgcataatatgccaacaggctgatgacttcatggccagcgagcgctcgatccttcactcgatcatgtctagtctaatgatggagtggtacgggtatattactaccgtgctagattggcggcacggatatattgctaccttgcatgcaagcgtgcgtacgctgtgagacacttgggctaatgctccctagacgactccatgcataagtcataattacgttcaaccaaaaactgtgtggacaaactcaatcgccacccgaacgaggacagaactctcttgctgaagagactcactcacctctgaatggggaaattgtcttgacatcgtgagttcgcattgtggccccatatagctaagccgcatacatggagaactaaacatctccgtgggcagccaatctcgattgttacatagagcgaatccttcgtaagagatagacacagcacagctcattaacacagatcttaaatagggaacactcaactccacttgcaagagttgccttgatggaccagaaccattggaaccaatcttgggatctcctaaaggcgcacatcgaagcgcagtgtctccaaacttgctatcgaaaggtatgggcgctaagtttctatctcggttagatacaccagaattttttccttacggccacctaaattcaaggtttgggagaaatatcactctctaattacaacctccagaatatattcgcggaatggctagaggtccttgaagtggcaaccaacaccggtcatttgagggtccaccgcacggctgttaattgtgggaaagcacgtgttgatgccttaaagatacttaggagtagaaggagccttggcacattgaactcacaacttacccagcaatattaggagggccccattgacccgatttggcgtaattttctatagaaaagcacacttgatgtatgacacgtaagggcagaatctctacccaagggacatcggggactttaacccctaacctagagatgcacatatcacttagagaaaggaggacaatggaaatgtggacccccattggcccgactgttagcataacaccgggggagaactccctaacgagagcagaatgacggcgacaaacaccagcgccctatcgcgactaacggcataaagaatttgagaggcgagccaccatcacaaaaacgtagacccccagggtggcgtggttaggtacccactaaaaagcaggggagacaacggggcgcaagagggattacacgcaggcacaatatggcacgcccacaacacctatacagcacaccgcgtgggaacactagatctgaggcgacagaacgcacaagtggcaacaatcaacggcgcacagacgacaaaagaactcagagacagcgacaaacaaagtggggaaacagacacacagggagaacaccacgagcaaaagaagggcaaatagaagaaccaaacgacagaatgcgcggcacagcgcgacacgcggtgacgaagtcatagcagctacgaagcgcaccaaggaataagagaagaccacaaaaacag

SEQ ID NO: 720957 - DNA, 397 bp, Homo sapiens
  misc_feature (36)..(36): n is a, c, g, or t
  misc_feature (55)..(55): n is a, c, g, or t
  misc_feature (58)..(60): n is a, c, g, or t
  misc_feature (130)..(130): n is a, c, g, or t
  misc_feature (132)..(132): n is a, c, g, or t
  misc_feature (177)..(177): n is a, c, g, or t
  misc_feature (272)..(272): n is a, c, g, or t
  misc_feature (293)..(294): n is a, c, g, or t
  misc_feature (332)..(332): n is a, c, g, or t
  misc_feature (350)..(350): n is a, c, g, or t
  misc_feature (356)..(356): n is a, c, g, or t
  misc_feature (358)..(358): n is a, c, g, or t
  misc_feature (364)..(364): n is a, c, g, or t
  misc_feature (375)..(375): n is a, c, g, or t
ggatcctggtgacggtaccaacaggaataggcctgnagtgatcagactagcaaangtnnnggcagagggtcaggacgcaggtaccacatccaggacttcactttggcctttaaaaattcagccgtaactngngctcaggacttccccttgagctggctgtccctgggattttctccngctttagagtttggtttcattttttaatggtctggatttcccagtagcagcctggccctaaagctggactgagtttatggctcctaaggagcttncctaagactctggactatttnncttcccccttcagtcaagtgtctttacagttaagaatnaattggtaactgcatacntgcccngncagtcngtcccggggtngggtaccgtcgacggggaaccg

SEQ ID NO: 720958 - DNA, 774 bp, Homo sapiens
atcctagcactttggaaggccaaggtgggatgatgcctgagcaaaacggcgaaaccccatttctactaaaatacaaaaaattagctgggcatagcggcacatgcctgtagtcccagccacttgggagtctgagagaggagaatcgcttgaacctaggaggcagaggttgcagtgagccaagatcgcgccactgcactgcagtctgggcaacagaatgagactccgcctcaagaaaaaaaaaaaaatttcccaaaggtataccgaggaaagcagggaagcagcctcattctagaaatctatcatggccggttgcgggcagtagctcacgcctgtaatcccagaactctaggagtctgaggacgcggggaccaggagggcaggacgtcaagaccagcccgggccaagagggggaaaccccatacgtcactaaaaatcatctccaaattaggccagatggccagggggatcacaccggtaatcccagaacttcactgaggccgaggcgggtgatacaccggaaagcgggcgagtccgagaccaagcctgaacaaaacagtggaagaaaccccagtctcatacaaataagccgggcaatgggggcgcatggctagggacacgaagccacccggggacggctgagcgaggcaaaatggttgacccacacggaggcggaggtagggtgacccaggcacgggactcgcacccacgcctgagcaacagagagaacccgcccaaaacacaaacaaaaaacacatcaggaccgcccaccccaaa

SEQ ID NO: 720959 - DNA, 120 bp, Homo sapiens
cagccttcagcaacttctggaactgtttcttggtgccggcagccttggtgacctttagtcacgttgaagcgcacctgtcttgctcagaggccggcactcgcccactgttacgatttctcc

SEQ ID NO: 720960 - DNA, 621 bp, Homo sapiens
aaaaaaaaaaaaaaaaaaattttggaaaaaaaaaaaaaaaaaaaaaaaaaaagggaaaaaattaaaaaaaaccaagaaaaaaaaaaaaaaaaggggaaaaaaaaatgtggcccgcttggcccaagcggtttttaacctgggcaaggtttagcctggggccccaatttggggttaattggcccaatcgcccttatggggggcggtttccaatttactggcccgcggtttaacaaggccggaatgggaaaaccctgggggttcccaatttaaacgccttgggagcaaacccctttttgccaggttggggtatacccaaagggcccgccccgagtggcctttccaaacggtggcaaaccctaatgggcaagggaaattggaaggcgtaaatttttggtaaaattcggggtaaatttttggtaaacccagttattttttaacccatggggcgaaactggcatcctttatactccaaggaattcccccggtatgggttggggtgttgtccaagtttggaaccaggggccccttttaaagaaccggggcctccaacggccaagggcgattttttggctcccagtccccaaaggcctcaatcgggcccctggggcgcctcccttttgg

SEQ ID NO: 720961 - DNA, 100 bp, Homo sapiens
tttctgggctgttctctgtctgttgtctggccccgtttcttgggtggtccttggttcctatcctggcccgtcctgttagtccggtatgtttggcgtatta

SEQ ID NO: 720962 - DNA, 355 bp, Homo sapiens
  misc_feature (71)..(71): n is a, c, g, or t
  misc_feature (335)..(335): n is a, c, g, or t
  misc_feature (349)..(349): n is a, c, g, or t
ttgaggatcgcggtgttgtgggtggaggacattataaatataaaagatagataagcatctgggggtctgtncagaggatgggaatgagctaagagattgaatctggagcagactaaactggagggcacttactgtgtgtgggacgcagactgctcacttaagccccctgtgcttcagtctcctcatcttggtaaacaaggattatactagtgcccatttcaaaaggttgctgtgaggatgaagtaagctagtatgtgtagtgtggcaggcacatagtaagggatatgtggatatttgttgatcttactgtgtggttgttgttactcctcccccancccctaaccacaancacctg

SEQ ID NO: 720963 - DNA, 229 bp, Homo sapiens
gagctgactcctagaggatcccctggatcttcccgggggtggtgtgtaggtgtgcctgtgtaagaattgggctagggcatttgaaatcctagagcgaaagcctataatcacgtgcgcccgctcatcacggggatggccatggctatcgtttatagcatatcgcgggctggttggtgtctcatcgagtgaggcatggagatccgaggtatggttagttgtgagtcaataa

SEQ ID NO: 720964 - DNA, 781 bp, Homo sapiens
gggagggccttcaaggctctcatcgctgctcagtacagcggtggctcagtgtccgcgtgctctccgtaccacccacttccattttggccaaaccaaccgcaccctgaatttctccgcaaatttcctgcctggcaaggtcccagcatttgacgggtgatgatggcattctgtgtgtttgagagcaacgccattgcctactatgtgagcacattgaggatgctgcggggaagtactccagaggcagcagcccaggtggttgcagtggtgtgagcttagctgattccgatatagttgcccccagccatgtacctgggttgtaccccaccttgggcatcatgcaccacaacaaacaggccacttgagaatgcaactgtgaggaacgtgaggcgaattctggcggctgctgcatgcttacttgaagacgagtgcactttcctggtgggcgaacgcagtgacattgggctgacatcaccagttcgtctgccaccctgtctgaggcctctataagcaggttctagagcccttctatccgcccatgccttatcacaataccaaccgctggttcctcacctgcattacccagcccacattatctgggcatgtctcgcggcgaacgtgaacctgtgtagcaaaggatggcccagatcgactgcgtacacacagtttgccccagacccgaacactagaaggcaacaccacggacaccgaccgggtcacgggaccacgaccccgaagcccccaggatgcaccggaccgacgagcaaacaccgcggtgctcctc

SEQ ID NO: 720965 - DNA, 154 bp, Homo sapiens
  misc_feature (4)..(4): n is a, c, g, or t
  misc_feature (79)..(79): n is a, c, g, or t
attnggacgaggggaatggaatgctgtataagcactgaaaacaacaacaaataacactaaaattttaggaactctgaantgatctgcctctaacagcgttggatgtagcattatggaattaggattttccttatttgcttcattgtactacctg

SEQ ID NO: 720966 - DNA, 177 bp, Homo sapiens
  misc_feature (79)..(79): n is a, c, g, or t
  misc_feature (92)..(92): n is a, c, g, or t
  misc_feature (163)..(163): n is a, c, g, or t
ctcttcgtgagatacgccgctgagtcgagtgaacggcacggtagcgtcacactgattaatgttctttattaagtcaggngtctaagaatgtntagcgagataatttctaaactgcctaccgcaatgtgtttgttgcgaccgggcaggacgtaataagctatgnaaagggccggctcg

SEQ ID NO: 720967 - DNA, 269 bp, Homo sapiens
gtcgacgtctggtggttggtttgtttgttaaatctgtgttggtctgtgggtctcagaatctgcaagttctactttcagctgctcttaaataaactaacagacttactcttcaaataattagatagttacaaaaaaccccagcaaatccccatcacattaatggggggaaaacacttcttatttataaattcatgctatataaaatttcctataatagagtatgcaatgtctggcccatactagtactccaataatagcctttgttattg

SEQ ID NO: 720968 - DNA, 303 bp, Homo sapiens
taagagctatctgtataatgattttttttcccccatataagaaatgaaatcatgggaggccaaggcaggaggcttgcttgaggccaggggttcaagaccagcctgggtaacatagtgagagctcgtctctacaaaaacaaaaaacaaacaaacaaaaatggctaggtgtggtggcacacacctgtagtcctagctacttgggaggctgcggtgggagaggatcacttgagctcaggagtttgaggttactgtaagctgtgattgcatccctgtctccaacctgggtgacagagccagactgtt

SEQ ID NO: 720969 - DNA, 304 bp, Homo sapiens
gctcgacaaatgtggtatatataccccatggaatactatttggccattaaaaaaactaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaattaaaaaaaaaagtcgacg

SEQ ID NO: 720970 - DNA, 604 bp, Homo sapiens
  misc_feature (380)..(380): n is a, c, g, or t
ggcattcttctagctggggcaggggggccgagatgtctcgctccctggccttagatgtgctcgagatactctctctttctggcctggaggctatccagtttacttcaaagatctaggtttactcacgtgatccaggaggggatgcattgtcaaatctcctgaattgtttatgggggggggttccatccatccggcattggaactcggcaaactgaagaaaggttagagaattgtttcatcttttcatcataaacttgtttctcattacggtctagggttttctgtctcttcctctacactgcactcacccccacgggagcaggttcgtagcctttacgttttaatcatgtgtctttcttcctgcctctggtagctggggnggtgtcgcgccctgtcagcatgatgaggatcgacctgtatgattccccgttgtggattcgataatcttgaaatcccctcctcagccgggtttctgcgatacgaccccacgtaatgatctactcgttgttattcagactgcaagcccttacatcagtcctcctcttcaacatcgaatcttatgacaaaaagtgtatgtaaaactggatatgtttttaataacgtc

SEQ ID NO: 720971 - DNA, 642 bp, Homo sapiens
ggaatgatcctgtgagtatcaactcagtgtggatgatcatttgtagatagtctagtgctatgcggtgacagttgcctatgcgctcctagcgtaactatgtcggatgcagcaacgttacctcatgcgcatctgccaatcacatccgtggagaatgcccctatggtaggtagacggctgttcttcaggtactctagccagctcttacatacgaattttgcaatccgacgtaatttcttagtgtgctagccaactctatgttggaccgagcgcaatggacatctgacgcgggatgaacatgtgctgtttgaaattagtgaccatgcctagatggacttctgacatcctactctgcatcggagtggcacagagacaggaccggtcttggcacacaagggacttggctatcacaattagtgtccgatgagaatgatgccaagatcctcaatgatgagcaggatcgctttgaggtcaataatagtgagctgccagatgagaaagacatctcctcctacattgaacagacacggtagaagactcgcccattatggaatgtgaccgtctgtccttcaggagagacacccagggtgggggtgaaggagacactactgcccccacccatgacagcccccaccccatggcttc

SEQ ID NO: 720972 - DNA, 457 bp, Homo sapiens
  misc_feature (160)..(161): n is a, c, g, or t
  misc_feature (262)..(262): n is a, c, g, or t
ccccggggttcccctccccaaccaccccagggcccggagtttttttttaacacgggtttgggttggacccttgctcgggggcccaccggtgggaggaaatgggggttgcccctgttattgtttacatgggccccccccccctgaaggaccaaattttttnncccccccctccaggggagggtttggggtgggccccttatttggttggggaggaccagggccctgggcagggcagggcaccctttcccccgtgtgaaaaaanagggggtttttctctccccgccccctcgcggggttttttaggaatattaaaaaagtttgggcccccttttggggaggggggggcaggggggggggggctcctgccccaaaatttttccctttccccggggggccccccccccccagggccccctggggggcctttgttttaaccccattaaaaacctgattttta

SEQ ID NO: 720973 - DNA, 421 bp, Homo sapiens
aatcatcagactccttgaactcccccactctgctggctctgtaacccagtgcacctccctccccagctccggagggggtcctcctcgctcctccttcccagggaccagcaccttcaagcgctccagggccgtgagggcaagaaggggaccctccaacaaggagcttcctggctcttggggacccaggttggacttagcagtgtagtatttgaagactcttgggtgatctctctagaagccatatggacctcctccctcatatcatctctgcacagcgcaatcccctttctctgagaagcctcttgagagctctcgtgtttgtagactctggacatctctctcgcgtctgaagagcctctagctcgcctcgaccactcctctccccctgttaccacactctctctcgagtgatggtgtctcc

SEQ ID NO: 720974 - DNA, 315 bp, Homo sapiens
gtattgtccacacggctgtgatcccagctgacaaggaaactgagaggggacaatcgcttgagaccgccagagctggttgctgtgagtcccaaaatacgagcgcgctcgttagctccacacatgggcgacgggagcacagtctccgtactcgtatcatacctaaataaataacagtgtggccgcaaagagcacacgccatttccacgcccgcatgactgacccttcctaccgctctctgttgacacgacacggggccatctttgacaaatgcaaacacactctctgcaggaggttgtgaggttcaatttactggat

SEQ ID NO: 720975 - DNA, 392 bp, Homo sapiens
gtatagtcataccatggccagtagatgggaagacacaacacagagtacagatgtcgagtcttccatagatttgctgcaatacctatcaaaatcacagcatgatttctttctagatacagaacatgtgtatgctcaaatttatctgagagagacacaggaactagaataaccagaaacaattttgaaaaagaaaatcaaggggcaatcatcagtgtacctgatttcaaagctcattatcatagctatagtaatcaagacaatatattatcagctgggggacatacacagatcaatgaaatagagtcgaaaatgcaaaaacagatgaacagatatgtccaagtgattttagagagaggtgcaaaaacaattccatggagaaaaaataggcttat

SEQ ID NO: 720976 - DNA, 371 bp, Homo sapiens
  misc_feature (20)..(20): n is a, c, g, or t
  misc_feature (30)..(30): n is a, c, g, or t
tttcctgcaacgactcacgnaacattgtanacatcaaaggatcgccatggaaagggtccctcctgctgctgctggtgtcaaactgtccgtccagacgtgccctgccatcgtccggggggtgccgatgcaggacttcagacgttgacgcccgcgtcgtccataatccatactctcctcaaaagtcaggatcgatacgttaccaggcggggtcattacaagcctcaacagtgcaacttctcctgcacccgaagacagacagccacagataatcgattcgaccgtatcgatatggtctgaatggctcgtatatcgtccggagtcggttgcagaagccggagtatcatcaagtgtgagagaacaaggtttggatg

SEQ ID NO: 720977 - DNA, 453 bp, Homo sapiens
ggcctcccgaagtgctgggattacaggcatgagccaccgcgcgcagtcacacttaaaagtcttcttaaaaagaaaatcagagacaagttttgtttcctagtcttgtaacaaaatggaagttgctacactgagtttccgtttaatttatagttaattgccttttaccatgccagcactaggaaaagtgtagtgagggatgagaccgccatggagtcatcgctgcctggggagagatgtactctggcatttgtcgggatgtcgatggctgcccctgggacaacagggatccctcatgcctctggtgaggaagaccagccaataactggatgttcaacagagctttgcttcttcccaaattgttaatggtgatttttatagagcctaaaagtggcatccttcagtgacattccaagtatcttatgtaacacttgaaggtttacacagaggggaccc

SEQ ID NO: 720978 - DNA, 668 bp, Homo sapiens
  misc_feature (393)..(393): n is a, c, g, or t
aggagtcatggtgagagccgcagccgcggggcgcatatcgcgatctataccgggacacgtgattgcgatacctgggctatgccaatgaggtgggcgaggctttccgctctcttgtgccagcggcggtggtgtggctgagctatggcgtggccagctcctacgtgctaggcggatagccatcgacataggcaagaaggctggagaggagcccagccctgaagcaggccgcatcgccagggtgaccgtggctgaggtggacacctttgtatggcatgctctagcctatgtggacattccgggctataccattaaacgcacgtgtgctgcctctatctatgtcctgggcactgccacccgatggcccctggatgatcgcaagtggaccaccaccgngcttgggctggtgaccatccccataattatccacccgattgacaggtcggtggatttactcctggactccaggctgggcaagctctaaccaacatgggggaaagccagcttattcagaacataatctgggaccctggcctagagaaaggacttctgcttaatgagagactcctatatctgccaggggatggggacaaatgggttcctgggggacaaagaccctggccaatgggcggggtttaacctggccaaaaaacttaaaaaaaagggccaaa

SEQ ID NO: 720979 - DNA, 453 bp, Homo sapiens
cccacgcgtccgcggtggaaaggggccaaaccgggcttcccctggacctccactttataaaggcaccttattccccctccactgagcacctccaccccttgtcattctaattccccttccccacgattctcttaaaatcactgccccttgggaatgaggatttccagcataataagcttgaggagagaaacaccattccaacccttagccaactaccactttttctgaagcttaggataatccccatatacttaaaccttaccaagattgtgggggtgggaggagctccaatcatttgtaaaagtagttgtaaataaataccagccaacccaattctatacagtttttaaagttgtcccagccttgtccatgttagttaccattttagaaagtaaatttgattaaatatatcattcccagttaaacccatttaaagatattttttcatcccca

SEQ ID NO: 720980 - DNA, 424 bp, Homo sapiens
ctggctggctggtccccatggtcttgctaaattgactatgtacagaccagctctgtgctggctctctatctctccccactttattttctattagtttcagtgtttctggttttatgtgaaagtccttgttctacttggacttgagctttgtacatggagataataatggtcaatttgcattcttctcaaacgctgactgttcaaccagcaccatttgttgaaaaccctatcgttttccactggatggttttggctcctttgtcaaaggtcaagtcttcataagtgtgtggattcatttctggatcttcaattctcttccactgatacacttgtctgtctctgtaccaatccgattagacattatcactatttattgttctgtagtatagcttgaggtcagggatggtgattcccccgtcgacgc

SEQ ID NO: 720981 - DNA, 214 bp, Homo sapiens
tgcgaaatgttgtttgatatacgatggaatactatttagattcagaagagaaggaaatcttgtcattcgcaacagcgtgaagaagcctggaagatactatgttaagcaaaataagccaggcacagaaagacaaataccacatgatctcacttacgtcgaatctgaaaaagttgaattcctagaagcagagggtcgactgcttggattacaagga

SEQ ID NO: 720982 - DNA, 143 bp, Homo sapiens
  misc_feature (24)..(24): n is a, c, g, or t
accaaataataataatgctatacntaaattacttgtgaaaaacaacacattttaaagattacgtgctcttggtacaggtttgtggatgacagtttattcgtcatgctgttagtgtgcattctaaataaatatatattcaaaca

SEQ ID NO: 720983 - DNA, 404 bp, Homo sapiens
  misc_feature (2)..(2): n is a, c, g, or t
  misc_feature (197)..(197): n is a, c, g, or t
  misc_feature (204)..(204): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (222)..(222): n is a, c, g, or t
  misc_feature (224)..(225): n is a, c, g, or t
  misc_feature (228)..(228): n is a, c, g, or t
  misc_feature (233)..(233): n is a, c, g, or t
  misc_feature (257)..(257): n is a, c, g, or t
  misc_feature (276)..(276): n is a, c, g, or t
  misc_feature (279)..(279): n is a, c, g, or t
  misc_feature (288)..(290): n is a, c, g, or t
  misc_feature (293)..(293): n is a, c, g, or t
  misc_feature (295)..(295): n is a, c, g, or t
  misc_feature (316)..(316): n is a, c, g, or t
  misc_feature (342)..(342): n is a, c, g, or t
  misc_feature (391)..(391): n is a, c, g, or t
anttagaaaaaaaaaaagtggggagagaaaaaagtgacagcgctctttagaccaaggacttagaagagaaacctccacccttccggagcacgtaagtcccttccctctctcactgcccaacctccctgggcttccagagcaagaaaaggctacgtcccccgtcgaaggagagtcgacggtgaaggtgcctggaaacngccaganaaaagacctagncngncnanntcnccgtngaggacactgtccagcacacccanacggggtccacccccaccnccnccccccccnnngancncccgaatgaagcgaccccgcnctgattggaagatgaacttctgaggnaagggcccatgctcccggagaaaaccccagacactgagcagcagcagangcaccttgaaagg

SEQ ID NO: 720984 - DNA, 199 bp, Homo sapiens
  misc_feature (17)..(17): n is a, c, g, or t
ctggcaaggcatatgcnatattgcaatctcagacaacaggcaaagtccaagagttggtgtacaggctgctgaagatctatagagtcccatgatgtctctactcaagtggtctccgtcgaaaggtgatcgtctcagacacggttgtcacgggcagcttttgctgcaccgcgagtcttctcccccttctgtcgtcttctcg

SEQ ID NO: 720985 - DNA, 121 bp, Homo sapiens
gtgtcatcccccttcgtgctaccaggagtcatgcatatgccgactccaagacatggagataacgtgatagacagactgtccaccatctgaaacttcattcaacaacattcggataaacctt

SEQ ID NO: 720986 - DNA, 214 bp, Homo sapiens
gccggtacccttaggaggctgcagtgcactggcgctatcatggtaacttagctttgactcctgggctcaatccatcctcccacctcagtctcccaagtagctgggatataggcatgagccaccatgcccagccagtttttgtgctttttgtacagacaggatcttgccacgttgcccaggcttgtttagaactcctgggcttaagggatccacc

SEQ ID NO: 720987 - DNA, 432 bp, Homo sapiens
tcaggtcctactcttccatcatcactacttcctgatgccttcatttctacggctcccgggactcgagaatgcgacttaacagagagttcttttacaaacgagatcaaaacagagacactgactttttggctaaagtgactttttgcattataatgctttgttggattttaaaaattcagggaaaaaatcggcagaccattagttactatggattctattttttttcctttcaaacactgtacggaaacaatctattacttttttccttataaggagaatttatagcactgtaatacagcttataatatttttagactgatgtacatcgttcaccttcagtagtctattaaggcattaatacttctctggacattcgcgtttgagggtggaggggtcctgtaaggtgcttcatcgtctgtgattactgcttgg

SEQ ID NO: 720988 - DNA, 760 bp, Homo sapiens
gtgaagaccccaggccgcccgttgcactcttcccctttcacttgggtgcccctgggccacccgcaccacccccttcagcagccatctggggccagcaccctgcgcccccacccgccttctaccccacactccagccacgatggcgagcacccgcagttagctcagtcatgtgagggagtgtcccagtgcgtcgcactcatgtcttgcttcccatcacacggtgcgcccatcaggtcaccctctgctcgcatcgccaggattctgatgccacctacggtatgatgtgcagccactgtcgcaagacgttcagctcccggaaaaactacaccaagcacatgttcatccactcgggggcagaagccgcaccagtgcgccgtgtgctggcgatccttctctctacgcgactacctgctcaagacacatggtcacgcacaccggcgttgcgcgccttccagtgcgccgtctgcgccaagcgcttcacgcgagaagagctcgctcaacgtgcacatgcgcactcaccggcccgagcgcgcggccctgcgcccgcctgcggccaaggtcttctcgcaccgggcgctgctggagcgccactggccggtgcaccctgtgccctgatggcgctggggcctggctcgcccacggtggatccggggcctcccgcacatgtcggccacgcgcgctgcgggacccgtggttccccgacactagacccgctccctcctgagctgcaggtcctctctctcccttcgccctttctcca

SEQ ID NO: 720989 - DNA, 110 bp, Homo sapiens
tagcttatattaagagttacatatccggtattttgagtccgtccaactttgttatttttcataattgtttaggctattcttagttcttgtcatttccatataaattgtgg

SEQ ID NO: 720990 - DNA, 422 bp, Homo sapiens
ctggggctttcgagttgctggagattacggcgtgcaccatcacgccagctaattatagtatgtatagtagagacggggtatcccatgtgggacaggcgggtcttgaatctcactggacctcgtgaactgcccaccttggactcccaaaaacgctggggttacaggcgtgagcaaccatgtcctggatccgcatattctcaactaccaagcggtatgctctcgtgggatccttcagaaaacatgaagtgtcactgctctgctgtatgcctgccagtctccccatctctcctctccgtccatcatcataccttttccagcctgtcccttgtgcagttcttggctcaccatctgagtatctatgagactgcttaaagtctctctgcctggaactaaaacttgcaagtcgaaagccccaagcggga

SEQ ID NO: 720991 - DNA, 555 bp, Homo sapiens
ttaaacgcggtggaggagacacaccgcgcttaaaggacccaatgtactgtaggatcacgtacataatgcttactagtaagccctggatggaaaaacttacctggcggaaataagtgtatagtcccacatatagccggacattcctgtagggatggatttagtacgaggccaaatatgtgcacttgcccatctagtcagatagctccttcctgtggctccagatccatacaacactgcaatattcgctgtatgaatggaggtagctgcagtgacgatcactgtctatgccagaaaggatacatagggactcactgtggaacaacctgtaagtgagagtggctgactcaatggaggaaggtagtgtggaccccaatcgatgtgcatgcacttgcgaatttactggaccccagtgtgaaagcgataacaggacaggcccatgtttaactgtgatcagcaaacagatgtgccaggacaactcagagggattgtctgaacaaaaaagctctgatgtgccacagtcggccgagcctgaggcacccctatgagatgtgtcct

SEQ ID NO: 720992 - DNA, 180 bp, Homo sapiens
gctacagagttcctggaatgattgctgcagattgtgggttagacttctattttaatatatgggctgggtacggtcgtcacgcctgtaatcccaacattttgggaggccgaggtgggtggatcacttggggtcaggagttcgagaccggcttggccagcatggtgggaccccatctctact

SEQ ID NO: 720993 - DNA, 162 bp, Homo sapiens
acaggtaacgtaacgtctttaagtgagtacgtgtcgcttactttgtacctgtcatcagagttagatggagatggcggtatatagggtagagacaagaggtggtgaggttgatcggggtttatctgattactgaacaggctcctctaggttaggtctacctgg

SEQ ID NO: 720994 - DNA, 862 bp, Homo sapiens
agcgggctcttccaagatggcggcgcgtcgtcgcgagcgaccgggccgacggtggaggccagcgaatgccgacgtaaaaccgccgcccgggacgaacgactgaatggatgcagttgccgccgtttggcgagtggccctgatgcagttttcgctgctgctactggctgttgccatgaggcgaggctaggtgatggacctcacttccccggggtgtaatagtgttaactgaggccagtctatcctactagtggggatggggaatgccttggtcagttgtcctttttctgataacctttggaccctttgtaatattccatttgacattttatatcctctgctttgtgggtgggggtaataagtggttactctccgtgtttggaaaaagcaagagcgtcaggagaagtaccgtagaacagtgttgaacacgtcatttcttcctcaaacatcacctggggttcctaagatgcttagaagacatgaaacggggaagccaggactattaagattgctagaagattgacgggtgccaatataattgatgaacctctccagcaagttatccagttttccttgagggattatgtccagtattggtattatacactaagcgatgatgaatctttgcttcttgaaattaggcagactcttcaaaagcgcactcattcagtttgctactagagtctcgcctgtcgcccaggctggagtaccatggcgcaatctcggtcactgcaaccttccggttcctggaaccctgtattgttttaacaaaaaccttgggtctcactgtgttctcctagaatatggttacttttacattctggatctgaaatttccgggaattgtgggaggatttgaagaaccc

SEQ ID NO: 720995 - DNA, 863 bp, Homo sapiens
  misc_feature (795)..(795): n is a, c, g, or t
  misc_feature (799)..(800): n is a, c, g, or t
  misc_feature (812)..(813): n is a, c, g, or t
  misc_feature (818)..(819): n is a, c, g, or t
  misc_feature (827)..(827): n is a, c, g, or t
  misc_feature (840)..(840): n is a, c, g, or t
  misc_feature (848)..(850): n is a, c, g, or t
  misc_feature (857)..(857): n is a, c, g, or t
agaagatgggacagagaggatgggaggttgtctgagcctttcccggactgacggaacctgtgtcttctctcttttgtggacaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccaggtaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagtaacactttgggaggccgaggcaggtggataacttgagctcaggagtttgagactagcctgggcagcatggcaaaaccttgtctctacgaaaattagctgggcatggtggtgcacgcctatagtctgagctacttgggatgctgaggctgggagaattgcttgaacctgggaggcngagnntgcagtgagccnngatcnngccactgnactccagcctggntgacagannnagactcngtctca

SEQ ID NO: 720996 - DNA, 423 bp, Homo sapiens
tggatcccccgggctcaggaattcttctcgagagagagatatagagagagagagagagagagagagatagagagagagagagagagagagagagagagagactctgtgtctgtttttgtgtgtttgtctgtgtatatttctttcttgttttggttatattgctctctcctctctgacttcctcttgctctctttatttcttcttcttgtcttttaccacctgccccccttgcgcctctccccgtcaccctgtgactctctctttcttatgccctcctccacctttcctatctgccttccctctcttccgcttttccctatttatctatttctcttcttccctttccacacttcccttcctctttctctttttcacttccgctgtttcctttttcttttttctttttttctcttccctttcccc

SEQ ID NO: 720997 - DNA, 892 bp, Homo sapiens
  misc_feature (824)..(824): n is a, c, g, or t
  misc_feature (828)..(829): n is a, c, g, or t
  misc_feature (841)..(842): n is a, c, g, or t
  misc_feature (847)..(848): n is a, c, g, or t
  misc_feature (856)..(856): n is a, c, g, or t
  misc_feature (869)..(869): n is a, c, g, or t
  misc_feature (877)..(879): n is a, c, g, or t
  misc_feature (886)..(886): n is a, c, g, or t
aagcctgtactcggtgggatgacggctgacagcacagaagtcactggggcctttcgacttctacacactccctgtgcgctccgcactgtgcccgtcacctgagagcctgtgggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccaggtaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagtaacactttgggaggccgaggcaggtggataacttgagctcaggagtttgagactagcctgggcagcatggcaaaaccttgtctctacgaaaattagctgggcatggtggtgcacgcctatagtctgagctacttgggatgctgaggctgggagaattgcttgaacctgggaggcngagnntgcagtgagccnngatcnngccactgnactccagcctggntgacagannnagactcngtctca

SEQ ID NO: 720998 - DNA, 331 bp, Homo sapiens
  misc_feature (60)..(61): n is a, c, g, or t
  misc_feature (177)..(177): n is a, c, g, or t
  misc_feature (272)..(273): n is a, c, g, or t
ccactctttcattaatttgttttaagccccgtgttagaaaaaaggggtagtgcatagtgnnttgaccttcatacgcttttaaaataaagcaaatggacttgataatgtacctttatttgatctcaagttgtataaaaccaataaatttgtgattctgcagtagtaatcttatgcacncggtgatttcatgttatatatgcaaagtaggcagctgttttgttagttacagaagtttcaagcttcgcttttgtgcagtaaaaacaaaagtaggnnacagtgtgtgccatgttgatgtacagtttctgaaattgttttacaagactttgataat

SEQ ID NO: 720999 - DNA, 512 bp, Homo sapiens
  misc_feature (8)..(8): n is a, c, g, or t
cttcacangtagcccagggctatagcccaggcttacagtgattctggtgtttggagtcatgagtcacactacatgcccctgtgtaattggtgacatcccaatttgtccttgagtaataaaagcatacatttcactgtctggttaaacttgtggaatttgttgtgctaaaagtgttatgctttcctaatgctttatatctctgggctcttaagtgtccacccaaaactcaggcccctagcatttgttcttttctcttgtcaggccagactggggatagatccccttgctttcttgtcttgcagatttcgtggatattgatgctattggaattgaagccttcatgtctgaattattcatcaatcatatatagaaatttcattaagttttgatcctgatctttattctgtggccttacttcttagccccacttgttttgggggtgattactctgagatagtttgtatacaatcaacctatctgaaaataaagataattttactccaaaaaaaaaa

SEQ ID NO: 721000 - DNA, 210 bp, Homo sapiens
aaagtggctcttatccgcatgactgtacgatgagccggattccagctgaccagcgctcgaggctacgcaaaatgtgcttatcgccgtgattcgacatcacccgggaagagggtgtccttacactgtggcggggctgcatccctaccatggctcgggccgtcgtcgtcaatgctgcccagctcgcctcctactcccaatccaagcagttct

SEQ ID NO: 721001 - DNA, 80 bp, Homo sapiens
ttagagtgcccctccggcctcgcatgaggtcttcctgtcgctcccggtcctggtggtggttctgtggatcgtcttggaag

SEQ ID NO: 721002 - DNA, 359 bp, Homo sapiens
  misc_feature (22)..(22): n is a, c, g, or t
  misc_feature (225)..(225): n is a, c, g, or t
  misc_feature (281)..(281): n is a, c, g, or t
  misc_feature (347)..(347): n is a, c, g, or t
cagacaggcatttttagtctcngtgccagtggaaaggagatctccactcagccgtgggtctctctttctataggatcagcttgagaaaatagccttgccattggaggaatacacaggctgcctggtacaagactgtctgaatttgagatgccagcaatttaggaattaactaagaatgttgcctctttagaatttaggcccatgagatattgcagttgaccctgnctgcagggaggaaatctcttgacccatgggaagtagagcttgggtgcagcctttcnctctggaagaagagaccctagtttactgctggcttcattggttcaatgaaggttaaggccaggcgnaggggatttcat

SEQ ID NO: 721003 - DNA, 125 bp, Homo sapiens
tggctgtgggaggaggtgatggtcatgggtggtgacggttgtgggacgaggtgatggccgtgagaggtgatggttgtgggaggaggtgatggttgtggaaggtagtgatggttgaggaaggaggt

SEQ ID NO: 721004 - DNA, 741 bp, Homo sapiens
aaggtctgaaaaaataccacgtgtatttctctgaaatgaaagtagtcaatgctataaatcttctaatcaagaattctacgatatcatcagcagcaggtgcagcccatatggtctgtctgaagattctactttcctggaccttaccactggtgactatgatagcactcataaatcctaactggtaagtgggtggttaccgaaaatattttccttattctggggacatgcttattagcaagttttaggcgttatgatgtaagcatagtgcagagcaagatgggaaatgattcatttctcccaactgctctctattatgggtgggtggggcatttagagtcccccgctataatccagaaagtctccttactttgcaatttggacttgtccttgcatgtgttctatgctggtcaagtattttactggcagctgcatctcaaggccatctgcaatcaagaagtgtgtctaagattggcaggtgtaaggtgttctggtaaatgaagaggacaaggaaggatttgccttacaaggagatcccttcttggcttaccgtggcagaacaggttcccaatgcatgatcgtcctgcctcgacgagctggatggtatgcaaatgaggacgtgcacggcttgatggatgaattggggggcgcaaacagtttttggcgctttatggctcagtatttaaagtggacacttgctctttaatccggccaaagtgaacggcctcttggttactgctgggt

SEQ ID NO: 721005 - DNA, 440 bp, Homo sapiens
aactagatctcagaatggacagacctgatgttggacattataaacatggctccatcagcatgagttctctaccatgtcgatggccagctacagacgaatgcactgtcgtttagagcttgaggacagacatctctgtgaccgcggatgaggcagtcccatctctgaggacctatacgatgttcacaggacaccatactgtgtgaagcacataagttacagtagtggaccattcatgtaacagtacgcatggcaacattttgactatatgctccaagaacgtgacgatcatatagacagttagttgatgatgcagatgctgactgtatcaatcatacggactgacgatgacaacggcgtgctgccatgtatatcatcacctgtatgcacataggcagattagttcagagcttgatgatatacatgcctcgctttatccgtgc

SEQ ID NO: 721006 - DNA, 491 bp, Homo sapiens
cgcacagccgggctgcagggaggcagcagtgcagccaggtggtcctgtttgggggctgagagggttcagcacagcaatcgatggtttagtcgcaggtggatcagggaggttagagctgtcaccatagaagagggcagagacatgcttttcccagagctgggagaactgggctggactcttagaagcaggtaaggtgggggacgtaggcttaaagtccccaccagatttcttagcacttccattagccttgcaaaattaagatggcgggagacattttgtcagacaaggcggtcacatgatcaacccacagggcctggcaacatagcccttctgagaatacttcactcaaagaaaaccaaccagacacagttcaaggcctgagctaagtcttgtggtgctctactggccctggtagaaaccccccatgtacatagcaaaggatggacgggaaaggaggaatgtgagaatacatttgtgagaggagtcccatc

SEQ ID NO: 721007 - DNA, 449 bp, Homo sapiens
agcatggataggatttttaaccaatgaaaattgaggtgagtaggaaaggtccccttccaagtgaaggaaaagcaaaagcaaaataggaaaatgggtgtatagggagtgttaacctaaggatggaattggagataagactagagaaggtgggttgaaggcaaattgtggatgcttttaaatgccatagaactgtttatattgatttattctctggagagtcattgaagtttttttgatcacaggaataacatgtttagatagtaaatgccaacagaagtttctcatctataatcagtagcactaaactcttggtttgaaaaatatttagtatgggtaatacttggagtatcagttttcattaaaatgtacattggttatatacacttctggtctgatgtgttacctttttaaatatgcttatcctgctgaataaagaccatccaacctga

SEQ ID NO: 721008 - DNA, 1023 bp, Homo sapiens
  misc_feature (205)..(205): n is a, c, g, or t
gcgccaagaaaccgattgaagacgcgcggcagcagaccgcatacctgtcatcgagtaatacgatatctgtcctccatcatggacctgaatcttcgaatcgccggacctgggcatggcggacagcacggcccaaacggatgacaactacaggtcgttgcgctgcttctggaagcgaataggccgaattgcagtttacatttcgacnagtacgtgtggcaagagactgctacaatccagtaaacacctggcgccgacgcacggaaagccattgcgctcgactggcagagctctcgagtctagacttcacatatacgcacatcgaacgtcggtcgtagacaccgagcatcagacacatagggctaggtcatgcgtgggacgacgtgacgcgttgtgaccatgaacgaactcggagggagcatgtatccatcaggatatggtcccatctcatggaatggtgcccgtgcgcagacgcgtcctgaaccattccaaggggtaccctagcgactgtgcattcctggtcaccattatcttcgcaattgacatctggaggcacagggaccggctcctgcttattgtgggcatgcactgactggacgggttcgaatacgatggagtcccagaaacgtctaccattcctgatcgtgtggcctgaggccattggttggaacccggcctccacctgtagttcttctcgtggtggtcccttcatcctattgctggttgtccctgcatacgcaatttgaaacccccaacgtagtactttttcaccctagaatgattcaaagtggaggggaggagagcccccacgtcaagtcgtcgcacgccaggtaaccccgcagtgacatccagtcgtcttctcgagagctggtagccggctagcgttggtgcgaattgcctgagggggtcaaagggtttcttgggcggttccctgggatgtcgacgttgggcaatggatgtgccctgaccctactgtgccctccttcataggggcgtcgtggtgttacttggttcggtggcttgtgg

SEQ ID NO: 721009 - DNA, 292 bp, Homo sapiens
tgcgatgctgatctagagtatcccgaggaggagtagtggtgatggcagtctctaaagctgtcttcaaggaacagaaacaaggagtggggaaacggatgtagtgaactatggcggtcagctcaggttctctatttatgtcgcagtttatattactggtttcagttcaggataggcacaaaccaggctatctaagagtcgcaaagtatcccaaccatgcgctaggatgtagaacggtgttggggctttgacgacgatcagttcagtacacgactcagtcagggcagttgcacat

SEQ ID NO: 721010 - DNA, 127 bp, Homo sapiens
agcgcgtcggcccgttcaactaagcactctactctcagtttatctgctaaatcctgccacgagccacacgattgagccacgcgaagagccccccacgatgccacgcaaactgagccgggtacctgag

SEQ ID NO: 721011 - DNA, 709 bp, Homo sapiens
  misc_feature (10)..(10): n is a, c, g, or t
  misc_feature (46)..(46): n is a, c, g, or t
  misc_feature (59)..(59): n is a, c, g, or t
  misc_feature (61)..(61): n is a, c, g, or t
  misc_feature (65)..(65): n is a, c, g, or t
  misc_feature (93)..(93): n is a, c, g, or t
  misc_feature (110)..(110): n is a, c, g, or t
  misc_feature (115)..(115): n is a, c, g, or t
  misc_feature (121)..(121): n is a, c, g, or t
  misc_feature (123)..(123): n is a, c, g, or t
  misc_feature (125)..(125): n is a, c, g, or t
  misc_feature (143)..(143): n is a, c, g, or t
  misc_feature (158)..(158): n is a, c, g, or t
  misc_feature (170)..(170): n is a, c, g, or t
  misc_feature (208)..(208): n is a, c, g, or t
  misc_feature (226)..(226): n is a, c, g, or t
  misc_feature (251)..(251): n is a, c, g, or t
  misc_feature (267)..(267): n is a, c, g, or t
  misc_feature (286)..(286): n is a, c, g, or t
  misc_feature (299)..(299): n is a, c, g, or t
  misc_feature (355)..(355): n is a, c, g, or t
  misc_feature (360)..(360): n is a, c, g, or t
  misc_feature (382)..(382): n is a, c, g, or t
  misc_feature (385)..(385): n is a, c, g, or t
  misc_feature (388)..(388): n is a, c, g, or t
  misc_feature (402)..(402): n is a, c, g, or t
  misc_feature (445)..(445): n is a, c, g, or t
  misc_feature (453)..(453): n is a, c, g, or t
  misc_feature (488)..(488): n is a, c, g, or t
  misc_feature (520)..(520): n is a, c, g, or t
  misc_feature (605)..(605): n is a, c, g, or t
  misc_feature (619)..(619): n is a, c, g, or t
  misc_feature (621)..(621): n is a, c, g, or t
  misc_feature (643)..(643): n is a, c, g, or t
  misc_feature (649)..(649): n is a, c, g, or t
  misc_feature (699)..(699): n is a, c, g, or t
tatcattcanattttattaccatggttttcccatcttctatctaanagtagcatgcaanancttntaaaatgctttattggaaccaaaaaatnttgcgcttaaagcttanaaaanaaaaanancnaaagctttctttcaaaancaacaattgtcttcnccatccccaccncattggaactgacatgatgaaggatttgaaagtttcanaacttaactcagcgaacncagtagtacatttagtattggttanacaacatttgtttaanaaatgcaatgaacaaagcnacacaggaattanatattgaagcagaaaaggtggttttacagtccctgcattaacccctaattcttacnacccnggccaaaaaagcattttcaccnccngcnctttccttcctgtnttcttttggttggttctttcttctcaggctttctcattctgangctgaaanagttctgttcacttagcaacttgggacagtaacanagggtttgttctgtactttcttttccaccccnccccccaccgcaatcctcagtccccttcctaggaccattttctactcctagcattaagaggactcatcgttatatacttggaganggtccagttctgananagtcccctggaagactcaattntacgtnaccctcatgatttcctgttaattccactacggctaatgttctaggaaganacccttatct

SEQ ID NO: 721012 - DNA, 364 bp, Homo sapiens
gtcatctctcgtatagtatttctctcatcatcatatataatatagattagatgtggtgtcgtcgtgcgcgatcatcgtattatatagaagattatgagacaacaccaccacatcttcatcatcatcacatcatagacacgcgcctcgtcacatcatcatcatcatatgatgagtgtgtgtgacgactctctctgctgtgagacgacacacacagagagacacacacacaccgctctccacacacactgtgtgtgagagagaaggtatactactatatttgtctccacactctctactactctccacacaaaatattgtatattttttattaataaaaaccctctttaataaaccacaaaaaaaa

SEQ ID NO: 721013 - DNA, 209 bp, Homo sapiens
tccctaattggttcttcgatgacgtcgtggctcggtggaaacgaatctgaccagcgtccatgaggatgcaggttcaatccctggcctcactcagtgggttaaggatccggtgtgcagtgactgtgatgtaggcccgtggctacagctccaatttgacacctagcctggtaactttcatatgccgcaagcgtcatcgaagaaccaattag

SEQ ID NO: 721014 - DNA, 282 bp, Homo sapiens
tatccctgagagaccgtgttgcatgtcattaaggagagaaggaagagaagtaagcctgaggcgatctttgattgtgtagtaagggtggaaggtgattttattggaatgggaggtgatcctagggggttgtgtgatcccgtttcgtgcaagaataggaggtgaagtgctgctagggttgcaataatgaagggtaagatgaagtgaaagtgtaacgaatcgtgtgaggttgggcactggtctactgagtagcctcctcagattcattgcaacacggtctctcag

SEQ ID NO: 721015 - DNA, 397 bp, Homo sapiens
  misc_feature (4)..(4): n is a, c, g, or t
ctcncgtcggcgctgaccccccatccacacacccgtgggaacactgggagcctgcactccacagaccctctccttgcctcttccctcacctcagcctccgtccccgccctcttccggcccaaggcgccggcccacccttcccatcgccgccactggccgcggggaggacatggccgcgcacaggccggtggaatgggtccaggccgtggtcagcagattcgacgaacagcttccaataaaaacaggacagcagaacacacataccaaagtcagtactgagaacaacaaggatgtctaaatacataattccaaatacaaattatatatagttataagcggccaaaactacatacttttaaaagaatgaaaacaaaatgagaatatttggaaaagatga

SEQ ID NO: 721016 - DNA, 640 bp, Homo sapiens
catgaaccccatggttaatggactggtcaccagtttgttattttattcctccatgaatctaccttgtccacttgagttgatcttaagttcaaggcctcactcttgtctgtctcttgtatactcggttacatgtgtgttatcttgtgtatgatagagctgtaagtgatggcattttttcaaacagcctgttagcacagccgcatgcctgattattgtatactggcgcggacagggttcccctgtccattctagagtcagtatataagggagtagaaggctgcttgtattcctggtattggtaaccttcagttctccctgtaagacctcctaccaacatggcgacgctatacaccaatacaggagatgggtagactgcctgtcataggagacctcgcttcgcagagtgtagttcccttcccaatattattcactccagatattagccacagtgcacaaaagcaaacctgtctagtacgagccagtgaacaccacagcttctctcccagctaggtgcctttaacatcgggtttgttctccttccatggtgtgtagcatgacattgtcactagagtcccatgtgaagagctggcgagtattacctttcatctgtaccatgctcatagaatacgacccggatagg

SEQ ID NO: 721017 - DNA, 164 bp, Homo sapiens
ctgggggttgtagcgcttttctttttcgttgttctgttgatttttggttgcgcgtctggggggagagatttactgggatgggggaaggacgcttcggtgttcgtggactttgatgggcgggcgatggggagcgcgacaagggcggcgccgggacccgggatccc

SEQ ID NO: 721018 - DNA, 301 bp, Homo sapiens
gtgtactagatgacgtgtgctggctagcgcgtattattcctgattacacagtgatgctgctgtgcaactactaatgatatactagagccaggcacgccgcgcttattacacagcacaaagggtgagctctacggtgagccatggggtgctggtgctgccacagaaagctctggaggccaagagagcagagatgagcttggtcatcactcatctcccagggttctgattctctgaaagaggaatgagccccttggggtcaggaaacagaacgccttttttcctcttagaaacacagcctccc

SEQ ID NO: 721019 - DNA, 349 bp, Homo sapiens
gggactaaatgtgtcaccaccacactcagctcatttttttattttttggagtcagggtcctgctctgtcgcccaggctggagtgcagtggcatgaacacagctcactgcagccttgacctcctgggctcagatgatcctcctgcctcagcctcccaggtagttggaaccacaggcatgtaccatgatacatggctaattttttaatctttttgtagagatgggggtctcactttgttgccaaggctggtcccaaactcgtgacctcatccgagtctttggcctcaggccagccccggcccctcgccctcaggccttctttcttatccaaataaatgtttcttaatgaga

SEQ ID NO: 721020 - DNA, 169 bp, Homo sapiens
attgaggatctggcacaccccgcttacgggaggtcccatattgatgccgaacttagtgcggacacccgatcggcatagcgcactacagcccagaactcctggactcaagcgatcctccagcctcagcctcccgagtagctgggactacaggcacgcgccaccgcgcccg

SEQ ID NO: 721021 - DNA, 104 bp, Homo sapiens
gtcaccctgaagaccctccagcagcagaccttcaagatagacattgaccccgaggagacggctgaaagcacttaaagagaggattgaactctgaaaaggggaaa

SEQ ID NO: 721022 - DNA, 447 bp, Homo sapiens
acggggagccttagaggtctttaactcatgtggtctcggctgcttctctatcgttatgctctattagcgcctcggaaataggtattcacttgctctttgaactgtcagtcaagatctgaagactaggcttttcctggacagcctcagacaaacacaacaatcgttgtaggtcatttgcactctatctcaggccataggttgcagtttgcttctaccatggatgcctaaaggctgcgaatgggatcctcgatggtaactataggatctctcgaatgtcgaactcgttcctttgctgcattcctttttcttcacttacaagaaaggcctgaatggaggacttttctgtaaccaggaacatttgttaaggggtctaaagtgctaactaattaagctcaacctaggtctgacttatttaatggctttcataacacttaactcataaggtta

SEQ ID NO: 721023 - DNA, 147 bp, Homo sapiens
  misc_feature (59)..(59): n is a, c, g, or t
  misc_feature (108)..(108): n is a, c, g, or t
agctcggtaccccttactttcacgtaatacttctttcccctagtcagtccggtaattgnctttgatgtattcttatatccggatatcttgactttctttgttgtgctngaggtaaaattcttattggtcgaatatagtacctgatag

SEQ ID NO: 721024 - DNA, 124 bp, Homo sapiens
tgtaaaactgactggccagtgtaaaactgacggccagtgtcacacgacggccagtgtaaactgccggccagtgtaaacctgacggccagtgtaaaacgacggccagctgtccaacgccggccag

SEQ ID NO: 721025 - DNA, 1569 bp, Homo sapiens
  misc_feature (158)..(158): n is a, c, g, or t
gagagagagagaggccagcgcacgcgcagtccgggagcggagtccgcgcccgacgccgacatgccggacagctgggacatgtatgtgtaccctgtagcccccgcgccggacgccggtgcagctccaaatcccattcgtcatacatgattgaaaagcgnttcgatgcttcattcgttgttacctgaccgcgtgactccttcggtgagacgaagtttatacgagcggcaggcaccgagcaatacgaagcacggtagttacctatcgtactcaccgctggcaacgtagccagcctagcagtgcctaggagcattcagctggatgttgcaaccggagggacgagacactcattgctgcattagtacttgtaaggcccgacgaagtgccaggtgtgatagtagccggactaccaaccgttctgacccgaaggcaacactttgatcgaagcaatttatttgcacgcgagtcggtggctcgaaaacgctcgtgatcgaagcagcgagtgggaaacgggactggaatgttagccagagcagcgaaatcttgttatcacagaggatatcgttaggaaagcaggtctcgacacccatgggtagtgaccgaggggccttacctcgacgggaccggcttattctagagaacccttgtcgggggcctcataacggtttcgtagccaagggtaaacgctgcccttgtgggcaaaacaaccagaagaggctaagaggagtaactcgcgtcgtcgaaacgcaggaaggcatcagaaggcttggccttcaaaaggagggggcccggagcggccttaggctcaacgcctttccccttgaaagggggccaacgcgttcgtgagggattgccccccccgttggcattgttggtggggcttccgtgggttcactagaaccctcgttttgggctgcgcaacattttataacactggcccgctatgacaaaaaggcctctggaacgattacacgaacgcgactcggatacagagctgcgcgtgtaacaaaaaactagagtgtccccggaaaggcgggaacctcttcctatatgtgccaggagcgcgtgcaccggcgggagaagacaacacactgcggcgatcctatgtacgactgcatgcttgtgcggctcttttccggcagccaacagtaagacggtatagtctctgctgtatgagaaacccaccccactgtgctcttattgtcggttgttccaccgaagcgggggggacagcaaatctcagaccgaacggggagctcctccccccagttgaagcaggcggacttgcgcaacacttgatatatacgcgcgaaaaaagagggcacagagtctttaccggtgtagaatgaatgagcagtctgcgtgcctgctactgtacctaggacaacactcccctgctacatggagaaatcctcgtcagctgtctcatggcgacctaccaatcaccaggtgagcagacgcgttgtacccattgaagtaggcagaaggattatgcaagcctgcatgaacactcgtgactgtccgatctgacaagcattcatcacacaatatagagactgacccacgcacaac

SEQ ID NO: 721026 - DNA, 355 bp, Homo sapiens
actaaccatcctggcccgggctgcctgtctgacctccgtgcctagtcgtggctctccatcttgtctcctccccgtgtccccaatgtcttcagtgggggctcctggctggcctgaggctggccggaggggaaggggctagcaggtgtgtaaacagagggttcccctcctctgccatcacctgaagacccccacgccaaacactgaatgtcacctgtgcctgccgcctcggtccacttgcggcccgtgtttgactcaactcagctcctttaacgctaatatttccggcaaaatcccatgcttgggttttgtctttaaccttgtaacgcttgcaatcccaataaagcattaaaagtca

SEQ ID NO: 721027 - DNA, 198 bp, Homo sapiens
gcttaaagagctttcacatcagtactctacagggagaagacgagatcgccccgattagttttgagagtaaatcgggtaccagaggaagagctaagcaacattgccaacgcccttgccagcgccacttgcgagcgctgcaagggcggctttgcgccccatgagaagatcgtgaacagtaatggggagctgtacccatgt

SEQ ID NO: 721028 - DNA, 1428 bp, Homo sapiens
aaccacgacggtgttgtgtaccaccacaagaaaagccgactgaggcttggtggtatacccccgggtttccccgcgggagaatttgtgcctcccgcggcgaagttatattttccttgtcgggaggtccccccaccgcgcgggttttctccctgccgtgtgaacacagtgcccgtttgtggtgtgcccgggggacacagcccgctgttgtgggcgccgcagaaatcgctttttgaagtgtatttgtccccccctttgtgtccctggggcgagggacctggtagagagagttgttagacgacgagaagaaatgttgtttggacaaacatgtgtcacagcaccgcggtgttgtccaacttgttggagaagagttccggaaagattggtggccacaaaaggggtctccccggaaaccccttggagatgtattgttcacgcccttgtgccccccctggcggttgggagatgttcccaatgtgggaagaatgggtcagaaatccgagggcccacgtgttgtgacgcccaaagggactcccggggggagaggaaggaaaattttttcccccgttgctttggaatatgctttaatagtgaagccgcaccccacacagggggttgcacgcctcttttggcctgtgtgagacacttgtcggttatttttgacaccacgcgccttctcaagaggggagaggggccacaccagcggtatacacccaacagttgtttggtgtcgccccacaaagttttgaggaggcgagaaaggattttcctcttcttgtggtggggggccacctcacaaaatggggagattccccccctctactctcttgggtgagaacctcccataggagattcgccccgcacccccacatctcccgcgtattcccccccgatggcctcccccctcactatcacaaagaggtgtagaatgtagttatccacctttctcagaggttgtaattttatagagagatctcggccacacgagtgtattctcgagtttttcactccacaattttccgacacacctggtgataaccctcgtgtaattggtggaacttggaaggtggctaaccctataggaaagaaatttggttgtgagtgcaccccaccacgaggaagagggcacccctggattcttttgaacctggttcacacgtgaaaagaaggcccaatggccaccacgctttgccacactcgagactttccacaccacatcttttgttatattggcccagggcacaccaaccactggagtttctcttccccgcagggaaaagggtaatccccctcacccacttgctgaaagaaaagagaccacaaaagactggcggcccaaacacgaggcacagtgggtgaaaatgggtccctgggtgacctagtcagatctttgtacgtaatttaaaatattgtggccggatttatagccca

SEQ ID NO: 721029 - DNA, 879 bp, Homo sapiens
ctgcctgtacttccttgatatgtattagaccccctgttcaggtgagtacttgccataatgaacccacggctccaatcgtgcccaagagaccctcgctaacggaaatatacatacctttccataatcacctcacccaaaggaggacggtcacagctgacctacttgacactatatgcggcttcatcagaaactatcaaattgtcttcccaaacttctagaccaggatgtattcaaaatctaaagtgctcagcgatggtaattatattacagacttaaatccctccaccctcagctgacattatgcatgcatgtgatatcgtataacatgcacatattgattatcgatataacaacattcagacgactctgccgataacttactccatagctactaaattttctcttaataagctcactgaactgtttcaacatgacatgtcagccgattgcttaactgtatcactgacctgcgccctgtgctaccattaagatattgctgataaactacgtgcggatatctctgcgactaaggcatgccacataagtaatcctattgcacctggattttacgtggtactcactacccttctatctgaccttctgaagaccatatcatcggatcacgagattccccgtgcactcgaactaggttgaacctgtgcattgaacagaagaatctaatcagacgtgcgcgcaaaaaacttcagacttttctgtctgctattacacagaatcctgggttgggatcgttatgggctgcatgacggattatgccgatcctcaaggcctactctgaacacagggtgataattgataaagcattaaagggctgttgcttcccggcgatctctatactttccaggacaaacgccgaacccg

SEQ ID NO: 721030 - DNA, 296 bp, Homo sapiens
  misc_feature (75)..(75): n is a, c, g, or t
  misc_feature (153)..(153): n is a, c, g, or t
  misc_feature (156)..(156): n is a, c, g, or t
acgtgctgggagggggtggtgttatgacgggggccaaggcacgcggggtttgagtgggacaattaggagctttanatcactgagaaaagaagaagaacaagctacagagacacaacccattgtttatggtgggcccgcgggggatgctgacancangacccagtgttgccgtccctccccaggcaccttttggttatggttataccgcaccaccgtatggacagccacagcctggctttgggtacagcatgtgagatggagcgctgatcctgtagtcacctattttggggggggga

SEQ ID NO: 721031 - DNA, 261 bp, Homo sapiens
ctcatagactgcgcgttgttaccgggtattgtaagaacaagtcgtacgcaaagtctcgcttctgccgagttgtccctgatgccaagattcgcattgttgacctgggggcggacacaagggaatcgtggatgagtttctctgctttgtggccacatggtgtcagatgaatatgagcagctgtcctctggagccctggaggctgtccgaatttgtgccaattcgtacatggtaaaaagttgtggcagagatggcttccatatc

SEQ ID NO: 721032 - DNA, 142 bp, Homo sapiens
ggatttggcattccgttccgtttttgccaagcactcccgaaccagtcctttagcgtgaatgatgccgcgcttcagcctctccatggcactcttgctccctgggtacgtgggtttgataaaaacatttggaagaaaatgccta

SEQ ID NO: 721033 - DNA, 191 bp, Homo sapiens
  misc_feature (14)..(14): n is a, c, g, or t
  misc_feature (21)..(21): n is a, c, g, or t
cggttggtcttgcngtctgangggtggcagaggcagaaaaaaaatccatgggccgagcacggtggctcacacctgtaatcccagcactttgggaggccgagacggacagatcacaaggtcaggagattgagactatcctggctaatatggtgaaacccgtctgtactaaaaatacaaaaaattagccaggt

SEQ ID NO: 721034 - DNA, 264 bp, Homo sapiens
aactatgaccatagctcactgtggaggaataacatcataatcctacctgtcatagctatttgaatatttcaaacatttcaattgaaatagtacatcttatgaaaataacacagtcaatgaaatgatactagaagaatatatctaaatgcaagcatgagaaatgtgaaaactcaaaacagcctgacccccagcaccacatagcctaaccccacttcctgtcagttttctacttcgtgatgtgcccactgcctcttctgtcgacgc

SEQ ID NO: 721035 - DNA, 395 bp, Homo sapiens
ggccaaacaattgttttaataatgtcaattcaaagttacagataatttcagaattcttaaatccataattaactcatcactttctttttgccatttctcatcaggctggaagaatttcctgaaatcagacttctgtttgcacctaaacaagcctttttttacacaatatagtcttttacttaaataactttttgtagaatactctactgtcaaatgatattaactgaacagtctgttcaaaccaaagggtactcaaatcataatcattacagagatattttaaaatatctttatcatgtaatatttaatccatagaaacatgtaagttataaagcatatattaaaacatcatccagcatccattcagttggagaaatgggacatcggcaatacca

SEQ ID NO: 721036 - DNA, 546 bp, Homo sapiens
tcagacatctagagagctcccccgattatagtactatgagcccgggtcacgcgtgagatcctactccggactcgagagatagcatcctcagagagtagatgtagcgaagcaaattactaggaaaatagtcctacaatcatcaatttcccaacaaggactttctcagcgagcagatcttgctagtagaggaaccggctccccgagatggtgcgcagccatctgttgtccagctgctcttgaagaggttccgagcctcctgcaggcggttggtcaggttgtcctcccggaatgaccatgtagtcgctgatgctggccaccacgaagatgatggcaagtcacatcgttgaagcactggatccacctgcggcgtacatcgcgctggacacccacgtcaaacatgtggaagttgactttgtccacctggaacttggtctcaaagattccagcagtcaggacacggcagcgaagcaggtcctgaatcgctcggaacatagtcagcctgcttcatcacgtcgatcttgtccaggaagtactgggcacagtcaa

SEQ ID NO: 721037 - DNA, 119 bp, Homo sapiens
tggtcggtaccgactacaagggcgactcctaggatagtcagtagaattagaatggaagagtgagagtggggttccaacttgaagcttgcgggtgatcttctggccaattgatggggaac

SEQ ID NO: 721038 - DNA, 254 bp, Homo sapiens
gcgatccaacgccgctgactgaagtcaaatacgttctcgacctactagcaacatctatactcttgcctccaacagtatgtcaatcaaatccatgtcctgctgggacgggagtctccggcgagcggcagctccaagtccatcatgatgagctgtggaccgtgtgttggggctcccagatagcggccctgttccggctgccgaggcgcggcgcggacagaggcggctcaggtggcggcggcggcgttggatgcagt

SEQ ID NO: 721039 - DNA, 268 bp, Homo sapiens
gcacgaggctactcaggaggctgaggcaggagaaccacttgaacctgggagatggaggttgtggtgagctgcgattgtgccattacactacagttgtactccagcctgggcgacagagacaggctctattttaaaaaaaaagaaaaaagaaaagcagaatgttctacacggatgaacctgcctccttggtagctccctacctctttacccaggaaggaggatgggggctggtgattggcccaaatcaggaaagtgtgccctgaccttt

SEQ ID NO: 721040 - DNA, 283 bp, Homo sapiens
aggctagcaggcagatcatctgaggtcgggagatcgagacccacctgcaccaacatgtagaaaacccgtgtctactacaaaattagccaggcgtggtggcgcatgcctgtaatcccagctactcagaaaggctgaggcaggagaatcacctgaacccgggaggcagaggtcgcagtgagctgagatcgcaccatttcactccagcctgggcaacaagagaaactccatcgcattaaaaaaaagggtagccttcccttaaggaaaaaattagttaacccggtgt

SEQ ID NO: 721041 - DNA, 626 bp, Homo sapiens
gatccgctaaacacagtcgttcggccggcgcggcaccaagtcctctgaccgtgagcagtgtccgtacgcctgtttcactaccgcggatgcctggtcatcccactgaggtgattgggtatccgtcagccgaattagataagataccagcacgggggtcacagcgcgatgctgctactggacaccgagaattccgagagtcggaagttacttggacccgtcgttacctggtgatttcctattcttcaaatggatgtcgcacagcgccgaaggggtcagactaattcgaacagttactgcctcgcgccacttgttcacaaaaggatttccctatggtggggcagactgaagggccccaggaaggccaaagaagaagggccatccattcaacccctgtgaaatgtaaccccaatcagacgccacgggcaatcgggtccaaccaacgtggagagaaccgcaccatttgtgagacaacaattcgttgggacacccaacgacctttttcttacaaaaatgaacgcttggcacgttgtgggggcctccccactgtaggaaagacacccccccggttgtgctttgcttgagaccagggaggggcccccctccctggaaaccccacaaagggccaa

SEQ ID NO: 721042 - DNA, 237 bp, Homo sapiens
  misc_feature (13)..(13): n is a, c, g, or t
  misc_feature (103)..(103): n is a, c, g, or t
  misc_feature (216)..(216): n is a, c, g, or t
ctggaaacgagantcttaattgaggagatgggagactcgaactctagccctggatctgccttcctgctgaaacttgttccacctcagtcccctcatctgtcanacgcatgtggggtggagtagggagatgcggggagcagggtgggcagaatactgttatctatgtacggggagtcgtgaggctgaagatgaaaatgggggttaaaaatgcctgcngtgctcaccagtacaccaaaa

SEQ ID NO: 721043 - DNA, 913 bp, Homo sapiens
caagtggaaagagaaacacttgtggacttgtcctctgacctccatcttcccaccatggcatcctcacccacatacacacaataataggtacatatttttaaatgcagaacttcagattcactccaggtctgcttctggagtcttcctcttggtaagattccggcccttggggacattaagcttccccggtcccacacttggcttagtttgttcttgctcggttgctcatgacttagttcacactgagcatttcagaagaacatatactgagataaaggcatttttcattttcttgtgtcaataaagtacccagtggacatacttcatgcttgtcatgcttgaagggacatagcagcccatgcatgttatgtgagtcattaggtatgcaaaagggggtgggggtgggggaagaaccgggatgattgtaagaaaagcgagtgtgccatttgaactctgaaagcaggcatatttttgctaaatttggaactctttaaactatgataacttatcttgattttcatgtggttcaaaatcgcttaaaaatagttgctaaaagatagtatgctcttgacctccagattcaaattatcctaaactgagatttttttccccagtgatttattgtcaggaattctgtccctttaattatttttatattttaagtataaaattaacccccaaacattaactttcctagccttcttaggctataatacaccttctattttccacacttgaattcgccccggcgttttcctctcacagacttgcgaagcatttttccctctcgttcttcaacaggcagcctttttccccgcgctgtgcccacggccttgggaactccccttcccaggggagacctgtcaggaacacatttatctgcggaaacaacccctttaattcacacggcgcc

SEQ ID NO: 721044 - DNA, 314 bp, Homo sapiens
caggattactccacaaacagtgtatacccgtggaatgtggtaaacttatagtgtacgcagctgcatcatttatgaaggagaggggtcacgcttgattcgggaggatcctattggtgcgggggctttgtctgattatgggcgttgcttcgtagtagttactggttgaacattgtttgttggtgtatatattgtaattgagattgctcgggggcctaggttactgtgattaggagtagggttacgactgcgtgggaagacacgacaagacgaggacacgtaaagtttaattatgcctgtttgtggaggtacgcact

SEQ ID NO: 721045 - DNA, 535 bp, Homo sapiens
aggctggatgagctctacataaaagtatcggtgaattattgagagctagacagtcatcctcagagatgtgagacctcagtcccagcgtaggataatgagggtgttcctatcggaaaaggcttagtccagctcatacttagagatgtatctttcaacaccattggccaggtgctatcaggtcatctgtgtcaggagcaaagccagtcatcatggatttgtcctctatagtcttagttttgtccgggtctccccggtacctggtacagatctcaaggatcatagtgttcttggcatcctgaggcctcttttctgtttccggtgctggttttatggtgaccttgaggtcgaatttattacaggtgagttgatctttggccttagcatgatacattgtcaccaccgagaaggtgccttggccttttccttcagctgtgactgtaaaaccctcattttccttggtctcttctgatcgcaggaggctggcagattcccagtggatacggtgggtgatcttggagctacgttctgctgagaa

SEQ ID NO: 721046 - DNA, 107 bp, Homo sapiens
cgaaagcgaggggagagcctgcactcagagggaggtcttctgggcatttgcagcaggacatttgctacaagaagaggtagtggtgattgtggggcttagggatgagg

SEQ ID NO: 721047 - DNA, 1162 bp, Homo sapiens
gtttgtattttgcctctggtcgtgccttttctctgcgtttttctctgtttcctttctcctgttcttttttgctggttgtgtttttgctttttcgtgtttctgttttttcctctcttcctttttgtttttctccttgttgtcttagtcatattttgcctccggttttggccatttgtgcttggcactgatgcttccgctgttgtgccatgttccgttgttccgttgtttgcatcgtcttctgtgagtgtgtgtcgtcattggtctccggttcctctcttcctattgggttcccctattggggttgctcgtttcttgtgctttgcacctttctgggccttcgtcttcggggctctgcattccgtgcgtttcccgcccccttgtttgagtatccttgtgtggtcgtgtttcttgtgttgtacaccctttctagttcgttctttggtgtaccctggctttctacttctgtcaggcccctccaagccgttctgatcctgtctgcatccgtgggcatcgttgttgatgtgctttttttccgcaagtctgtgaccctggcctctcctgggagatcgttttctgtgtctacctctcgcctatagtcctgatgaggggatcgtgttctgacccctctcgtatcacgtgtcttccgtgacaatcttcccctagataccctgtgggcaagttcttccaatattgacacctggaagcagtccatcccagcgcactgcgcatggggcactgcctgccctccggcgtgcccgctaggggtcacgtgctcgccaatggagtctcgatggcgttcagggatggccaaacgtcaccgtctccctgattgctctacccaccacaagaccccgcccacgggggcgcacaccacccatgagatggccagcaatcggaagtgtagcaaaactgcacagcaagtcagcagcacacaggcgccaccatcctgcagcctcctccttgaccacaggacgtttccatcaggttccatcccgaaaatctctcggttccatcgtccaccctggggcttctcactgacccagtccccgtgccccgcactccaccagaaatcaggctactctcctcggccccactcacatcgggctgaggaagcatcagcagcatcttcaaacatgtacatataacgactgggtatatacaa

SEQ ID NO: 721048 - DNA, 760 bp, Homo sapiens
  misc_feature (104)..(104): n is a, c, g, or t
  misc_feature (154)..(154): n is a, c, g, or t
  misc_feature (259)..(259): n is a, c, g, or t
  misc_feature (324)..(324): n is a, c, g, or t
ggcggacctcggctctactgtctttctgttagaggttactgctttatatgtaagtgctaactcagcacagtctacatcacatagtaagagctcaaaaaattagntattactacaacgattacactactgctgctgctgctattattactgtganataacaaaaggcagaatggttaataagacaattttttttgtgaagtcttaaagcaatatacatttttttcctctgacaagatgcagaccgatggaggaacagaanaaaactgctgaaccaacccataaataatgcaaataattcagagaaaagagtatacttgtacaatntgtacaagggacttagcagggtcttcagtgctggcccaactagctgctgatcttctgaatgtcactgtgaagggggaaggactgaaggagccttgacagagtagcaggcagtggcctagggtggtggccaaaggctactcgagtggtagggggctttctccttggccacactgcacaccagactgacctgatgccctcccacgctgtcttggctgtcaggttactccagcaattctgtaaatcccatggcagtctggagatgagactccttaaaccactggtttactgactgccttgaaaaagacacatttacaatgggatttggagccaacaaagggcttaaattctagaatgccacttatttttagtgtggccttggatgggttttattttatgctttttttttgacagagtctcactccatcactcaggctgg

SEQ ID NO: 721049 - DNA, 725 bp, Homo sapiens
  misc_feature (65)..(65): n is a, c, g, or t
  misc_feature (79)..(80): n is a, c, g, or t
  misc_feature (99)..(99): n is a, c, g, or t
  misc_feature (150)..(150): n is a, c, g, or t
  misc_feature (306)..(306): n is a, c, g, or t
atatatgcatttattgaaatgtctgtaagtctctttccatcacagagtttagcacattgaacgtngctgggtgaaatcnngggtgtcattgacatggtnctctgacttatcctttcctataaatggtagtcagatcggagggtctgattntgtggcaaaaatacttctataggtggtgctgggtacttcttgttgcatcctgtcaggaggcagataatgctggtgcctctctattggtaatgttaagactgctgggtgggtttggagttcttggctttaatcattcattacaaagttcagcatttnacctgatcgtttcagtggtcattgatgatcattgctgagatccacactataattaggggcggcagaacaggtgtttttctaattctgctatccctttggcatttgttagttggaattcttctataaaaaacataggccgggtacagtggctcacgcctgtaatcctagcactttcggaggccaaggcaggcagatcacgaggtcaagagatggagactatcctggccaacatggttaaaccccttctctactaaaagtacaaaaattagccaggcatggtggcacacgcctgtagtcccagctacccaggaagctgaggcaggagaatcgcttgaacccaggagacagaggctgcagtgagccaagatcacgccactgcactccagcctggcaacagagcgagactccttctcaaaata

SEQ ID NO: 721050 - DNA, 438 bp, Homo sapiens
  misc_feature (137)..(137): n is a, c, g, or t
  misc_feature (159)..(159): n is a, c, g, or t
attctaatctaactttatctttctagtggatttattcataccagttacattggtagagttgtctttcattgttacttaataaatgggtagtcttgttaatttaaattaaaattttaaaaatggagaaagaggatganaaagccaataaggagataaagnccagatgactgcgaaatcaattctaactttgtaaatctctaatcttgagatgctacatggcagatgagtgaaacatttcaggtctttaaggcgatatttattcaaaaggctgctttttattttataacagctttattaagatgtattttacataccatacaatgcatacatttaaactgtataatttagtggatttaatatatgcacagatttggccaaggtgctggggttgcaggcgtgagccaccacatctggctggtagtggacctttatggattt

SEQ ID NO: 721051 - DNA, 430 bp, Homo sapiens
  misc_feature (125)..(125): n is a, c, g, or t
  misc_feature (379)..(379): n is a, c, g, or t
cggactcagcccacctgcacccaggtgattaaaagctttattgctcacacaaagcctgtttggtggtctcttcacacggacacacatgaaatttggtgccgtgactcggatcgggggtcctcccnttgggagaatcaatcccctgtcctcctgttctttgctccgtgagaaagatccacctacgacctcaggtcctcagaccgaccagcccaacgaacatctcaccaattttaaatcaggacctacccagtctgccctgctcatacttgatctggatgagactgataccctgcgaagaccgcaacagaatcagctcctgggattgtgttagcagaatgaccgggagtgtggagatccaccacatggcgaggcaacccangaacctgttttcttcttgaagagcaaccggggaactaatttccaaggttta

SEQ ID NO: 721052 - DNA, 131 bp, Homo sapiens
tgtgtcgagtaagaataaacaggcactagtcgacacgatgtcagtaagagtaagagagagagagagtgagagcaacgcccggtggaaaatggggaatgtggttttgcagggtctgaatttttttcgtgttt

SEQ ID NO: 721053 - DNA, 273 bp, Homo sapiens
acacgccacgtagaaggtatatggaggttcctagggctaggagtcgaatcggagctgtagacaccagcctacgccaggccacagcaactcaggatgcgagctgcatctgcgacctacaccacagctcacagcaacacagatccttaacccactgagcgaggccagggatggaacccacaacttcatggttcctagtcggattcgttaaccactgagccatgaaggaaatttcgctccatctttaatggtgaatcccttctccggtggcgtggt

SEQ ID NO: 721054 - DNA, 620 bp, Homo sapiens
gccaggcctctgctgccctttctgtgccccccaggttctatctcctccgttcacaccctgatggcctgtgcttcagcgagtggagcggagcagccattctccagtgccccgtggttgcccctgtgacgtgtgcgtctgcgtgctccgcgggtggagctgcgggttgttgggatgcagcggcctcgtggggtgcctgaggccgtcctccagccccagctgctccctggccagcccccttgtctgcttgtcgtgtcccgtctaaccatgatgccttaacatgtggagtgtaccgtggggcctcactagcctctaacgtccctgtgtctgcttgaggcatgtggcctccccgatcccttccccggatggctgaagcccacgctgactccagtggacacgtggggtgtgctgctgctgctccccagcccaccagtgccgtggccatgccttggccccttcgcctggacatgggctgtgtgagattggctcctggcggcttgggcgagagccaatattgccatagctcaggtcacctcagtgccatccacggaggctgggtattgtcctgcctctgccttgtctgtctcaccgggcatgtgccgcagagccccaaagtcccctag

SEQ ID NO: 721055 - DNA, 349 bp, Homo sapiens
ttttctatctgactgctagggatactagtgtgtcgctcacacctcatatcctccctactgtgcctagaaggaataatactatcgctgttcattgtagctgctctggtggggcgtgaacacccactccctcttagccaatattgtgcctattgccatactagtctttgccgcctgcgaagctgcggtgggcctagccctactagtctcaatctccaacacatatggcctagactacgtacataacctaaacctactccaatgctgaaactaatcgggccaacaattatgttactaccactgacatggctgtccaaaaaacacataattgggatcaacacaaccaccgtcg

SEQ ID NO: 721056 - DNA, 759 bp, Homo sapiens
  misc_feature (227)..(227): n is a, c, g, or t
  misc_feature (245)..(245): n is a, c, g, or t
  misc_feature (247)..(247): n is a, c, g, or t
  misc_feature (371)..(371): n is a, c, g, or t
  misc_feature (475)..(475): n is a, c, g, or t
  misc_feature (502)..(502): n is a, c, g, or t
  misc_feature (527)..(527): n is a, c, g, or t
  misc_feature (550)..(551): n is a, c, g, or t
  misc_feature (573)..(573): n is a, c, g, or t
gaagctgacgaagtccctgtcggaagagtgcaggaggtggtggacacgtacggcagctccatcctgtccatcctgctggaggaggtcagccctgagctggtgtgcagcatgctgcacctctgctctggcacgcggctgcctgcactgaccgttcacgtgactcagccaaaggacggtggcttctgcgatacgtgtgcaagaagctggtgggttatttggatcgcaancctggagaaaaaacagcnanccaagcaggagatcctggctgctcttgagaagaggctgcagcttcctggccagacccttaccagaagcagtgtgatcagttcgtggcagagtacgagcccgtgctgatcgagatcctggtgganggtgatggatccttccttcgctgtgcttgacgaattggagcctgccccctcggcccataagcccttgttgggaactgagaagtgtatatggggcccaagctacntggtgccagaacacagagacagcagcnccagtgcaatgctgtcgagcattgnaaacgccatgtgtggaactaggnnggaggaatattccatcttgggnagaaaccacagcattggtttttttctacttgtgtgtctgggggaatgaacgcacagatctgtttgactttgttataaaaatagggtcccccactcccccatttctgtgtcctttaattgtagcatggctgtctgcaagggagcccctagcccctggagacatagctgttcatgcccctttacttcg

SEQ ID NO: 721057 - DNA, 105 bp, Homo sapiens
tccggcggtaatcacctcatggaaggtgtactttagggccactgggtcgtcatgggctcgctggtgctggtaccagtgaatatggccctggtccgcggggttgat

SEQ ID NO: 721058 - DNA, 1109 bp, Homo sapiens
  misc_feature (311)..(311): n is a, c, g, or t
gggcggactcaagccttggacactgtggagcttgacgaagctggcttcttgaaagttgagactagatgctagtgaaagcatgaggattgctgagaagctctatactcgcagggtacatcagactatccccgtaacaagattcaacggaatacatttgtcctcagatgacgtctaacaacatgacggttgtccgtggtgagacaactcagcatgaccctcgcgatccatgcttcgcgaggggctcgtttgccacagagcattctagacgcggggtggtcccaacgcctagcagccaactgggaacaatgtcntgaccaaaggcatcaatccctccccaattactactctccaagcgaagatacgaatcaactaacattaacacgagggatgagtgaagcatggccgagctgtcatgaggtatctattgtgtcgccactatttcgctggtcctttgcatgcatccaccagggaattgctccatgtgggggccatggcgatgatgcaacgaggtgggaaggaatccgaaccaatcggtctactaaggtacatcgcgttcgctcgtgctcgcattgagtccctccactcgatgtctcggccacgaggagacgtagtctcgcgaattgtggtagtcccagtaattgatccacctggaagtgtacaaagatcctcccctgttctattgaggccaaggtaagccccaagtattcaggtccagcaaacggggcgtgcccgattgagtgagattggggggaagaacacgatgcgcacaggacccatacagttgagcctcaacctgacgagtcacgacactcttcattgggcaccctccacttgggaacaaatgccagttagtgcggagtccggcgtcaccgtgggagattagcccatcgtttcagtggtcggagaggcgacaagttcgggaggatcccactcaaaaaaagccactcggaattcagctcacggtttgcgtatcttcgagccgcctaggaacaaagggcctggttttccctcacacttggcggataccccttgggggccatttagggagagtaggggtacaacgtgggcgatgagtctcccatcggggggcactccacaattggtcctag

SEQ ID NO: 721059 - DNA, 746 bp, Homo sapiens
  misc_feature (214)..(214): n is a, c, g, or t
  misc_feature (232)..(232): n is a, c, g, or t
  misc_feature (234)..(234): n is a, c, g, or t
  misc_feature (358)..(358): n is a, c, g, or t
  misc_feature (462)..(462): n is a, c, g, or t
  misc_feature (489)..(489): n is a, c, g, or t
  misc_feature (514)..(514): n is a, c, g, or t
  misc_feature (537)..(538): n is a, c, g, or t
  misc_feature (560)..(560): n is a, c, g, or t
agtgtctgatatcctgtcttgatcatctgctgtctgatctatcctgctgtctgatctatctgctggaggaggtcagccctgagctggtgtgcagcatgctgcacctctgctctggcacgcggctgcctgcactgaccgttcacgtgactcagccaaaggacggtggcttctgcgatacgtgtgcaagaagctggtgggttatttggatcgcaancctggagaaaaaacagcnanccaagcaggagatcctggctgctcttgagaagaggctgcagcttcctggccagacccttaccagaagcagtgtgatcagttcgtggcagagtacgagcccgtgctgatcgagatcctggtgganggtgatggatccttccttcgctgtgcttgacgaattggagcctgccccctcggcccataagcccttgttgggaactgagaagtgtatatggggcccaagctacntggtgccagaacacagagacagcagcnccagtgcaatgctgtcgagcattgnaaacgccatgtgtggaactaggnnggaggaatattccatcttgggnagaaaccacagcattggtttttttctacttgtgtgtctgggggaatgaacgcacagatctgtttgactttgttataaaaatagggtcccccactcccccatttctgtgtcctttaattgtagcatggctgtctgcaagggagcccctagcccctggagacatagctgttcatgcccctttacttcg

SEQ ID NO: 721060 - DNA, 658 bp, Homo sapiens
  misc_feature (645)..(645): n is a, c, g, or t
tccattgtaccggcacaagcgtgcgtctcggccaagatgcatctaaactggagtgatgtgagcagacccagcttagagttctacgttctttcttaagccctgtgctctggaggaagttctccagcttcagctcaactcagagcttgtgcaagcatcaccctgcgagtgctctgaggcgttacccataaatgaggtctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagccttaaacatgnaaagacgggtacc

SEQ ID NO: 721061 - DNA, 300 bp, Homo sapiens
taatctcatcaactgtactccaccctgggaggcacgtgcatgacactgtctcgaaaaaaaacaaaaaagcaaaaaacgcttggttctgatccacagctttgcttgccaacggcttcagtatacccgtggtcaacagaggtctgaaaatattaaatagaaaatcccgagtaagtaaagcatacaaatatcaaatgtaaatggcaggccagtctgagtagcaggatgatgtctcaaaccatcccgctgttctgcctgtggatgtgaataatccctttgttctggcatatcctgcactctgga

SEQ ID NO: 721062 - DNA, 710 bp, Homo sapiens
cgtggtgtcttcttttcttaatttgggggagggactcttcttctcgtcgccgaccattgggggccccattgctcgagtattctgcgcgtagcgccaaacaccccccccccggggggtcaacgacaagttgttttgcgcgacgccccccacacagttgggggatcaacggcctggtgcccacccacttcgccggcgcgaaatttttgttgattttttagaagaggccacgcgtgctcccccctgtttaccccaccgcgctggggttctcaaaacttctgtgcccttcacgccatttgccccccgcgggggtcctgtcataacacttctgggggtctcactgccggggcccccccctttgccccctgcgcccccagcgcgttttttaaatgggagcccccccttgctttttttaggccaacccggagtctatcgagacgcctcctcccggaaaatattacctttgtgattaggcgccacaaataatttttctccgtgtgcttgaagtaaataaaaacacgtatgtaacctttgtcccggtaaagtttaattattgacgtttattcaataaaataactaatactcttttcaaaaccactttttcttaaaggaccacttattattatgaataaaaagtctcctttttttttcccaagggaaaaaaaatgtgtttttttttttttttttaaaaaaattcccccaaccaaaaaaaa

SEQ ID NO: 721063 - DNA, 209 bp, Homo sapiens
ttttttgggggggcggtccttgggaaaaggggccccggggcccccccccccccctttttttagggggggggccctccattggttccggtctttttttttaggtttgggcccttgccccctttgtgtttcccgccctttatggggggcccccgggggggctttttttttttcttttttgggggtttcccttcccccccccccccccccca

SEQ ID NO: 721064 - DNA, 406 bp, Homo sapiens
  misc_feature (90)..(90): n is a, c, g, or t
  misc_feature (112)..(112): n is a, c, g, or t
  misc_feature (226)..(226): n is a, c, g, or t
  misc_feature (389)..(389): n is a, c, g, or t
attggggccctaggagatgaaatcactttttaaatttttagagatttttttttttaattttggaggttggggtgcaatctttagaatatnccttaaaaggccgggcgccggntgtcacgcctgtaatcccagcactttgggaggccaaggtggcggatcgcctgaggtcaggagttcaagaccaacctgactaacatggtgaaaccccatctctactaaaaatacnaaattagccaggcatgatggcacatgcctgtaatcccagatacttgggaggctgaggcaggagaattgcttgaacccaggaggtggaggttgcagtgagctgagatcgtgccattgtgatatgaatatgccttatatgctgatatgaatatgccttaaaatanagtgaaatccacccctg

SEQ ID NO: 721065 - DNA, 314 bp, Homo sapiens
tgcaattctacacttactggtttaagttggttatcgtcactgtataagtattataatagagctacttagctgtggttattaatacccttctgttaacaagtttgcaggcagattaatggccttgtctaacatagttcaacccaccaaagacctcgacaccatcgtgaccgtgaaaccgattatggatcatgcccacaaggatccaagctacgggctgcatcgaggtgaggggtgaaagggtctgtgctatgatcaaacaggcacggggtggccgatgtggcagaaaagtatgctgtggggagacctttgtgtag

SEQ ID NO: 721066 - DNA, 1258 bp, Homo sapiens
ctgctgtatcgtagctataccttctacagccaatatgaacaaggcctaagttaacagaaagcaagtaagacgcatgacctgccataacgcggctataaaatccaacaaaaaggttcgagaacatcagtcgaagaactcaagaaaggagcgctacaaaagcggggtcacaagaagcctaggaacagacccaggagcttccaaacagagctccctttaaggaggctctctctcaagggaagctgagctaaggaaacagaggcttgaagaactaaaacagacagcagaaacttgacaggcagaaggaactagaacaagcaacaagaaaacttgcacaactaatcctagatacttaagccatcaaatgtggaacctatggcaaccaggagtttgggcttcgcaacacactgagcaacacatagccaagctcgcggcaaacagaacttcaccagaagctgtacatgccaagaacttaacacaggtgattgaagcctccgatgctgtcctagcaggtgtaggatgccagcagatcctctaggtagcacgatgtccatcaggtagaacgaggccattgtccagagtggacagcacaaaagctggtaacttatattaacataaatcagatctggctaccactaggagacacctcgccacgaagcatgcgcataacactacactccgcacagaaacgaaataagccacaccagacggactcgctccagaagccctcaaccacagtacccacacggactacaccgggcaaccaattagccaaacgcagctgttgacagagcacacagcaactacactgctgcctccccacctacacatgaaacgactagtactgctactgcactcagtgtccaccaaaaatcggagcctcaggacacaaacttgcaatgtgaagcgctcctccacaagggtacatattggaccagccacaccgccatgacacagatttcggaacagttcaacatgagctcgttcccacacaactgtgtcgtcgtgctacccacactaacaactacatcttcatcgagactgctcgccaccaccgatccataaatggataatacatgctagacacgccatacacttagagtataataatacacagccacccagtactgataggtatacaatagagcaactaatatcatcaagcaaatataagataatcagaacatccgctgatcacccgataccactctatcgcactatgactccgtaagctcacctatcatgcaaaatagtataaacc

SEQ ID NO: 721067 - DNA, 179 bp, Homo sapiens
aattatagaatacgatgaaacacaatgttagtaggaataattcaggcttgcttgaaaagatgtaatcgataatgtcagcccgctctgttttccctgaaccaggagtctccagatgtcaacacagaagtagctgttcacaattgctcagttacctggggcatggtgggtcagaacataag

SEQ ID NO: 721068 - DNA, 234 bp, Homo sapiens
tggacatttgtcatgaaacagtctagtgtgtgccacccggcttaatacacagggcgtgatctggtttatactggcatgagcagtgagcaaagattccaagggcatccggtttcaccagcaagaaataagatggaaaaagtcttttggtaaagtgggtagcgggaaaatcacttaaaatttatattgcttggataataaggagggtggaatagttaaccagaagggggtgggggg

SEQ ID NO: 721069 - DNA, 132 bp, Homo sapiens
ggagtatataattaactgctagaaaatactaatacaaccatttctactgaactaggaaatacatttctaagaaagattttacatgatgccatcgctattgttttttttgagacagggtcttactctgtcacc

SEQ ID NO: 721070 - DNA, 1026 bp, Homo sapiens
taaaccctgcgtggccattccctgacgcaccgccgtgatgcccagtgcaatcacagggcgacctggatagtccaatctacttccttaatgatcactccaactattgtgatgattatcctgaaatgtttcacttgctgggatgcagacaagtgtgggctccagagcatgatgcagcaggatccgcatgtccctttcgcgggaaggctgtggtgctgatgggcaagaacaccatgatgcgcaaggtgcattccgagggcacctggacaaacaagcccatgctctgtgagaaactgctgcctcagtatccggggggaagtgttgcggcttatggtgattcaccaaggtacgtgacctcacgtgagactcagggacatgttgctgtgccagtaaggtgccatgcatgctgctccggtgctgtctgccattctgccccatgtgagagtcactggtgccagcccatgaacactggtctcgtggcccgcataagacctcctttttccaggcttaaggtatcaccactaaaatctccaggggcaccattgaaatcctgaggtgatgtgcagctgatcaagactggagacaaacgtgggagccagcgaagccacgctgctgaacatgctcaagatctcccccattctcctttgggctggtcgatccagcaggtgttcgacaatggcagatctacaaccctgaagtgcttgatattcacagatgaaactctgcattctcgcttctggagcggtgtccgcatgttgccaggtctgtctgagattggtaaccaactgttgctcataccccattctatcatcacgggtccaagagtccggctggtctggtgcacggttaccctttccagttgctgcgaggcagggcctctaggcagttcactgcattgtggtgagccctttgtttatgccacaagtgcctgtgtcttagccagaatgtagccgaaaacaggaaccaagaatgatagcataaaaaccaagaaaagatcactttacacagcaggtattaacaaaaacaaac

SEQ ID NO: 721071 - DNA, 332 bp, Homo sapiens
tagcacccagatgttaaccggcataaaaaataccccagtgttgctccagaaagttgaaaaaaaaagtgtatatcacgtcttatacggaacacagtgccgtgctagtttcatgccactgaatgcataccattgcgattcttcaagctcatttcgattacaattcacggagtgtatttttacggtgagggcttctagaactaacctagatcgaattcgcttagagctggactgcaagccccgtttatcagcggtcaccgatgaggcggaaacacatgttgttttaaaaggggtgtaacagatcactaggtagaccctgaaaacctgataaagcg

SEQ ID NO: 721072 - DNA, 85 bp, Homo sapiens
cccgggggggtttacccccccctttgggggttgcccggccggggggggggcccctgtcccccctttaatttttccccccttttga

SEQ ID NO: 721073 - DNA, 326 bp, Homo sapiens
gaataatggaacccttccggttcataataggtagtttggatatttttgtccttgatttgatgtgcctttttttggtataatgtttaaatcaggtatggtatgatattgtttaaaatccagtttttgtatcttggggccaagcccgcacccttttttatatcttttggttattttaagccctttccccccaatgatcctatcaattggcagtgcctttgtatagagaatttaagtagaaaagttgcaaatgttttgactgtcccccagccccaatatgtatgctttttccctagctggtagcataaataaaactgaatctcaccata

SEQ ID NO: 721074 - DNA, 150 bp, Homo sapiens
ataacagagacattacataaatggagatttgactgaagactttgttctttgcttcactcttcagagattccctctcaatcaagaaagtagtcttggatatttcctagtgtagcccctccccttcccctttgtatacgccacagcagaaaa

SEQ ID NO: 721075 - DNA, 634 bp, Homo sapiens
ctcggcggcaggcttgctccccgtccggcacgcctgctaacttccccgcgctagtcccgttcggccgcgcgaggccggcccgatcttcgcgcgggccctccgggtcgagtcctccaggagcgccaggtaagcgtgccggcgtgtgaccctccgccgggtcgcctgcgcggccctgaggcatctgcccgaactgcggcgctcaacgacgccacgtgggacccgcggcgcgcgcaggtcgcgtcggggcgggtcagtgcgtgggcccgtcgtggccgtcggtgggccggccccgtggcgtaggatggtcacggcacggagccccggagcacagagccctgtggccgtacgcaagctctagtccactgtcacggcgctgtctctcgagggagaagctgggcagacgcatgaccgttcctgcgcacggtgcgtgtctgcggaaggtagacgtgagtgcagagaagctcagtgtcgtggccggcgctgttgtagctgccaacattagcagcccacgtggaggcgcgtatgggggagtatgcgcacatgactgggggtgtgtcacgaagcctctcgccggatttcgccggggatctcccgcggtgacccacttgagcagggccttttgagccattaaacc

SEQ ID NO: 721076 - DNA, 271 bp, Homo sapiens
gtgaaacatgaaatagtcttttgttataattagggcatgtaggcctcaagaaacagaatctctctggccttctccgtgcctatcctttcacctgccccaaagcaggactctaatcttcccctgcctttttattcttatttttgtttttgagacagggtcttgctctgtcgcccaggctggagtgcaacggcatgatcatggctcactgaagcctcaacctcttgggttcaagaaaccctcccacctcagcctttcaagaagcaggaactgg

SEQ ID NO: 721077 - DNA, 385 bp, Homo sapiens
acgctggataggggatgtaagcagactatgtggcaaatttagataccgttccactaaacagatgtctctgcgacccttccctcctccgatcagccaggaaagtcctctgtacctaacctttcaatggccaaatacttgcaccagccccagatctcccagccactgtccatcattcacaacatctcttatcctcaatcactgggcagacatgtcagggaaagaatctactaagattgtgctacgcatgttcaggaggatgttttctctggagacacacccccagtagagagtcagacaccctttggaggaagaacacagatgaaaatccactgaaacgtggggcagggagatcctattgcatctcatgcctggaaagggaccacag

SEQ ID NO: 721078 - DNA, 2076 bp, Homo sapiens
gacagccaatggaggacacatcgggctccgagtaagagacgtgcgccggggcggagtgtgagagccagtgaggggtcgctgggctgactgctgtcgcctcgcgggacgcgaccacaaataacttaacagatggcgcgataaggatgatccgtgagatgagcgcccggagaggcgagagatggtcgatgcatcatgcattgattatgtcgcgaacatagtccgggtacgggagcattaggaatacgaagccaccccagatagcttccagtcatactgtcataccatgacgtttccataagaaagttgctctagaagcaggtagtggaagacacatgtcttgcttaaagagatagggcaagagtttagcaccgatatgggctagaagtcggactacagggcctcgcgtctatgaaaatgaggataggtgacaaaacgctagtaattcccgtacccatagcggggaggtagctacataaacgtagatgttcaacgggaatctcccagatgcaacccaaagaagagcctccctttcggaccttcttcctccttactgactctgaggttattcggccgcagacatagattccaaagggagaagcagtccgctggggcctggtgcccaatagggtgcagggtgccgggaagaaaaactggggacgaaggacccgccggaacacgaaacacggggatgtgaggatgcaccgagggacaggagctccgtggacaaacgaacggggtggggggaaactcggcaacggcaacacgcactacgcaacaaaggggactttgggccccgcgggtgaatccgaggccctagaaagggcgataggccctgaaattggacggcgaaaacacagcgggaggattgcgcaacggggcgcgaacacaggggtcagcaaaacaagcaggcagcacggcggggcagctggtgcggaggaagaaaaaaagagcgacaccaccagagcaggagcaagtaacaaacaagacacaccgcccgacaacgcgcgctgccaaatcaacaacgcgcgccgagacgagcgaacaaactgcgagagaaagagaacacacccacttgaaacacccgcacacacccaaaccatgagcgccccaagaacaagagtagggagacacagaggttaacaacaaaaagtgacaggtacgcgggtcagacacaccgactcgtcagagagaggagatggtacagtgaaatccagaataagtagttgtggtatatacattttgctgttggtcatcttctctttcgtctcgctagcaccatcaccaagagcctaccgcgcagagaaacacgcaaagatgacacagacgcagaccagacacgcacagaccactacgtaccgatccagcgagcgcataccaccgacagagagtacagacacgtcacgcaatcacgaagaacaccagagaagagcgaccacacatgagcgcctacacgcaagcgaagaaagaatagagaggagcggacgagcgaggtgagcaggagcgaagtgtagaggcgagcgcgcaccgagtgagggcgagcgcagcggaagaagcaagaagaagaacagagagaggggcagcgagagcaggggagtagagcaggaggagacagagcaggagagcagcagagagcgaggagaaacgacaagcagacaccagcaacggaagcagcgacaaagaaagcggcagagccaccagacgatgagatgctagagtaggttagaatgagcgtggaggagaggcaagcgtgggagaagtggacgtgagggagtgcagaagccgcaaggatggacggagaggatggaggggagagagggaagagagaaatgagaaaaggcagggagcaggagcgaagatcgtgcagaagcggcacactcggacactgcgaggacatgcgagaggaagatacgagaccgacacagaccacagaagacaactccacagcgaagccaacgcacacagccgcgctacgcaagcgacgaacgacagcagcgcaacggcagccacaacacacaccccagcacgcatgccagagcacaacacagcacagaacagcaggacgacacagcagtcaaa

SEQ ID NO: 721079 - DNA, 959 bp, Homo sapiens
  misc_feature (1)..(1): n is a, c, g, or t
  misc_feature (3)..(4): n is a, c, g, or t
ncnnctgtacgattgtgatggcgtacgatgagcggacaagatgaaaacagacactggcgcgcggttgacctctgtaattaagatccagtgctgcctatacttgagcgtttatttagagagtttaccaccggagacgagacttgtttgcaagcatcccctcccggcaatggttgccctacgcctcccatgcgggcccacgcgatgcccacagaaccgcggtatgttgaattcccgtgcagccgaggttacacctacgttcgccttggctggcatgtacggaacgggaggtcatatcctttttaaaaagccgcgtctcttctcttcttttatgacgacggggtctatactaccagccctatttcccgcgtggactacaactgacaataaagtggtcggccaaacggcccctccccacggggccaggggatgtgtggcacaccgcgccgtcgccccgcataccagcgggggtacaccgcgaggccccccacaaatcccggggaaactcatggattctttagatataacacgggggtcatatcaccaaaagtttcagcacgcaccgtgcttcctagcgctcgccccgcccaaggagtgttggtccccccccgcggctttttacaaagcccagggagcaatcaaacaggacgtattttataagccccccccctaatgtgggctaataatgtcggaacatataataggggtacaaagaaagatttttttataccacgccgcccggtccccaaggggcgtctcctcccctgttattctcctagcaacaaattgggaagtttcttggcggggagcaatctaaaagttcaagagtatcgagacacattcgcttgggctaaaacattggagaatatccccactcccggtgggggaaatactccaatattatctcgctcgtaggtagcacccagtagggggataacccgccatcccccccccacatgaca

SEQ ID NO: 721080 - DNA, 483 bp, Homo sapiens
gctgttctcacgagagtagatataacgcgatacatgtataatatcatactcagcaaatatctcaataacgcaagatgtaatatggatatacatcagcaacatgtagtgccacttcactatagccggggtgacagaggaagaccctgtcttatacatacacacataaatccaacaaggaagacaagaaatgtaacctctttctcttctccagagccaagaatgcctaaatgatgacagtcaggatttagaacactgggcttcaaatgcttgctctcatcttttctccgagtggtgtctgtccaccctgttgctccaactaattttctaatggaagcagcatttatcaatctgggcccttggctaacaacatgataaataatttagtgcattcctccttttgaatcacttttttccccaaatgtcaaaagggggtatatggggaacaaaaaagatgggctcaagttgctggaggccacggaggct

SEQ ID NO: 721081 - DNA, 359 bp, Homo sapiens
ccttggaccctctcaatgcagcttcttgctggtgagcacgcttttgatgctgcatggctgcatgcttctttccttcttctgtccccagcaccacttgtttgaagttatgcacatcattgcaggaaaggggcgtgcccacagctgctaagtccttggcgtgcaaggtgaggactctgcttcatccagcatgcccgattctggtcctcaggcagctgcccattgagctcttgccaatgccgtggctcttgctattatttgatgattgtcataaagggaccacctattggtcatgccggccactcatttcctttttgcaagaaacccagagtgtggcttcttattttgcattacgtttagtc

SEQ ID NO: 721082 - DNA, 111 bp, Homo sapiens
gtgcaaccaaggcaacacaacttccagtttcctattgttgttacaaccatttggcggctttaaaatgcaaattgtcctcccggatttacccacacaccatacggcctgcaa

SEQ ID NO: 721083 - DNA, 93 bp, Homo sapiens
ggggggggggggggaaacataatgacaggcccccctcccccttttcctgcacctgtttttgtaccaaaatattatattactgttttcttttta

SEQ ID NO: 721084 - DNA, 1194 bp, Homo sapiens
acttgctgaagctgagtgctccagcctgagggctccaggcctctgacctgtgcccagcagtgagctgcggatgccctgacgcttcagtggcctggtgagcatgtggatgctgtgatgtctgccatgtgctgactgcctgtgctgggtcttggagctgctggtgttcatgtgactgatgcttgcactctggttgtttgtggtgcttgagctgacgctgtgcactgtctggcccagtttcttgatctggtacctgcacatggctgcatagcaacccatacttgcactggaaggaaggttctgttgcaatgctggccatactggaagaacaacattggattaaccctattgtgaattctacaagttggtgagcacctgtgcccctgggtgaaccttctgcgcccatagaagagactcatatggaaaaaccaaattgtgtatacaccgacaaggaaaaaaggtggccatggtatgtggtatacagataaatatggccccatcgacgtacagttgagcccgatgtacaatgcaatgcctgaacggatggtggcccccttggtgtgacacgacgttggcagattggcggagagagcaaaatgaacaacacatgggattactttttaacttaacggtggtttacacctttcgggggaaccagggaagccgatggtgtggaccaatgcgatggaaacggacgaatggctacggcatcgtggcacagcacacatctggtttaggaacgacgtttaacagcgtggtggctcttttggtggaaaaagcgcccaaacggtccgccgtaccagcacaatgaaataacggctaacacacactgggttcaccacacgaagaagggcctgttcgaataagcataccataccccttaccgaggtggtacaaatgccaccacgccggactgtagtgaggggagaaacgaaccaacggaacggtggaaccgcggcacacacgacagcgatggcacttataccttggacaccgcaacacgatacggcgtggctaaagtctgaacaccgggacacagacacacccacaagtgcggagctgcgtgtcgaacgcgtctacacgaaacaccacgtgtgaccaagtgaaaaccacacgagaaggcgacacaatgcgcccccaggaacaggcttcccggtgcgaagcagcgaaatttgaaacggtcttgcggtgaacagc

SEQ ID NO: 721085 - DNA, 279 bp, Homo sapiens
tggacgacggggtctcaccatgtggccagggcgggtctcgaactccggacctcagggggtccgccggcctgggcctcccaaatggctgggaattacagggtgtgagccacggtgtccagcctagttgggaattcttcataataaaaagctttttaaaaaggtaatattgggacttcggctccggggaagagggaataggacttttcctaattctttcttctaactacaactaaaagcccggggctatacataaggaaaacacggggagcctctgaaaag

SEQ ID NO: 721086 - DNA, 156 bp, Homo sapiens
  misc_feature (93)..(93): n is a, c, g, or t
ggtaacaacaattataagattatatcttctgtaggggaagttgtaactataaagagaagtgataccaggtgccatggctcacacctgtaatcncagcattttcggaggccgaggcagtaggacagtttgagcccaggagtttaaggccagcctggc

SEQ ID NO: 721087 - DNA, 352 bp, Homo sapiens
tttgaggcttagattcgtggtccactgtcgcttatcgagctgagagacggggcggggcacagagtgctgggcagagatcttggaggactgatttaccattctgagtacctctgcttccaacccttcgaataatcacccgtgcatatcgatgtgcaatcctaataaccaaaggaggccagacagcaatgtcatgaggaatatcctgttagaaatgatgaaacattctccaaaccattctcagagtacatgcttcgtaccctggaggcttatgctgtgaaataggtaataggaagccttggcaggtgcttcccctacagaatcaggatgcaaaagtaagacctactgcgaacaa

SEQ ID NO: 721088 - DNA, 100 bp, Homo sapiens
ccgtccacgcgagtccagactcacatctgaaatcataatggacgaagtggtgcgcaacaacttcgtccatggtgatttgtatggatattcggcgtgtgca

SEQ ID NO: 721089 - DNA, 169 bp, Homo sapiens
gggggcccccccccccccccccccgtttgccaagcatgggtattatttgggcccccacccatgttttaaggccggggggggggggcctgggttgatgccctccagggccctggggggggcctggaggggggcccttgtttgtttgaacccataaagcaaccggtcccga

SEQ ID NO: 721090 - DNA, 136 bp, Homo sapiens
ggtatgaataaaccacatgatccttctatgttgtccaagagcagaatcctgttttctacagtgcttcaaatcatctgagagtgtctaagcctcagtttcctcatctgttaaatggaaccattaatactatctcata

SEQ ID NO: 721091 - DNA, 110 bp, Homo sapiens
tcagcccggtccacgatctttacctttcacttcatcttgcccttcattattgcagccctagcagcactccacctcctattcttgcacgatgaggtgatcttctgcacgat

SEQ ID NO: 721092 - DNA, 138 bp, Homo sapiens
gcatgataccatcgattcggtacccgcattggcagcccactcgatcttctggatccagctatgccggaggcactgtcaccctaggagattacaattatcgtttatgaaagctaataaattgactttggtgaaatttaa

SEQ ID NO: 721093 - DNA, 472 bp, Homo sapiens
cgatacaatatacgtatatgtcgtccatcatccgaaaagtgctatatgatgaaggttattcactaatcacatatctttaatagaactgtacattgttagcgtgcagagccagctagtgaattagaattacacttgctttcttgtttagtctttcctagaattaacaactgccttgtttttctatttgcttcattttctaagtatctttattatgttataaacacattactcggacctgtaagataccgatcaatattctttcccaaagggcaaacaataccagataactttacaattcctttcccaccgcgttcgtgatcacgagatgtactagggcaaaggggagcagaagaccagggacaaatacgcaatgtggtacctattcaatttccagcctggattcatacaccggggcccacacaccagtgccaacgtgtccacagggcctataattccagggtcccttttatca

SEQ ID NO: 721094 - DNA, 360 bp, Homo sapiens
ttgactatggctattggtggtactagtatgactgtcaagtcgatcaggtggctgaggagcagtacatgggggtatacagagtgcaggcctcagaactgcagaacatctgcacaatctccagcaagctaacctctctggacatcgtattcctcatctataaaagggagacttcaatcttatttaatggcaaaagtcacaattacttttgtaccaacgtaatagaattaagtaaaataaggctagacatgctggctcatacctttaatcccagcactttgcgaggccaaggtgggcagattacttgagcccaggtgttggagaccagcctgagcaccatggcaaaaccccatcgctaccaaa

SEQ ID NO: 721095 - DNA, 1024 bp, Homo sapiens
gaggccagaagcggtggctcactcctgtagtcgcagcactttgagaggcatagatgggcagatcgcttgagtccaggagtttgagaccatcctgggcagtgtgtgtgtgtgtgtgtgtgtgtgtgtgtgtgtgtgtgtgtatacagtgtctatatatatatatgtacacacgtgtgtatatatgtacacacatatatatatatgtgtgtgtatatatatatatatgtatatatacacatgtgtatatatatatatatttgagagacagagtgtggctctgtataaaaaaaaagcaaaataacaaaaaagaagaacaacacgacaaacataatcacgtggatagaaacgatgcacgcaagtagagaggtacaccaatactagaaagaagtaatcggcgaagacccacgaagccaccaacgcagaaacaccatatagtataacaacaacagcgagataaatcacgtagcagaccaaatactactacaaggataatagtgaccctgcgccgacagaaagagaaagtgaagacaaagaggcaccgacgccctccattaagatcccgaagaggggaaatagcaaagaacccgaggaggtatagaagaggccgccgatagtgggaccacaacaaggggaacgaatacaggggaggcacgagagagcaaccaaacagagaagacagcaacggaagtaagagagcagctcagcggcaggcagcgcacttgcatgagaggaaaacaggaaacgagcgaggggactaggagcggcagctgcagacggcagccgaagagcaaacaactgcgtgacaacgacagacacaaaacgacgacacgggaacacgcacacgacagagtgggggcaacaggtcacacagggagggcgaacgcagccgacgaggccatgccgcagccggccgagcgacgaaaccacacaacaggcaactctccatcagcgccggcagccgagaagcagaagcgagcggcgacaacagaagcggggaccaacggacaaagagaggaggcaggcg

SEQ ID NO: 721096 - DNA, 291 bp, Homo sapiens
  misc_feature (250)..(250): n is a, c, g, or t
  misc_feature (287)..(288): n is a, c, g, or t
gcacatcctgcaattgccgagagccaggtatgcgtgtgtgtatctggggagcacgccccaaacatgagcagggacggtgttcccagctatccgagaggtcatgccaagccaaaaggaaggctctagcctctataaacatgaataacgtttattcctattacatttccacatgtgtctatatgcttgcttcctgttttctcgcaaggaagtatggtgcccaccatactcctccagcctagacgatccatgntgagggttcctttgttcccccagcccaattcttcatnngtc

SEQ ID NO: 721097 - DNA, 1137 bp, Homo sapiens
  misc_feature (874)..(874): n is a, c, g, or t
tcattaaggaagaatttccaaatgaaaatcaagtagtgttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctganccaactgatacagccccaggagagcaagcccaagatgtagcaagcagtccacctgagagctccttccagagactagcaaccagtgaatatagggtataactctaatgagggatcgaggatgagctttaaaacttggaaaaacaggtgtaagccttcaaaagagaataacctagtggtggaatgtaacctttattttcgtactcctagggggaattaaaattcggaatcaacggaaggaaagttttacaaagaaacaaagaggg

SEQ ID NO: 721098 - DNA, 213 bp, Homo sapiens
tttttggggccccccccagggtttcccgggggggggattttttttgggtaacttttcccccccccccccccccctgggggggcccagggggggggcccccccccggggggggaaggggggcccccccttttgggggggggggggtttttttaatttttggggggttccttttccccctaaatcccccggttttttttttatttaatttgttta

SEQ ID NO: 721099 - DNA, 546 bp, Homo sapiens
aagtatgcctccagaacacaggagaagaaaagctccaggatccctgtccccatctgacctcttgatgccagagagactctgaggcttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgagccccagctggggcctctgaagggattcctcactgtgggcagctgtcctgagcttcaggcagcagtgttcatctctggccagatgtctggtttccatgtattctaagcca

SEQ ID NO: 721100 - DNA, 231 bp, Homo sapiens
agccgaggcgacctagaggatcccagaaagggctcaggacaggtagcctaggtcatgagatcagagcagtgggagaaggggctggatcatgtaggccctatagtaggagatggtaaggactaagatagttgtctagagtatactcagcataaagacagaaaaagccatagggaaggtattgagtatacggagtaagtagaaatctagatactatagatatgacatgagact

SEQ ID NO: 721101 - DNA, 838 bp, Homo sapiens
tctctcgtccggtgacttgcactctcgcgtactgtgctcgctgtggtgcacttctcgtgtatggttgcccgctttcgtcaggaggcacaagcactggggccttagcactggggggtttaatcctttgcctcgaccgcggggtttaggtcgcccgctgcgccgtttgttcgggtcacgtcgcacgctcttcaagctgcctgggccgtacagttttgtttcgtcccccttcttggtaggtggttctcggcacgcccgtggcaacatcagttgttctccccggacgtggtttctttgcaggagcagccgagttcggtatggcctgtggtcgcagcggtttttcataggagatgggtaggtcagtgattcctcttaagtgtgccctcctttggtcgtatagacgaggtttccccccccgtgttctccgcctccgtgtgacactcatgctcccccgcgacgaaagcggttactcaatagttgtatccaccgagtgggagttacgtactttttgaaggctgagggagaatgttccggtctgatcaacgcccctgcttgagattacacccggggtctaaggctggaactcgcttgatgcacgcccttacctggcctcctagtattaggcgccgtgtttatttttctgtctccctggctctaatattccggacacggccttgtttacaacatctgcacttgtccccccgggtgccaaaaggagcctggtgcctcacgctcttttgggaactttgtcccaaccgcatactgaataagagggccaagccgccaactacattttgggcccccctcttcctgttcccacccggaaaaacacccaaataac

SEQ ID NO: 721102 - DNA, 485 bp, Homo sapiens
cgaatatcacaacactccactgaatatcacagcacctcaaatagttgctataaatgaagagaggcacagaggcggtgccctaggttatgcagctagtgagtcctacagctgtgtttgatccaagcacctgtggctttgaccatccactgtgccagctggctgcaggcggcctcaggcactgtgctgaactctgggagtggatcagacagctagtgtgtgtcttgtcctcccctgaaatcctgtctcctttctcctccagagcactgccaaggtttgcctcctccaagaagcctgcctctccgggatcagttaggttctccttgcacttgaccgtgccctgagctacctccgttacagcccgtccctcggtatttcggctccagagtaggggccctggttggtggggcctgggttgaacttcagcctgggtcccagcattgcctggcacctgggaggtctcagagatgtcatgatagaatcaatga

SEQ ID NO: 721103 - DNA, 619 bp, Homo sapiens
taaagtcagagtctcgctctgtcacccaggctggagtgcgggggttgatctcagctcattgccacctctctgccttccaggttcaagcgattttcatgtctcagcctcccaagtagctgggattataggtgagtgccaccacgcccagctggttatgtattttagtagagacggggtttggccactgttggccgggctggtctcgaactcctgacctcaggtgatctgcccacctcagcctcccaaagtgctgggattcacgggtgtgaggcactacgccccagcctttgggggtcttcggggctatatcacactctggtgtgatgcaagagcagtcagagcaaaggcagttcctaaaataggcatccgggtcagcactgaaaggtagtccacgtttggtaatattttcacactgtttaatcactatttatatatctaatgcattcgggttaaacgggtctgtgtcagatggtcttgaccaatgattagtttgggagccattttgaaattgtattctggtgctatcacaaaaagcgggattaggccgggcacggggggctctcaccctgtaatccccagcacttttggacggctgaggcgggcaggatcacgaagtcag

SEQ ID NO: 721104 - DNA, 349 bp, Homo sapiens
ggactgcttacaggctgtaaaacagagcccatagaactatgacctctgagggaccattggaatgaaagtgtactgtgcattatgcattacagtaaaggatttcattggctacaagatacataagtttattataaaaggcacagggctagaactaagctgacttggcagtgctcattctgtgagccaaacgagttatgctattgcttccctaaataatacctgtgaattatctaatgtaacataggtacttgcggaaggagttagactgtcatgaagaatatgaacatttactgtggtgctttaggaacatgcatttgcattatcctatggttagtgcacaccaactgtc

SEQ ID NO: 721105 - DNA, 744 bp, Homo sapiens
gctagtctcgagttttatgtttttttatttccagggtacgttgggagatagattctcataaaattattcggcgtcatataatatatagatatatgcttatatacctttttttttaaatacaatctatatacccttcccttccccaccaaattcacaaagggaaattaaaccctcccaggatggccatcaagttctcccgaaagggccagggccaagaaaagaactcatctctcaacgagggtaaaaaagggcgtgccattctttaggctcgggggttggaacgcacacagcattcccaggacccaggggccagagagaggaaaagaatgtgacggtagggcggcacgggatccataggagtgaacagtgctccagtgaccccgggcatgtggcagaagggcctcccagaaatctcagggtgagagtaaccagggtggggccccataaggggcctcatctcaggaagcgcggcccaaaaagggctcagggggatagggaagatacgcaaacgggggatcaaagagcattgccaggggacatgggcggctggcaagacaaaccacgcctagaatggcgaatatggaacgaaaaccgcaagcgacccacaaatagggagcacaccaccctacacattgcattgtttggcaccggcacagaccgccgacgcctaaggcgaaccgaggcacaacgactgcaagcggaccacaggacactggagcacaaaaaccgaagaccacaaatacc

SEQ ID NO: 721106 - DNA, 996 bp, Homo sapiens
tgggccggctctactctaccatctttggaggcacattcatcacagcgcgtggctcgcactgatgtcatatctgcgtaggcctacacgataaacttgctagctataattccagttctacccaaacgaaataaaccctcgatccacagaagcagtcatgaagtatttccatcatgcaaagcaacctgcaatcccgataatccgttcgtaattggctatcctcttcatgcaatgatacatctccgcgaacacttgaacggcatcaatgcgaactgacatacctagatctaatactcgatcatttaataaatcaataatagtgcataataggacaatacgaaccggatagggcaaataggtcccccgtttccactctcttgagatcacgcagaagtgttacgccataggagaccgccctcatgaccagtccggctctggtttcgtgtgctcacactgacgacaccaatctgatgaccccgcatgatccaggtcatgtatccaaaagtgttctccctcaggtaatacgtgtgatgctcttcgtcgctctaagtcttcgtcacattccttagtctcagtcattaggccaggcatgttatgatgggtgggagttgtaacccagacatcccaagcataccgacttgtaactctttagcagtacctcccctacacattatcccaccatagggactagggtaagtcgcacggtacctagccggatacaacccccttaaggattaacacgttcctgtggatggaacgcgtattcactatttggctcctgaatcctaactatccggattgaccataactaggggcaagtttaaaaggtccccaggcaccacagaaaccattgaatacatatactctgacagctggacacaagctcaagcatgaattgaacaaccctataattcaatcgaacttacctttgccttatgatggcttgaccgcggtagcgggcttttgcccaagtgggcattccgaagattccccaaggag

SEQ ID NO: 721107 - DNA, 330 bp, Homo sapiens
cggatatctgaccaggtatggcggttagatatccccgagtccttcaatgctagatatcccgttgatacgggatcctagatatcgtaccgagaaactagtgcggatatctgaccaggtatggcggttagatatccccgagtccttcaatgctagatatcccgttgatacgggatcctagatatcgtaccgagaaactagtgcggatatctgaccaggtatggcggttagatatccccgagtccttcaatgctagatatcccgttgatacgggatcctagatatcgtaccgagaaactagtgcggatatctgaccaggtatggcggttgggt

SEQ ID NO: 721108 - DNA, 426 bp, Homo sapiens
ccacaggacggtgatgactcgaggatattgattgtgattgattgattgattgtgaaacagagtctcgctctgtcactcaggctggagtgcggtggcacgatctcagctcactgcaacctccgcctcccgggttcgagcgatcctccctcctcagcctcccgcatagctgggactacagccacgagccgccacgcgccaccaatttttgtatttttagtagagagggggcttcatcatgccggtcagtctgagctcaaactcccggcctcaagcgatctcccgcatcggcctcccaaagtcctaggattacagacgtgatccactgtgcctggcctcttctttctttttttgtagacttgatatcgttctgcctcttaggctggagtgcagtggcatgatcacagcacactacagcctcagcctcca

SEQ ID NO: 721109 - DNA, 140 bp, Homo sapiens
cttgacaacaccttacacgggtacctgctacgcggtttgttacggcctcctatactacgtctacgtctactacgggctactaactcacgacacacaccttaccaacttgactttcacctttgttacctacacttaactac

SEQ ID NO: 721110 - DNA, 292 bp, Homo sapiens
tatacaagtcagctcggtacctgatcattcgtgtctcagaagcaggttgtcctcagtttgacgtgtcattggctgtctttgccactcgaacaatgtcttcagcttcctgtttatagacgttcatctaagctgtcgagcctcttctgccaataagagtcatgtttgttcgggtcccctgtagatactggttgcctgaaagacacattggcagcagcgacttttgctttctcaagttctctggatgcgatttcaatcaaccgctctgtgttctctacatggacacgaatgttca

SEQ ID NO: 721111 - DNA, 205 bp, Homo sapiens
ctagacaaccttgggatcaagatgttctgtgtatcatgaacctcgttcatgccaagaccgaaagtgctggtccagtgtgagtacattcagttcatgccgtgacaattttcctggaactcctttttattgttagttctcacttgtttccatatttagtgaatgtacatttaattgcaaagctgtcattaataaaaattcttatagt

SEQ ID NO: 721112 - DNA, 619 bp, Homo sapiens
  misc_feature (130)..(130): n is a, c, g, or t
gaaattaaattttttttgaacacagcaccatttttgggtaatattgaaattaccggtcttaaaccctttagtaccaaagccaagtaaaagaatgaaagccctactcacacagttatcatatggcgcatgnatatgtcaaaaagagtattttcaaatcacttaaacaaaagcggaatgcaaaaacgaaagcacacaaccagcatttaatttccatttgaaataaaatcattgggcctattttcaataccccaagattcaaaagaatacccccccccatgcaaggtgtaccagacaatcccattgtctgttttagccgtgtaggggcggctgtattatcccccattcaggtttgcagagtgacacctgttaacccacaagcaagagtgatcttttttggcgcagttcccttaatagtggtcatgatttcggtcccacgaaatgaattccattctttgaaactagcacatccgccgctcttgagtatgaaattaccccgaaagggaatctccacctgtcccagaatatcccccaatatccacctcgtagaatttctttaaatctccaactttgaatttctcatattgtgcataacgctaaataaaaccctggggccgaattc

SEQ ID NO: 721113 - DNA, 553 bp, Homo sapiens
  misc_feature (5)..(6): n is a, c, g, or t
  misc_feature (330)..(330): n is a, c, g, or t
  misc_feature (404)..(404): n is a, c, g, or t
gatgnntcacctgccacctacaggttcataatagtcaattttgtggagactatacttcctaaatgggtgcctgggtctgatttcttactaggagttagtgttcatagaattaaaaaaactctaccctctacagtggtctctgaaggctttcagaagtcctgatgtttcttcccaaggtatctgaccctctctccataatccacccaactcctcacccccagtgctcccccactgatccaccctgcatctccttccagttcctgtcgggagtggatgcctggtgcaagatgtgcagtgaaggtggtctgccatccgagatgcaagacctanagctggcaatccaccaccaccagaccttgtatgagcaggtgacccaagcctacacagaggtgagaatggagcanggcaaccatggttcttgggcatgtctgcatgtgggtggggtgatgagggcactggcctgtgccctgtgaaatagcctggggtgggactaagaagaagaagctggtttttctttttttttggtgacatctttaagaacctttgactattt

SEQ ID NO: 721114 - DNA, 181 bp, Homo sapiens
  misc_feature (43)..(43): n is a, c, g, or t
  misc_feature (73)..(73): n is a, c, g, or t
ttgctcctgtagctagacaggttgctggcaggagggggtcacnaacacggcagggaagtctcgtcgctcgaangggacgcggcatccatctctcctcgggaactttgaaaatgctcagttctggcctagtctccgctggggccgccgcccgagcctccccgggccaccccgtcgggtggag

SEQ ID NO: 721115 - DNA, 145 bp, Homo sapiens
  misc_feature (26)..(26): n is a, c, g, or t
  misc_feature (135)..(135): n is a, c, g, or t
  misc_feature (141)..(141): n is a, c, g, or t
aattcgcggccgcgtcgacgcgagangacgacagaagggatgacccaccaatcacatgcctatcatatagtcccagcccatgacccctaacaggggccctctcagccctccttgacctccggcctagccatgtgntttcanttcc

SEQ ID NO: 721116 - DNA, 172 bp, Homo sapiens
gggaaatctagctcaaatatccttgaattttcattaggattgaagtgtacagcttaatcaaaggtaagactgtagtaaacattgttatattaactgatacttaattggaacaagtgtcactaggatgtgtaactgtataacacgtacactatgaaaattaagacaagttatc

SEQ ID NO: 721117 - DNA, 660 bp, Homo sapiens
gcggccctgtgccctccaaattcacagggtggtacctagtgagccagtgtgggtgtactgacatgtgctgggtgcacacatgtctccccccgtgccacctcgtgggctgcctgggcctctggcttccagtgccctgctctccacggcctccctctggccctgttggagtggtgcagtgctgatggctgtggagtgggacaatgcactgccccccagaactgcatgtctccactgagtggcaccgcctatttggtgtcctgtgggaggtgcgagctgagaacacatgtgactagctgagtggtagctggtagttgggacgagaagctggggtagttggatctagtgtagttcctcaatgccccactgctcctagtgaggtccccctgtgggtgtggctgggctgggcctggggcactccgtctgcctttgcagaaccacctgggcccctttctgtcagtattattagggttacgaattgcagctgtttaacttgaaagacactgtcggaggtgagcatcttgggcgccgggacgctgcagtgatccccgccagagcctgtgcccttcctgctccgtctttgggggtcctcaaggctggctccttccttttgccaatctcttggactcagtttgccggtgatgcgtttctcatggaggtctg

SEQ ID NO: 721118 - DNA, 191 bp, Homo sapiens
tacaggacctttctcttttaagacttcttgagtgtgatgcatgagggaagtgtatctgaaacactcatgtttctcatggcactgatatagggctcaagggaacttggaccatcattgtgttttactgatgtttaatcccaggcctgacagtggccctgccctcagatctcacatcagatgtgtggcaggtg

SEQ ID NO: 721119 - DNA, 720 bp, Homo sapiens
  misc_feature (601)..(601): n is a, c, g, or t
ggcttccggacctcactcctcactcagatttctgtacatcacgtccctttatgtctataaatcttccaccatgtagctgtgctggagtctcaccaaatcttctgtgattctgggggctgcctgatttgtgaatcattcatttctcaattaagttcctttaaatttaattcagctgaagattttcttttaacagatggtgtcagaagtgggatctgtgggagcaggactgctagggcctccggagctataatgtggtgagcagtgttcctagggcttctaatgacccccaggagtgctgaagtacaagaaaggcacctgcaaggactgctctgtgatggcagcagtggcccatgtggagcagttgctacggagacactggctgcagtgaggaggagtggctggggctgtgcgctcctcgaagctggtgggagtcaggaaagggtgggagccccaccccttctaaattggcaggcaggagccccgccctcccaggcacagctgcagccatccagccatgactgcaaacccgggcatctttgcactctcagaggcccagcaagcccccctgccccgcaggctcagttgtacctggtcccaccanctggcgtctctccactcccagagcccactccaaccttcaggaattccccgaaaaaaggggtttttgggaaagggggccttggaaaaacccccaaaggggcaacaaggtccggaaacccg

SEQ ID NO: 721120 - DNA, 947 bp, Homo sapiens
tttctctgctccaccggtgggacgacacgatctccgggtttttttccaggctttcggccgccctccgggtccttgcccgtggcgaccttccgggaccatttttcggccatttccgctttttgggacctgcccgcccccggtttttgtgggttactccgtgtctgtgcccacccacgcgtgggttcccccaggttctccccagagattatgtcccggcgacctggggaggccacccggtctaccgccctgggtccaagtgggtgacactgccggccctctctacaaacctacctctctctggcttttattctgccccccattaatgtggctctggaaaggcctgagccccttggttcccccgaattggcccaggaaaagccccgagggctaccgagcctcttcctgaagaatgccaaaccccgccgtggcggccgcgcttttctttcccggacacttcagagaagcccgcctgaagatgaagtggggtaaaaacccccgaaccccctgaaagctgccctggccctcggagagaaaagcgtgagacccggcccctttggattttcacatgccctcgggttctgcccgccaccggagcccccacttctctgtgaactttcctggagggctcaccttcctaagaatggggaaagtgaagcttattccaagaaagatgggtgaccccctgagcccacctccacccggctgggtggccccgaggctgggctgggcgaagtatcttcttcgaaaaggctcactttcacagcccgactaagagccttttgaggccccgcgactttctgaagggccccctgccaagtaatagggcttctgcctaagacctctccctccagcccataggcagcttttttaactatcctacccagccttggacccaatggaaataaagctttttgatgcccaaaaaaaaatacaaaactcgagactag

SEQ ID NO: 721121 - DNA, 565 bp, Homo sapiens
  misc_feature (30)..(30): n is a, c, g, or t
  misc_feature (63)..(63): n is a, c, g, or t
  misc_feature (65)..(65): n is a, c, g, or t
  misc_feature (78)..(78): n is a, c, g, or t
  misc_feature (80)..(80): n is a, c, g, or t
  misc_feature (94)..(94): n is a, c, g, or t
  misc_feature (96)..(96): n is a, c, g, or t
  misc_feature (98)..(98): n is a, c, g, or t
  misc_feature (101)..(102): n is a, c, g, or t
  misc_feature (114)..(114): n is a, c, g, or t
  misc_feature (136)..(136): n is a, c, g, or t
  misc_feature (141)..(141): n is a, c, g, or t
  misc_feature (143)..(143): n is a, c, g, or t
  misc_feature (157)..(157): n is a, c, g, or t
  misc_feature (161)..(161): n is a, c, g, or t
  misc_feature (184)..(185): n is a, c, g, or t
  misc_feature (192)..(192): n is a, c, g, or t
  misc_feature (196)..(196): n is a, c, g, or t
  misc_feature (205)..(205): n is a, c, g, or t
  misc_feature (316)..(316): n is a, c, g, or t
  misc_feature (339)..(339): n is a, c, g, or t
  misc_feature (356)..(356): n is a, c, g, or t
  misc_feature (488)..(488): n is a, c, g, or t
  misc_feature (508)..(508): n is a, c, g, or t
  misc_feature (548)..(548): n is a, c, g, or t
ccgtcttccagcctccccatcagcctttgnctgccttcctctaggtcctttaggaggtgatantnatcgctgttcgangngtcatacaccaggntntnggnnaacatactcctnaagaaccgcacggactccagcnacgantngatgagcagcaggnagangcggacagctctagattggattnntgttgcntttnctccatgtnggagggtgttggaatagagtttgagaagcagaaggaggtctgggagttatgcaggaatgaatacttctggtcctttgggatataggtttcttcaaactcctggtaggtgtnaatggccagctggtgcgcgcgangggcttggagcatagcntggtcaaaaagcctggataacggaacggtttggacggcaccagcctcttgaagccagggcaggcagagcagggcaaaagccaggagcagggacgtccgggagcctggagccatttccactaggtgagctgtncacaggaccctgagtggttnggggagttgggccttgggatcctagagccggtctcttgtnggccctttttataccct

SEQ ID NO: 721122 - DNA, 283 bp, Homo sapiens
tgactatgtactcgacagaagaaaaaaaaaggtataaaaggccgaattcactcttggccttagggactacgagtggatgacgtcaaagatctcttggccctctggatataagccacctgagtgcagggtactaccttcactagagttaaacagtattggaggaaaattaggggtgatggtgctaggtaagaaggtgacgatataatgaaataaatttaagtcatgctcagtatgagacatctataagatacgcaagtggagatgtcaaatagccagtagcatt

SEQ ID NO: 721123 - DNA, 126 bp, Homo sapiens
aaatatgattagtttcgtggtgtgaatgttataatcaaggagatcgtagggagattagtatagagacggtagagtttttttcgtgatagtggttcactggataagtggcgtggcttgccatgagtg

SEQ ID NO: 721124 - DNA, 284 bp, Homo sapiens
agccaaactcaggatagcgagctgggtagacaggccagcagtatatgaaaccttccataagtgtgcagctgtattggatgccttctgtagaagagcagagatacacgtgccatgtgcagcacgagggtttgatgtacctcgtcagcctgagatgggagccatcttccgagcccaccatccccatcgtgagcatcgtaggtggcctggatgtcctgtctgtcctatctgtcctaggagctgtgatggctgttgtgatgtgtaggaggaagagctcagcgaaatcg

SEQ ID NO: 721125 - DNA, 402 bp, Homo sapiens
aggcgaggagagtgtagtgagccaagatcgtgccactgcattccagcctaagcaacagagccagactcccatctcaaaaaaaaaaaaaaaccccgcgcaaaacccaaaaccacagggccctttgttcttgctctttcaaaaaaccaccccattgaagggaacaccagggttaacccaatgcttcctgtggatttgaccactcagttggcctgccacccgcgttgtccacctcccaatgcccctcggtttcccctcaccccctccggtgctcagatagaactacagctgtttggtggagattccccttgtggggttcgccagcggccccagcgtttttgtaccagattctctgctcttagcttccccttcaaaaaagaggccccaggctccttgtacttctcc

SEQ ID NO: 721126 - DNA, 480 bp, Homo sapiens
ttctttcctactttttatttgggggttttatgattttagatcttatatttaagtctttaatccattttgaggtgatttttgtatatgcagttggacaaatgtccaattttatatttttgcatatggacatcagtttttgccaatataatttattaaagagactatcctttcccctaatatattcttggtgtcattgtcaaagactggttgactctgtatgcatgagtttatttctgtattctcaattatgttccacatggttctatgtctgtttttatgctagaactgactgttttgattcctataactttgaaatatcatttggcattagaaagtgtggtgcttccacctttgttcctatttctcaagatttatttggatgtttgagtttttttttattccatgtgaattttagaattttttttttctatttctgtaaaaaatctttttggaatttaataaagatgcattcaacccaaa

SEQ ID NO: 721127 - DNA, 337 bp, Homo sapiens
  misc_feature (193)..(193): n is a, c, g, or t
  misc_feature (231)..(231): n is a, c, g, or t
  misc_feature (253)..(253): n is a, c, g, or t
  misc_feature (293)..(293): n is a, c, g, or t
ttcagtaactgtgttacagtaacgactggatcaatcacaactctgtaacttgctgtacggttgattggcagtaataaacgatatatttgttgctgtaattctgataactgccagcgttgttcttttcgtccgaataagttgagtgtaattgataccgtgccttgcaacgatgacttgttaggtagcaattgtnatgatacgtcaccgcaatagacataaggcatttttgtnaatgttttcttgatgtcgggcncgtgaaaccaagtcatgccgttatcatcagcttatctganccgtttcataaaattcttggcctggtcgctcttttatacccctt

SEQ ID NO: 721128 - DNA, 385 bp, Homo sapiens
gcgcttagtaaataaactgctactactcctaagtgccagggtctcaggtcccatgtagggtttattcatgagtggccgattacaatttccactcttggccgaaacgatactttcccttcagcgcagaataagctcactttctaggatatgcaatctgtggcagtcgcaagatatattttccaaaacccgaaaggaggataaatggatgatttctcaaatgccctgaagtaaaatgaacaactctgggctgtcataaaatcagagtgagatgacactcctaagtgattaattctttgagattggtaggacatttttaaacacagaggggaaaaaagcctacatatcttctagaatttgtagtctaaccctgaagatggttggctgg

SEQ ID NO: 721129 - DNA, 228 bp, Homo sapiens
cacatacaaaaatttcatgtttttttttattaaaaacaaaataatgcttgctcgtttaaggtttcaatatatacaccaagataattatttggaattgttgcaccagaattagtaaaaatttcaaattttttctcaatatcttaatgacttaaataatttagcttttttcaggcattttttgttaaaaataaacttacttaattttcaacttaggtcaatgtgcttttt

SEQ ID NO: 721130 - DNA, 112 bp, Homo sapiens
ggtggctcacaccgtaattccagcattttgtagagactatagcagcacagatttacttaagcccaggagttaaaggaccaaccctgggtcaaatggtcaaagatcatccatc

SEQ ID NO: 721131 - DNA, 358 bp, Homo sapiens
  misc_feature (227)..(227): n is a, c, g, or t
  misc_feature (285)..(285): n is a, c, g, or t
aaagatttttttttttggggggggaggtggggggaaattttaggccccccttggggggggcaaaatttttttgggggggggcccccccccgggggggtattttaaaaaaattttttttcccaaggaggaaatgagggcggcccccaagaccattttagggagccccccttccccccatatgggggagaaatacaaaacttgggggggggtgaaaaaaaaagattgtnatcccagctactctggaggctgaggcaggagaattgcttgaacccaggaggcagaggntacagtgagccgagatggcaccattgcactctagcctgggcaacaagagagaaacttcatctcaaaaaaaaaa

SEQ ID NO: 721132 - DNA, 975 bp, Homo sapiens
catggagtgtgaatcatagctcatgtgtctgccataccatgtgcctcggggcatgttgctgttcaggaccgtcatatgacctagtagcatcacgcgagtagtgttgcggagatgccatgaagacgaagatgaatattatggatctcagatgtctaattaaacctagtggtgtggcattaggagtcaagatagtcttgtcagaagggaggatataactgggtagtgggatatgtgatctctggaaagaatgatgtacctttgatatagtttgatgcgtcacttcactgacattgatggagtacacctatattcaaagagtgatctagaaatccaatttgtatttggtagttgaatggatccggtattgagggattggaagaacgtcgagtagttgcacaggtgaccaggatgggactgcagcatagtgcatgccgacgagaatggcactcgtgccaaaggcacatctatagggatacggagcatatcactagggagtcgtgcttgaggtccagaggaatagctctgatgttcccctggtatacttagtgataagcctgggtgtaggctgtcttggctgtagtctggatcccatagttggttatacgttggaacagcaaggtctaaccgcatcttaagcgggtatcactgctggggctcatcagtgcagtggaccactggtgacagggattcggggatgctataatacacataggctgtgggttaggctgagggatcttccatgttataggactgacggtgaacagaaaggaagcatgtggatgagggacagtgttgttaacattgtagccgtgggacaaccatggtttggatgacaagttgacgcaagatataactgtgggttggatataatttgcatgtaataggactgtatcccatgaaaataggaaagtttgggaagtggagggaaagttgttagaatatccattaaggattcagtgcatttcaacattggta

SEQ ID NO: 721133 - DNA, 327 bp, Homo sapiens
tttctctctttgggttttgatgactttttggtaaactgaatgcaaaatccccaagggtcccaagggacagaccccccccctcaatgtttggttgccctttgtttttagtgtgaaaaaaaaggggtgggtttgaaaaaacagggcctagcaaacagacgggggggctgttccctcagcccctttcctgcctttgttcccagagaatgccccctgtaagggtccctgagacccaacccttttcttcctttgggcaactccctcccttccaaaggaaagggtttgttgtttggtcaatttccaaagctgggaatttccgaagaagaaaga

SEQ ID NO: 721134 - DNA, 119 bp, Homo sapiens
taccgttggatatgaagcattaccacttaaagaggatcagagcttctgcccaactgtcaagccttgacaattgtggacttagatcagtgaacatacacgggtgaatgcgtccgtcgaag

SEQ ID NO: 721135 - DNA, 114 bp, Homo sapiens
tgctacagtattatgtagaaactcttagaagtctgacgttgctagagtgagagagaggtacttggagaaaagccacaatctgggcttcatttatcaggaccttgattatctcat

SEQ ID NO: 721136 - DNA, 327 bp, Homo sapiens
atgcgcagctgaagcgcaaatagaaagataggcaaggtccaagtaaaccgctagcttgttgcatcgtgtaggccacaggagcagaaacatggaatgccagacgctgggggtgctggtacaagttgtgccactgcatgctactgtctaaagcttgtctcaatgcatctagaacttcatcgccccctgatcgccgatcacctctgatacccaccttgctcatccacaaaatgcccatgttggtcctctaccctgggcctgtcacattctgcactatttctgtgtttattcatggcactatgtactaccaccatgtcactacttacaaca

SEQ ID NO: 721137 - DNA, 240 bp, Homo sapiens
attctttgtctaatatattggagtctttaaaagtgttgaagaataaaatattaattagaccaccttcaaatgctaaggtgatgttttccgggacttaattaaatacaactttttcctttcgaaaagactgttcacatttgctccaggtgtaattatcgctctcatcctaccccctcagcaaatgtgaaagtatactgcctgagattctcatgagtttgagtctaaacggatgtaaatgtt

SEQ ID NO: 721138 - DNA, 729 bp, Homo sapiens
  misc_feature (12)..(13): n is a, c, g, or t
  misc_feature (20)..(20): n is a, c, g, or t
  misc_feature (167)..(167): n is a, c, g, or t
  misc_feature (206)..(207): n is a, c, g, or t
  misc_feature (301)..(301): n is a, c, g, or t
gccggggggggnngtttttncccaagtcttgctgtggggggggtttctcttctcccccttcttctttctttctctggttctctcgtgggtcttttcgcttttctcttgtgtgtttttttttcgcccctcgtctctcctggccccccctgcccctcgactcgtttttnccgccggcctccccttttttctgtgggtgttggggcccnnccccggggcggcgcccccggcgatagcgtctcccgcccggttctgtgctccccgttggcgccgccctccgctccgtggccgcctctgtgggtcnctgtttcggccgcctttgcctcgcgcctcgtgcgtttccgtttgtttgcctcgtccttgtccgcccctcctgccggttcttttgtttgtttgttgtgcccctgtcgccgttctgcgggctccgtggtgtgtctctgccggcctgtgtggtgtcgccgttttcccgccgcctctctcgttctgggtgtggggtgggtctttttcgcgttgtcctctccctgtgcgctccggggcccgtctcttctcccttgtcctctgtctcctttccgttctccgtgttccgtgctccttcttcgtctgcccctgtttgctttcttcctcttgcgtgtgtttgtcctgtctcgctgccttccctctcctctccgttcgccttcttctctttcctctctctgcctgtttctctctttaaacaggctttgcattctgccg

SEQ ID NO: 721139 - DNA, 253 bp, Homo sapiens
gggggggccccgccccccccccccccctggggggggtttccccccaaagaattttagaccaagggggtcggaaaaacccaaacccccctttggcccccttggaaaaccggccccccccgagaaacaaatttggggggggggggggttaaaaaccccccccccccaaaatctgggggggggttaatggccccgggtttccccccccggggccccccgcccccccgggggggaaaaaggtttttttgggttttta

SEQ ID NO: 721140 - DNA, 247 bp, Homo sapiens
atgcatttccatagccgcgtgatatcggggtacttgtccctcgctatctccaccatctgtaatctacaattatcatattactgccttagcaaacatagcagccatttcctcgaacattatcaccatatacgggaattctgcactctaattcgtcttcctcatctcatctctatcctctgtgtaaaaagaactagattaattttcatcttaaatcttcattgcattattttaaatttctaaggatcag

SEQ ID NO: 721141 - DNA, 608 bp, Homo sapiens
acgtctctgaggaggcaccattgagaatgattcgattagctaagtggatcccactggtgaatggggggaccacgcaggggcccaggtgcccatcatcctagtgggcaacaagtcagacctgcgtgtcggggagctccactggcagtggtccgttgcttccccaatcatgagccagtttcccgagcacttgacgacctgcacttaatgaatcgtgcaaacgttctctgccttttattcatcctccttcccaccccactccccctccatccccactcaacccaacccactcctcccctaccctcactccaccagctcccccccctccacaccgtcgcacgcacgccaaaacgcctcgcatactaatcaataccctctggcatcatctctctctaaaactacaactctctagcatgctcccccacgcttccaccgcatctcatactatctcctcgtacatacccgcgacactccttcccacccagactcccatactcacttccgcccaccctccccatattcagtccatcgacaacccaaataataccctaataactaacaccccaccattcccaccccagaacacatccaacaccacccttactacccga

SEQ ID NO: 721142 - DNA, 125 bp, Homo sapiens
catgtccatatacagaaacaagtttatttataagttctttttctttatgggtcatgttttttctatcaacaaaaccccagcgcgcctcatatagcttaaaagctacatcagcatggtatcattct

SEQ ID NO: 721143 - DNA, 269 bp, Homo sapiens
cttacgggacagcgataatgtcttgtgtgagagtagacctgggactgtgcctacagaaggagctgctgtgttccccaagtggctgcaccgattcacagtcctgccgccatgtccgagagttgcatctgggccatgtccttgtacacatttggtatagtcagcctgcacctttcagccaccccagtgggcacagagccccatctcactgtgggttgaatttgcatactccctagactgtggggagcacaggtcataagctagcaggcgca

SEQ ID NO: 721144 - DNA, 282 bp, Homo sapiens
catcccgggagacagctgacacaaggacaagagtgctgtctcccagcacgtcctatacaccagtagtactggaatgtccggccaggcagtcaggtaagagagagaaataaagggtattcaaagtaggaagagggaagtcaaactacgtctctatgcagatgacttaattctatatctaataaacccatagtctcagcccaaaagctccttcagctgataaacttcagcaaagtgtcaggatacacaatcagtatacaaaaatcactatcattctatggttgt

SEQ ID NO: 721145 - DNA, 1040 bp, Homo sapiens
  misc_feature (25)..(25): n is a, c, g, or t
  misc_feature (184)..(184): n is a, c, g, or t
  misc_feature (503)..(503): n is a, c, g, or t
  misc_feature (869)..(869): n is a, c, g, or t
  misc_feature (1006)..(1006): n is a, c, g, or t
tgcaacaaccttctaataaatagcnctgggccgcgtgttttagcctgcagattttaaatctacctcctctctcaatatgaacatatgccggatgaggaactttgcgaagtgacttacttgaaagcgctgacgtgaacctcttggcttggccagactcaggccgtacgtagactattagaattgngaacaaagcttgtatgctatgtggtgtccgaaattgcagagcctacacatgaggcacatatgtagacccatactagtgagagtcgtgcaattaataataccatctggtgccagccggtattaaacaaaggtagacagatctaggataatctccctctggtggtctaccacaaactatagatgcgagttgtgatagaataatacctccacttctacccagagtctaggaagacatataagcagaatggaaggcctcgatacactgatggcgctctctctctcacatacgaggtgtgcagccgagctcatatgagtgagcnctaatggcgaacagtcggcaacgctcgtaatatttgatttcgtgaagatatccggcaggtaaaacttcatgggtacactaaagcctcactgtttctataacgcacatcgtggcccgatatatcagcgcagataatcccctctctatacaaatataacaaagagagtgtcacccgctggctccggtctctagaaggggtttgttcctccatgctctgtgaacacaagcaggcctctagcttaattaaaactaaaccggaggcttctctcgagacagtttaaaagggggcgtgaaaaacaccggtcgtattagaagggggtagattgggacaacagatacttgagacaccattatccagccttaatcncataggttttttttagaggggtacgttgggccgcccaatgctttgcatgagagaaacccaaccctcacttggtaagagacgggagtggatctactgctgaatggtggcgccccccttggcagcccttgtgaatgatnacagtgctaaccttatagggtaacctacaattag

SEQ ID NO: 721146 - DNA, 178 bp, Homo sapiens
  misc_feature (80)..(80): n is a, c, g, or t
ggaagttgacgggcatcagtgacccgtgactgtcaagacctccgctcgaggttcggatcctggatgacagaccctctcgncctgaaggcgataaccgggtgtggtacatggacgactatcacaacaaccgattcgtacgtgagtacaagtgccatggttgacttcatgaacacggaca

SEQ ID NO: 721147 - DNA, 364 bp, Homo sapiens
tgtgggtatcacctaccatgggacctgcattctcacctgaatcccttctttgatcatcttccctctgcttagcactgcctttaccaaagtcctactcaccaaaatcttactacatgatactggtattgtgtttatatcaaaacgaaaaaaagcatattgaggtattcactaaaaatttagagatataaagtgaaaaatttagagattaaaacattttaaaaatagtactaggactttaggctctatatcaaatacctattcctttatgaaatgaatactaatgactcctaaccttcgacacaatccctggtgctctgtgctatgctttaccgtaggttctgggtaaactacacagttacgtctt

SEQ ID NO: 721148 - DNA, 155 bp, Homo sapiens
aaaaaaaaggggggggggggggggggccctttttccccccccccccaaagggttgggggggaaaattttttttttcccggggccaaggggttggtttgggcccggggtccccccttttcccccccgtgggggggaaaggggggccccctttccca

SEQ ID NO: 721149 - DNA, 689 bp, Homo sapiens
ctcgggcgatcgtgaccggcggacctgggtgttttgctccttgtcgtcctacgactcatccatagacttcacgtacgaccaatagtggcagctggatgaagcgagtactccagtccatcggtgtagtgaccgaggcgtagagttgtccagcactgggtcaatgaccgtgcttggggagcatctaccatggctcatgagaggcactagcagtccgagcccgcattgccacgatgcgcaaaggatgatcaaagatacaataggtgtggaacggagattgacatccttgtacttatcaaagtcctctacctgtgcgacagatatggaatgcaccagtagtgtccgaccttctgggtccccaaaatgggcgagccatgagtatagtgcaacacgcctgtgggggacaattgggcaagggttgggattcgggaattatgcggaaacctttgtcgaggaagaaattgccccaaggaacgagtccaatttacgtaattcggcaaagggttatagccgaggaaacaatggggctcatacctttaaacaacggttcccaaggattgcgtgtgccgaatcgccttggaggccgaccgttgtacgataccacgctatgggtcgagaaggctacacggattgggctagtgctccatatcaagctaatagactcgcggaaggagcgactagaggagcacacg

SEQ ID NO: 721150 - DNA, 275 bp, Homo sapiens
tcgaatctgtattgctttgtgtaatatacctattttaactatattaattcttccaatccaaaaacatgggttggctttccatttcttttgaatcatcttcagagttcccgtcatggctcagcggaaacaaatctgaccagtaaccatgaggatgcaggttcaatccctggccttgctcagtgggttaaggatccggtgttgctgtgagctgtggtataggttgcagacgtggctctgatcccacgttgctgtggctgtggcgtgggccgtcatag

SEQ ID NO: 721151 - DNA, 174 bp, Homo sapiens
gatcgacggaggattcaatcttaaaatatcgttacacattagctcatgaatttcctataagttgtatggcacataaaagttcgtgatgtggccaggtgtggttgttcatacctgtaatcccagcactttgggaggccaaggcaggagaatcactcgagctgaggaggtcgacgc

SEQ ID NO: 721152 - DNA, 350 bp, Homo sapiens
  misc_feature (209)..(209): n is a, c, g, or t
  misc_feature (318)..(318): n is a, c, g, or t
  misc_feature (326)..(326): n is a, c, g, or t
tttccaaatagtccatttcattaggaacttttttgtttgaatgaatgtcacataggtatcctcagtaacacagaacgaaattacctttgtattattgtgattagttggtgcttatttttttatatcaggtaataatgtggtacactgttaatttttttggttttgtaattattatttaaattaatggcaaggtttcttaccatttgtcnacatttaattttcgggctggaaataaaaatgaaaaattcttggtacccttgaaggaattgaatttcccggcagggccaaaatttttttggaaatagatagttttagtanaattaaantttcgggcttataataaaaaaaaa

SEQ ID NO: 721153 - DNA, 118 bp, Homo sapiens
acagacctgtctcaaaaaaaaggaagaacaaaataacaaaaagagcggaaaaaataaaacattttgatgacctctaaaatgtagtcatcaactgctaaatgtttggcagaagcaggaa

SEQ ID NO: 721154 - DNA, 901 bp, Homo sapiens
  misc_feature (17)..(17): n is a, c, g, or t
gtcccggaaagtttccncggggaatctggcaaaccatcctggccatacccggggatttcaaagcgaattctccacctcagctcccgagtagctgagattacaagctaatttttgtattttgtagagacagggtttcaccatgttggccaggctggtctcgaactccttgatctcaagtgatctgcctgcctcggccttccaaagtgctggaattaataggggtgagccaccatgcccgcccagtatattctttttttttttttttttttggaaacggagtttggctctggtggcccaggctggagttgcaggggcatgatctcagttcaccaaaacctccacctccggggttcaatcaattctacctcagccctcccgagtacctggaattaccggcttgtgccaccacacccagcctaattggtattttagcaagggatgggttcctccatgtgggccaggctggtctaaaactcctgacctcaggtgatcacgcctgcctcagcctcccaaagggctgggataacaggcgtcagccaatatacccagcagtatattcttaaactattcacggtgtgagccatatataccgacaaggggggacttttgaatgcccgacccatcgtgtattaaacatgcaaggctaccttcattcatcggtgggtatgcgctaaagaaatttcaacgtatctccccttgttcaaacccaacatacggtcggcgtattcacatgcggctgacacccattcttccccataggtatcgcgtgcactccgttctgaggcgaacgaaacattgcggacacttgtcgcaacagaaaaacccggtccagtcgacgttccctgtggggatcaacaaagggggtgacataccaacggggccggccaaggcatgggtcggc

SEQ ID NO: 721155 - DNA, 606 bp, Homo sapiens
agttgtatacctagaactgatgtgagcacaggtgctctaagcaatatgtataaagctgttcatagcaccatttttcttaatagccccaaactgaaacagcccaaatgtccattataaatagaaattgataaattgtaacattttgtacaatattatatatcaatgaaataagcaaattacagcagtatgccacaatgtggattgatttcatgaatatacgtgaaaaacagcacagaagaataccatacactatgtgattttaattttataaagttcaaatataggcaaagcaaagcaatagttttatttaccttcctgtatcataacaccgtgtattatactcatgcatatatatgtagtcccagctggtagaagtataaaggatagtaaaacaatgtgttcaatatggtaagcagagttccctctaattaaagggatgtatagaaaagtaaagtaaaacgggcatcaatgtagtaggtaaagtcaatgcaaagtaacattttttggtttattaaatgaatgtgttcttattaagcagttattaaaagaaggtttatattacccaggcattccgttttccattaaataaaaaaaccaatagcaaaa

SEQ ID NO: 721156 - DNA, 132 bp, Homo sapiens
atttcagacattcccctgtgcgttgcaatcatgctatactgtgtaccagcaggaattaatcctctgaaaggctggcttacttgtgcagagacgactcacactctgatgcctgtgcttggcggagtggtatgc

SEQ ID NO: 721157 - DNA, 141 bp, Homo sapiens
ctattgcttgcttcgtttttttaaacttgaactttactttgttagatctcataatactttcttggcattctagtaaggaggaccctgaggtgggagttgtggggaacggggagaagggtgacagcttggcaccggtcccgt

SEQ ID NO: 721158 - DNA, 704 bp, Homo sapiens
  misc_feature (56)..(57): n is a, c, g, or t
  misc_feature (84)..(84): n is a, c, g, or t
  misc_feature (638)..(638): n is a, c, g, or t
tattggtctcgacgatctaccaagcaaatggaaaacaaaaaaaaagcaggggttgnnatctagtctctgataaaacagactttnaaccaacaaagatcaaaagagacaaagaaggccattacataatggtaaagggatcaattcaacaagaagagctaactatcctaaatatatatatgcacccaatacagaagcacccagattaataaagtaagtccttagagacctacaaagagacttagactcccacacaataataatgggagacattaacgccccactgtcaacattagacagatcaatgagacagaaagttaacaaacatatccaggacttgaactcagctctgcaccaagtggacctaatagacacctacagaactctccaccccaaatcaacagaatatacattcttctcagcaccacatcgcacttattcaaagttatttatctttcagaactttgaaagtactgttccgtgatcttctagaattaaatgctgcatatgagaaatgtgattttagtccagttcctgcatgttttgtcacttatttcttccctctagggaaatatgttggtatatatatatatattttttttctatggagttctaaaattttactaggaataattgagttnttgacttttttaaatcatgtgattcaacacatagtgagccctttcttcgtccaggcaatatgcgtc

SEQ ID NO: 721159 - DNA, 127 bp, Homo sapiens
aacgaacaggttcagtcctcctactgtactgtcagccttccaagatagctaggacccactatgcccagctaattttttatttttttgtggagacaaggtctccctatggtgttcggttgagcggaga

SEQ ID NO: 721160 - DNA, 341 bp, Homo sapiens
taagacggggaataaagcggagcgaggacagcaaggtgagcaagtgcacccctatggaccctgggcttaggcccttgcgcgcgctgagttttcaagaaaaggtttcttgctttgagggtggccaagggatgccaggtgtgggctccgtgccttttctgagtgacttggaaaagaaagggccaaccatgggtctgggtgctactttggtactctggttctttgccggactggtgctgcggggctgggaggataggcttcttattttctttcccaagcgcccaccggcttcccgtgcgttttggaggaaacctacaaattggcgcaccggctcattgagaaaa

SEQ ID NO: 721161 - DNA, 564 bp, Homo sapiens
ttgttgtgcttatagctattatggtatagtactctctaggctttactaattatattatagtactattagtgtgccctggcacccttcctacgtgctctagcttagtagtggtaaggcataccaataatgatctcctaggatattctccttcgtatgctggttgatgacagtcgctggttcgtgggtcctactaggtaaaatgtatctcgtcctatgtgcagagcccgtgtcttataaggtacgtgtaccctgtagcctcatataggggttattctagtagagtggtagtatgatctttggcccctactgcatcagatcgggtggctaaatgctcaagattctgtcatataagctatataagaatagggtgatctacccccgaggctagtaggggcctagcatttgctaaaggcacagtagctaagtggagctgggcaaagtaaggaaagccagggaaggtggtgggtgatgagtctcaaagctaagtagtggaagctgggcacagtggctcatgcctgcaatgcccagcagctttgggaggccaagtaacggcggtgactgagg

SEQ ID NO: 721162 - DNA, 404 bp, Homo sapiens
  misc_feature (37)..(37): n is a, c, g, or t
ccggatgctatagagcacgaatgtccctcgggacatnacgcggggaatcaccatcaaaccatcggcgccgactttggcggcatgggctgcgtgggatacggcttcacggctgttcaccgcccccgtaccgacgatggtcggcacacccgtagccaccaggcgcgccacgccttcctggcgctgggcctcggtgagcagcggccagtcgcccatggaaccgcaatacaccacggcactcatgccgatgtcgatcagctcgcggcccttggccaccagtgcgtcgaagttcggttggcgctcggcggtgcaaggggtcatcagggcgggcatgcagccggtgaagatgttgtcgctcatggtgctaactccggtttcagttgaatgaataatgggctcagatgccc

SEQ ID NO: 721163 - DNA, 269 bp, Homo sapiens
gggctaagtgatctctagcaagagagacggacattggtctgagtcccaaactgttcatcaggtttctccgggccactgaatggtaagggggtccggtagccaggtgggggcggcaggttccactgggcacttgctgagagcttgcggcttgagcagccgctggtcagtgaagccgtgtccggcttcgttggctcccggcttgggacactcaagggctgtgccacagggccaaggatcctccagcccacagctgaagcactgggagtgac

SEQ ID NO: 721164 - DNA, 395 bp, Homo sapiens
ggtctctccagagctagtatacagcatcttggtcaccattcgtgctccttcaggagctccaggttctccactaggtgtctctttcctagctccaatgtctagatgcgacgtggtgctttgcacaggtccatccttctgtggcagccagttcgtctttcatgtgtgcaatggtctgagtcagcattagcaatgtcggccaacatgtgagtctctgcagcatacacgtttgagagtcgtccgagagagttcaagctcgagactaatgcgtcatcggttcccttgatctgttgaagcgagcctccctcttcagggagatatcaggcacggctcggctgagttcatgatcccctgtgactccgctagcgatcgcgccagcgtctgcggctggaccgtct

SEQ ID NO: 721165 - DNA, 805 bp, Homo sapiens
ctggtcggcacgtcgtcgttaccaggccgcgggggcgtcagtgcccgagccgcggcccatcgtagactgggacctgagagcatcctgggcagctactgtcccgcgctcctgcctccgtgctgcttctgctgctgctcctgcgccgggccgagcagccctagcggggcctgagctcactctatcgcagctagccggcactaacgccaagctagtgcttcctacgaggcaggtggcagcagggccgtgcaagttctccctggaattacgcaggtccatccattggccacggccactactgcatgcttagcactgctcatgctcaccaggcaccaccccagggcgcacaccacccatcgtaccagcaggcaacacgcacaccacagcacgtcacgcaccatgcgttcaccgtcaccagggggcttgcacagtcacagtgggccgtttcaccatcccagctatttagccttctcagagctcacacagccagcttccatcccgcaccccttaccgtcgtcaaccgacagcacctgcttcctccacttacatgccactcctttcccacagcttcgcgctgccgccattgcaagcctttccacgcataatacttcacgcatacggccaccattagggcgcggcacacgccagagggggctccacgcgcaggcactccgtctcccacccccaacgcactaggccacgctaccctgcccctttggcacgttaagcagcgcgattccccaactagcagggccttcttggccacaacacgtgcggcggaatcaggcaaataccgaatatcacacag

SEQ ID NO: 721166 - DNA, 111 bp, Homo sapiens
actctaagactagtatgctgccagtgcttactcctttggttaggcatttgtatttcctaccaatgctcttaagggataccaagtaccaaaagttggggggttgtttttttt

SEQ ID NO: 721167 - DNA, 161 bp, Homo sapiens
acaatcttgcagcatagcacagtccaatgtacaacgcacagttccagcatccaacccaccatccacagccatttccagtgtgccacatccagctactccaatccaagtcaacatcacacagtttcacagcttcgtcagtaacatcacacacacacacacac

SEQ ID NO: 721168 - DNA, 363 bp, Homo sapiens
  misc_feature (240)..(240): n is a, c, g, or t
tgtaatctaacataatctgctactgtacactagtttgggatgctatcagtggggttttcagacaagcatgagcactagaccagcttgcccttcttcagactccctatcctctggggcagtgtgacagtagcagaatttttgtgtcagagtcagtggtttttgacattgaaatgtgccaccatcacggcctttgctctgagttttgtacatgtctatacatgtgtgagtgtttgtacctantgcttgtgtgtgggaaggggtacatgtgtgtggtgggtgccagcatatgtgtgcaggagtgtttaggtcacagaagaggaccgcactctgggcctagacctttaacttaaatgatttgaccag

SEQ ID NO: 721169 - DNA, 83 bp, Homo sapiens
gatctcattcatgggaaaaaaaaatcctgtcttgttcataaattgacaatgtcataaattgaatatggtcactgttactcttg

SEQ ID NO: 721170 - DNA, 904 bp, Homo sapiens
gagatgctctcagtggcgctcctcgagaatggccttcccggagccgtacggttggctccaacgatggagagggactctccttggcctttacagaaattggaacggcgaatacatagtccctgatctgttcgatctttccgcatcgctatgcatgtgggggacgtgactaggtaatcagttcacacctcgtctcacatcaacagagttccgtgaaagacttcgatcgatagtaacgggagacttgagcatagtcctttcgaatagataggagccctatgaaggcacgcgtgtgctgtccattgatgctgtgtgatgaagaaattggggcaactcgtgccgtgactggtctccgtgtacttgctcgacaatatcttgttctgaatggtgagggctacgactcatgggtatatgctatagtactctctgtgctctaccatgggtcgtgtcctcgttcaccagaatgcggacacatgttggagcaccattggaccgtggactgacgaaatacaatccgctcgttcggtttgcaatgcactttctgtcatcatcttgactgcatgtccatgccctgagcagattgaaacatattgtgcttgtcctaacctgtcctttagtattgggatcattgtgcaacgatgcttttatccaccaatattgataggcctgtgcttgccttctacccccatccccgtgggggtttctacaacgtgatttcaaaaggtggtaaacctaagtttttaagaagcagcgtggtgctggcgtaaggtggggatacctgaaggggcgtattggggtggagttcactttgcctaacattggctcagtgttggggggcgtccccagggggggcacaaattgccttaaggataacggccattctttccaaagaaaaacccggggatgg

SEQ ID NO: 721171 - DNA, 361 bp, Homo sapiens
tgagtatattagatgattgtgatagctgttgcgtgatgatagaatatgatgggaagtatttaggaattgatgattagtaccggtgtagtccagtgtacatcgtatgttcagtatgtattggtgtggcaaatgatatgagggtgagggagggatcgttgagctcgtttgtaatgtaaaggatgtgtatggatgggagtggtgatgagagataggatgatggcgggcaggatagttcagacaggtttctatttcctgagacgtctgagagtgttctgtattagttagattttgtttgtgatgtgttagtgaaaatgggcatacatggactatggaagcagatataggaaaagtgattatgatg

SEQ ID NO: 721172 - DNA, 179 bp, Homo sapiens
gcctcccctttaagtaggttacacgaacgcgagaatagggagttggagaaggggaaggaagtgttgaagagtcagagctggctccggagtgggggagattggctcttcttttctttctccctctgtatttatcttgggtctgttgcttccttataaagagggaagcagctgcagtcctt

SEQ ID NO: 721173 - DNA, 222 bp, Homo sapiens
ttcattcccgcaatatgacatcaaagtggttaccctgtgctgtacccaactggattgtcatcttctgaggatgcaaacgtgcagaccccatatctttgatgatcctttcagtatcaactctggaaagaaaatgactacatcagctgatcatctcaaacgaggcacaattctggactgcaatacatgtaaatttgctaccatcacatgtaatctcacttcttc

SEQ ID NO: 721174 - DNA, 310 bp, Homo sapiens
ctttgtaaaaggatttttccatcaaaaatgggaaaaccattggggaggattaggacccatatgggaattattacctttcagggccgagaggacagaatggaaataatttgaatcctgttaaattttttttaaactgttttttagcggccctgtttatggaaaaaccaggcccagtttatgtttggggttttgggaaaaattatttgtgttgggggaaatgttgtggggggggggttaagttgggggtattttttaattttttttggacatttggaacagtgacaaaaaatgagacccctttaaactgtca

SEQ ID NO: 721175 - DNA, 650 bp, Homo sapiens
caggagaatggcatgaacctgggagacggagcttgcagtgagcaaagatcacgccactgcactccagcctgggccatagagggaaactctgtctcaaaaaaaaaaaaaaaaaaaagccccagccatagttgcccttgggatctctctgactctgaaattccacaccctattattgagggcatcatctaaacttttaaggatccgctccaattcttccgtgtcccccaagaaatttcccccgacccttcccttcttctttctagctgggggccctcaagtcaattaccatgcggaaggtctcaatgctgtgaaaagctttccttcagcaggcaacccctgtcaaacacacggcgcccaaataaagctgacttctctggttgatgcaaaaaaaaaaaaaaacaaaaacaaaaaaaaaaaaaacaaaaaaaaaaaatcaccacataaaaaaaaacaaaacaaaaaattaaaaaacaaaaaaacagcataaaaatacgtgtaacaacaaaacttctcatcccactaaatagagcaagcaaatccttatcatactatcgtctccacaatactatatccaataaatacaccgcttatgctaagcgtaaaaataacactactacactaatgaaactctgttactaatcaatcatata

SEQ ID NO: 721176 - DNA, 236 bp, Homo sapiens
cactgacaggaaaacacatttggcacgctgacattctctggtctcacagtaccaacttttccaagagaccttaaggctgtggtgtgtagcgtagcgtatttctacccagatcggagctctttggtgaagactcctttcgggacacagttttttggcttcttcttcacggatggttggaaggaccatcacactattcccatccttccaatcaactggggtggcaacccttttttctg

SEQ ID NO: 721177 - DNA, 144 bp, Homo sapiens
caagattacgatgtcatgtgagaagaatgcaggcggatgtcagagggtgtgggcttttgtatgtacaaactagtcattatatttttacagttgttatgatactgggtgagtagtagtgattagagagtggagtagacttaggcg

SEQ ID NO: 721178 - DNA, 125 bp, Homo sapiens
tatctttgttgaaaggccagaaataaactcacacatttatagccaagtgatattggcaaaagcatcaactgcacacaactggggaaaagacaaccccttctataaatggtgctaggaaaactgca

SEQ ID NO: 721179 - DNA, 531 bp, Homo sapiens
ttttgctattattgccaaacagtttgattaaacagtccagttatctttcagagacatttcattcaattggaagaacagcctcattgtgtatccatatacttaccatttccggagctcttttttccatctgtgatcattctccccccaccttcacgccaggcggggcagggttcggagcagagagtgtgatcaggagtggagaggccatttcgcagtgtttatcggggggtcggaggactctcgggcgcgtatgcgcctgatggtagagcttcgggggacatgaagcaaggatggatggaactgtgggcagacatggacaaatccataaagttggagatttcaataatggataaagcaggtagatagaaaatggggaagaatgtagaggagctgaaaaacactactaaccaacatgatctaattaacatttataggcagtttgtgacaatttgattatttgtcaatcaaactacaatcaaagtgatcaatagtgtcatattgtcatgcagtaaaatgtgaccatttggttaa

SEQ ID NO: 721180 - DNA, 154 bp, Homo sapiens
cctatcagatatgtctgggtgtccaacgccccttctgcacaccttgagagtcactttgcttctgttccagtgttacggccattcgggatggtctggactgtccctaggagaaccagactgatccataaggacctctgatggggagtgttggacc

SEQ ID NO: 721181 - DNA, 556 bp, Homo sapiens
ggctcactgcaacctcccgggttcaagcgatccttgtgtctcagcctcctgagtagctgggatcacaggtgtccactgccatgcccggctaatttttgtatttttagtagagacagggtttcactatgttggccaggctgatctcgaactcctgagttcatgtgatcagctcacctcagcctcccaaagtgctgggattacaggcgtgagccaccacatccggcctggttttgttttttttgaaacagagcctcactctgttgcccaggctggagtgcgaggctcaatcacagctcactatagcctcatcctcccagtctcaagggatcctccaaactcagcctcccaaatagctgggactacaagcatgtgccgccacgcctggctaatttttttatttttgtagagataggttctcgctatgttgcccaagctggtctcaaactcctggcttcaagagatcctcccactttggcctcccaaagtgctgggatgacagggatgagccctcgcgtctggcctctttcctctactttctctcccaaggacacccgct

SEQ ID NO: 721182 - DNA, 878 bp, Homo sapiens
aactatgcctgttcaggacaagatttatgcttttctccctttgcccagtacgccagactctggtctactcaggcaggatctactaagaaatgcagctaacctgctatctctctgtgacatggtcgagtgtacagcttattttcccgtatgaatctccagatctgtgagtcgagcagatatcatgttgcagattcagctttacatgcaaggatggtattatcctcacatgcacttttgacttgtcttgctgtaccttaagaggtgatagagtcaatactgtcatttgctacacgggaagattcaagagcgagctgacatgtgttatgcgtgtcctgcacgaatctgccctgtttaatgcattgtcctagtcctagtagttgcggttccctatatgtgatgtactgccgatattttactgtgcccgttagggcgacgctcttttgtggactagttgtttcatagtcctctcacggagacttccatgttcccgactcgggtggttcccgctgtgttgttggcagtgttgtctcagccgtctccctaggactgacttgagccctgggttcatctaagtgtgctttgtccttacggtctcacgatagagggcacacgttaggtcacacgctatgagggtcgcgagttaaggtatactacgaggcactttagggtgcctatgacttggggattatcgctcctacttgccactcccagtcctggagtgaagcctgctagtctggacagctctattccgggtgaaataggccgccaggcctacgtgttccccttgtttggcccgttgttcggccttgggccggtctccttgagactttgggccggtccgccttgtcccgatggggcgccttttcccaccccgctcc

SEQ ID NO: 721183 - DNA, 314 bp, Homo sapiens
actagaggatccccatgtgggcattggggtgggttccaggtcttggctataaagacacatgcacacgtatgtttatggcggcactattcacaatagcaaagacttggaaccaacccaaatgtccaacaatgatagactggattaagaaaatgtggcacatatacaccatggaatactatgcagccataaaaaatgatgagttcatatcctttgtagggacatggacgaaacgggaaaccatcattctcagtaaactattgcaagaacaaaaaaaccaaacaccgcaatattctcactcataggtgggaatcgaa

SEQ ID NO: 721184 - DNA, 290 bp, Homo sapiens
  misc_feature (36)..(36): n is a, c, g, or t
  misc_feature (53)..(53): n is a, c, g, or t
  misc_feature (60)..(60): n is a, c, g, or t
  misc_feature (73)..(73): n is a, c, g, or t
  misc_feature (178)..(178): n is a, c, g, or t
  misc_feature (284)..(284): n is a, c, g, or t
  misc_feature (287)..(287): n is a, c, g, or t
  misc_feature (289)..(289): n is a, c, g, or t
cagggtgtgagccatcatgcccagcccaaatgttgncctttttgaagcataanggagaanggattatttttancaagttaggtggcaaagcatttttttaaattatgcaatgacagtatagctgtgctaaaggaatacagtgtactttggacattcccagactaagcactcactatgntcttcctgactcataggacagcaacagtgagaaaaaatagaaaatttaaaacagagtatctcatcccataaaatttcttcataaagaaaaatgttcatgcaggctntantnt

SEQ ID NO: 721185 - DNA, 90 bp, Homo sapiens
aacacagggggtgcagcttttattttcccaaatacttcagtatatcctgaagctacgcaaagaattacaactaggccagatttaccatat

SEQ ID NO: 721186 - DNA, 183 bp, Homo sapiens
ccccattcccctaggcccctaactcttctgctattctgacccagccaggttggagtctctggcatcatttatctaaggactgacagagtcacacagaaaggagctgtcacctcttgccatctgctccagggcctccatccagcattcctcgtgtgccttgattggtgggcacatatggcagca

SEQ ID NO: 721187 - DNA, 584 bp, Homo sapiens
ctggggcacgatctttgtggcattgtcttcattgatcccggtgaggatttcaagctgggcaccatcaagggccagcttacttttgtccaggtgatttcccccggcgggactacgagtgcaacctggtgtccctgcagtgaaggaaagacatggagggctttgtggacaccagcgtggccaagtttgtgtttgaccgaaacctgccttttgtgggccgccagatggccctgcacgcaaatatggcctcacaggtgcattatagcgggtccaacccccccgacatttacccctccaagtggattgcccgggtccgccacatcaaggggttccgccagcggatttgggaggaagccgcttactcaaccccaggccaccctttggtgcaccctccgtcccatagcaaagcccctgcacagactccagccgagcccacacctggttatgaggtgggccagcggaagggcctcttttcctccgtggaggatttcaccgagtttgtgtgaggccggggccctccctcctgcactggccttggagggtattgcctgtcagtgaaataaatagtcctgcccccagggcccaga

SEQ ID NO: 721188 - DNA, 168 bp, Homo sapiens
ctcattgtcaaatgagtgaatgagacacttaccatcagtctcaggttgtttcttaaagacctaatatacaaatatatttgttaaaaacttacagagggcctattttgaatgctttaagatgtatgccacgtaatgtatttttctcttagtgtagaacgttaagagaaa

SEQ ID NO: 721189 - DNA, 800 bp, Homo sapiens
gggttggtctagcacaccagcatataatgagatgcttgatgaatggtgctatatggaatgtataaagcccacgcggtcctgagcagttgctcgaactggagacttgctggagatggagtctcgctctgttgcccaggctggtgagtgcaagggcgcgatcttggctcaactgtaaactccacctccgtgggattcaagcgatactcctgccgtcgagcctcccgagtagtctgggatcacaggtgggtgtcaccgacaggccagctcagctattgtattgttagccaagagatggggtttcacgcatttggcccacggctggtttggaactcctgatcttgcaaattacccacctgcctcaggcctcccaaagctgctggcatttcaggcgctcgcaggcgtttctgactgtgcggcgtgctgctgctcagcaatggtccgttgctcctgtgaaccagcctccttgccatgtccctggcaggcttgtgcctctaggctcccacctccctgtggagtcctgctggctttctcctatctcctatctgaatcctccctgctgtgtgggctcccctggtctcatccgtatcacagcccagtttagtgggcctctgttcctgcgggtggccagcctgtctgtgtggctgggctggggaggccacgtctggtatctgaatgctatcggtgggttgggggtgggaggaagccaggagagggctgcgagggagggagatggtctcagcccacagagtttgcagtctcagtgtgctgagcaaagtggagacccatttccctctctagac

SEQ ID NO: 721190 - DNA, 348 bp, Homo sapiens
ggcatcatgggtctggacagtgtgtattaggctgttttagagggaagtgcgttcacattgatttcctctctcaggcatacatgccctaaaaatgcctcgttgatcttaaaatgagcaactcagaattgttctgaggttgtgctgtggtgggaaatccgcttcttttgagtcttttgtggcttttttctttctttgttcttttggtataaggagaaccttggattaagaagcaagccatctgtcttgtagtcttgggccagcatcacggtccaggggaagccacttcttatctaaatatgtttcattcctgaaataagaggtgaccttaaatgacttctcagggacccc

SEQ ID NO: 721191 - DNA, 312 bp, Homo sapiens
ggacagcttcattaatagatttatacgcacctgtttctattgctccatttagtaataacaagagtcttttgagataaacagtctttggtttctacaaaaggtttttcttaaatttaaacacgattttgagcaatcggttaaattgcctaacaaataggtattatggttaagatacttttaaactgaataccgtaaaatgaaaactttataactactaatggctattaaaaaaaaggatatgaaaagcgaattaagaagcagaggttggtttggaaaaaaagataaggatggaattatttacagaagctgtcc

SEQ ID NO: 721192 - DNA, 283 bp, Homo sapiens
  misc_feature (121)..(121): n is a, c, g, or t
  misc_feature (131)..(131): n is a, c, g, or t
  misc_feature (259)..(259): n is a, c, g, or t
aagatccctgctgctcctcttagaaaacaggtgtggtctacgcagctccactctgcggctcaggcctttgaggcatatgcactcagctcctggagctgagagatgtctcttctcttcactntaccatcagnaaaaaaacaacttttatccagatccttctctgtgttagatgccaggagtgtgatgaagactctgctctggaaatgtcctgaggctgagggagggagggtgatacaaatcccaacccaggtcccactgngaagtcacatccttcaaatgcagg

SEQ ID NO: 721193 - DNA, 204 bp, Homo sapiens
atcggtaccaaccggggacacctttggtaaagtagtccctctcatgaaacttccgtagtcaccatgagttctcatctccattcttccaggatactgagtgacagacatatgcttgccatctagcagtcatattgaatggaaccctataagcgaactaatcctggcatggacattttctgagtatattgacggcctggaagcgag

SEQ ID NO: 721194 - DNA, 321 bp, Homo sapiens
gatgcttgttgctcgtctctcgcaggatcccctctgcatcgctaatcctttgtagttgccctattatctctcttccattcagagactatatagtcccgctgcaggctagcgatctggtgtatacatgacgaacctcaaccacagtaaaacactgtacagagttctttacaggagacaaaaaatgttactccagtctaaatattctaatttgaattttattttgaaatagggtctcactctctcgccctggctgaagtgcagtgatgctgccatcatatggttttcctttggtaatggcaccttcaaatgctcgtattgcag

SEQ ID NO: 721195 - DNA, 795 bp, Homo sapiens
gatggaggctggtctctgtctgaaagcagtgctctaccaagtcctggagatgaagggaattcactctgtttgcagaaaagattctgtggattaatacagaagcaccagcaacaccagaggggtggagactcctttctctcccgattctacagtctggctctaagcccagtaaaacagctcccgagcactgcttcagctgggtccagtcttgacaaaggcaggaagccagctagggtgggggcgatagggtcagcgggtatgtcccactgttggaggtcactggtattctgtggtaaggttggttcgtggtttttggagacagggtctcggtctgtcgcttagctggagtgcggtggcgtgatcatggcactgctattcttgaagcatccacccacctggctactttttctttagtgcagaggtgcactgtcttctttaaggtgggatcgcgtaagcatgagctggtaaggagcacggagaggcaggcagcagggttacgaaagactaagccaattattcactgaaagtcaatccttcctctcctcccaacaattcgattgtgatctacctctaaagccagggttgtgaagacaaagggagggcactttaaaaagacctcagcagtgtggtactgtgtctactttccatgagcgtgtacctgagtattttaagccaggcaagcttaggaacaccaccagttacttggaaatctatgtatataggtgttacagaggcacatgtgtcttcattatttgggccctgtggtccggtgatctgacactttgggaacatggc

SEQ ID NO: 721196 - DNA, 697 bp, Homo sapiens
  misc_feature (422)..(422): n is a, c, g, or t
gccacctggggccgaggagggtctcaatacgcgagttttccgggcaacaactggtgggctacgcgcgcagcgttgcacgaggattttgagcgcccgtctgcgccccggcccgccccccaaggcacccccgggcgcctctcgggtgactccgggctccgtggctgtcccggaccccccccctgttcccttgccgcccagccacaccggccgtaccgaccgcgggctgcccccgttgatgaccggcgtgtcccctttgcagcgcgcaccccggcggggctttggctgtgaccccgtcggggcgccggctgggctgtggccccccggcgcccgcctcctcctggtccctcgaaatcgtggcatctcacttctgagaacgaaatcttcgcgttcagtcactctgccgaaggcgctgacggcatccnggccggaacctcctgggcccggcccctcccaggggcccccgctcccgcttgggagaaacccgctcctccctttccctctgaaaactgagacgattattaaaatagattaaacttcgctggaaatgagtagccccggaagttccacggggagggtccccggtccttcccgggcctggcgtttcggaccaccccggtcccgcactgccgctgaggaaatgccaatatttgttgtgaccagaatcacaaacatttactttaaaaatagttgcccttta

SEQ ID NO: 721197 - DNA, 187 bp, Homo sapiens
cacaagcgcaagatctccaaatgagtacacactctctgtgagcactgccataatactagggagcactttgatcaggacggcatggtcacatgatggtactcagagtatcgcttcccatgaagaactcacatcagaacctacatgacgcagcaaatcacatcactggatctgtaccagcgacctggac

SEQ ID NO: 721198 - DNA, 1679 bp, Homo sapiens
tctctgctgcctctgttctgttggggtgtcctcaccagtacgtttttcgttttttggtgctgattcgcttgctggtgggttggtccgcccgtcgtgtgcgtctcccccctgtctatataaagtgcgtctttatgtgtgctcaccgccagttgcctggtggtggcgtctcgttttcccctgtgaagggtggcgcccgcagggcggtttgttttcatcgcgcgctattggttgtagtttttctttcacactgtgtgctcgtcccacgtggtgattaatatgactggatgtgttgttgcccccctcgggtggctcgctcacattggtcgcccccgctgcattaaatggttgtcctttgggtgagacccccatgtgtcgtaccatttgttgtcgtgttggtggcccctccgccaggttaggggggcgaccacacaagaaaccaactttggtcgccccaagtaagaagttgtttttgtgtttggaaacacacatctgttcttgtggggcttcttttagtctgcggtagtcccccatacatgttctgttgccccccctcctgctctggtttgtaaagtgggagtaaagttgtcctcgcccccccccggcggatatgtagatttctcctcgacgtgatattaatgagttgtgggggagacacccctcatcttgggacagaaagaaagcgggatcacccacttctttataagatggaggcgacacctctgtttcctcctgtgttggtcgcgaattatcccacttctggggcctttttttatccgaccacgtcatcgacttatgcgggggggataacacccccttctgtgagcaggagcagtggtggccacatcacatcacgccggtgggagaccccctcacgtggtcgttgttttcctggtgaagaatgttgataattgtttctcaacccctctggggaacaatatgtggagaccctcttggagaggagaaggttgttgacgcccacgagtctcattaatttgtgagagtgttcgccactctggttgaaattatattccctcttggggtgcgacacactatcgcacagtgtgtgcgcccggacaccacacagatagagattcttgagagagtggggggatatatacacacgcgacacactcgggttcctgcgcgcgagagtgagagagagagtttcatctgcggacacacagctggagcaccccgcagagaagagagagagtgttctacacctctccgcggcgccctcggagaatccgcgggctttctcttgtgttctctccacgccaccacattgtggttaacactctcttgggccgcaagagattttctcacacatgtccacaatgttctccccacagagattctcccacgcaagggttctacccacagatatctctctaacacacattcgcagaggaatagtcctccactctccacaattgttcacggcactattactcccaggagtatgccacgagaacacactcgcgggaacgcgccgcgaggcccgcgaatttccgcggagaaacgagccacaagcgcactccctcggggcttgctggaggaaactttctagaggcacccctggccctgcgcatcctggactctttccgcttccctcccccggatccctttttaccaccactctgtgtggcttttggacccaattaaaagctagttttggt

SEQ ID NO: 721199 - DNA, 225 bp, Homo sapiens
tagagaaacagaacagtggctaagtagccaagagcaagacatgagagtgtatagcagagtgccttgattagagtggtaacctagtcttggaagcaattcagtggatgtttcataaagaggactagaacttcaagaagcctcctgtgctggctgaggtgagcccttttggtatatgtacactactgggttgcctagaagccaattcatgaagaaaagagtgcttgg

SEQ ID NO: 721200 - DNA, 117 bp, Homo sapiens
tccccactgttgctcatcctcactgtgttctccatttccacccgtgaaaagctgaagaatgcattctctcttcagcttttcacgggtggcatcccccctgtgtgctcctgtgtgctc

SEQ ID NO: 721201 - DNA, 718 bp, Homo sapiens
gtccgccgaggtgctcggtggagtcatggcatgtgccctttgtggaagactgggaccttggtgcaaaccctgggacgaccggtgcctactggagaacgttcaaccttgctgtgaactagagtaactgaagacagcagtcgcagtgaagacttgtacgactatgaacgcgtgcccggtacgacctggtccacgagaacacctacttacacgacaacgacgactactggtactcaacgtaacacactggctaaactcactgacacacactggtacggtaccacacttgctatgcgatcaccacgcggacgacgaacggccagactacatcgcaaggtactactgaactatatgcgtcgggaagggtaccgtcgttacgttgggaccgggacggacggcttcctatcgtggaccgacgaaacgtacgaaagccgcaatgagagcattacgggcacttgaaccctggaggcccaggattgccctcccgaacgaactggcttgtccacgtcacagccttccagttggaaccacgggggtgcttgggccttgtacgttacgttggcacgttgcgttaacttcggggcaacattcacacccttccacaccaggtggaccttagtgaacacaacgcacgaacacaaaagtccgtgtccgtgggtatcgcgcactggcaccaacggggcacatacaccagccttccgcgacaaatactcttccatga

SEQ ID NO: 721202 - DNA, 177 bp, Homo sapiens
atggttatagagaaatggcaggtatagttttgggcaatgtgattgcatatgcaccttactaggagaagggaatggtgggtacccggtagtgctcttttgttcttgcttcgttttttttatacttgaactttacttcgttagatttcataatactttcttggcgctcgtaggacgcga

SEQ ID NO: 721203 - DNA, 226 bp, Homo sapiens
tgtgcgacgtgtacccacttacagcaatggatagatcaacagacagaaaatcaataaggaaacacaggcctgaatgatgcattaaaccagatggacttaatagatatttatatgcacattccaatccaacaagcaacagacatacacacttattcccacagtgcacacgtgaacattcatctaagacttgatcatatatctggtgacggtaacaccaccagtactg

SEQ ID NO: 721204 - DNA, 218 bp, Homo sapiens
gttctgggtcactctgaggatccccccgactagccgacagccggtggtggtagcagcgggcagctgcagagacggaggcgcaaactccccagtgcaggaggtgcttcagcccgaagtcttgcacttggcagcaccatcgcaggtagaggcttgggagggacgacattgtggacagatagcttgaggcagtgtccgtgatgcgtacacaccctgtcggg

SEQ ID NO: 721205 - DNA, 119 bp, Homo sapiens
gaaggtgaccctagagtatccccaggcaaagctcctactgtttgccagagcacctggcgaaaggattcatagctctgtaacaccaggcaggagtgcagtggcgcaatctcagcttactg

SEQ ID NO: 721206 - DNA, 160 bp, Homo sapiens
gcagcaggagagccttaggctgaggccagccgtgagtccacagatgccagctcagcttccagcttgggaaaatgcaggcaacagggaatttccttgggggagttttcttccactgtagagatttgatcaacccatggaggaggattcattatgatctttt

SEQ ID NO: 721207 - DNA, 470 bp, Homo sapiens
cgcggacaagtcttagcaaatatcagagttatacttactttgcataatgagtgaaaactagaagattggtcacgcctgtaatcccagcacttatgggaggccaaggtgggcagatcgctggaggtcaggagttcgagactagcccggacaacatggtgaaaccccatgtctactaaaaaaaagtacaaaaattagccagacctggtggcgcatgcctgtagtcccagccacttggcaggctgaggcaggagaatcgcttggacccgggagacagaggttgcagtgagccgagatcacgccattgcactccagcctggtggacagagtgagactcagtctaaaaaaaataccgactataccaataacaaaaaagggcagaaaaaactatatacgcttgtaatcaataaaaagatgatacatctcagcaggaaacaaacaaacaaagaaacacatgagggtcagccactgtg

SEQ ID NO: 721208 - DNA, 553 bp, Homo sapiens
gatgtaggcctggtagttcctcatacggagtagggtgaggccctagtcactgtctactgttaaccaaaagaggtgggcaggaacccctggcctacacacctttgccattgtaggaaatatagcataggcattacatctaaagcaagctttcctaatattactaccctgttcctaactaccaatggttctttttttttttttttttttttttgagatggagtctcactgttgcccaggctggagtgcagtggcgcgatcccgactcactgcaggctctgccccacggggttcacgccattctccagcctcagcctcctgagtagctgggactacaggcgccaatggttctttatttatgaaaagccccttgtaaaacctggttcaagtaaaacattttgtgatttatttaattgttgcatatgaataaatatagtttttaaaaagtatcagatgaaaatgtatatctatgaacttaccactatacttagaagtaaagttatcaacatctttcactcctctacatatttctccttttacccatttttctgtcctt

SEQ ID NO: 721209 - DNA, 943 bp, Homo sapiens
gatgtgggaataacatagagtcacgatcctgtaagtgccaaagccaagttggttggaggatgtggattttgaatgagagtcagagaaaaagctgggtatatcactccagttcctggagttgtgtcccatgataggggcactgctattgatgaatagccatgtatgttgcaagaagaggtgctgaggcttgaagagcgagaagtgcgtgaagtctaaaagagcttggggtaggcacataattaacatactgtgtcttcgtgtgtcacaaacgagtacgtccagtggcaggtcaagaagcaaagaaggccaaatagaaatgcagtattttgaatttatgctactgaagatggttgtacaagtgatgccttgtattttcatttgagaagcttaaagtgggtggggtgtactgcgcatacctcttgcgagtaagctcaccagggagcattccatgtatcatgcaagggtcctgtgatctagccaggagcaagcattaacctagtgattcaatatgggagaccattaccatatggaggatggattgcgtacatttgtcgagcacgtcagttgacaacattcgccttttctaggaatgatttcccaagtgcgtatgaataacagttggatactcatatgaggtacccaaacctttgaggttccactgatcaaaccaacaggcaaccgggctggtagaagaaacgttcgggaacagggtggacaccgcacacatggacgtactggggcaacaaaccataattctgattggtttggttggaccccagttcctccaagcacgggtgggctcggacaagcgaaacgggtgttcaatcccaggcgctcgggcgcagaccatgcgaactacgagatactggcaacacacgagtcccacagatacaccagtgccggaagagcacacacggcgggagggcaacaacacatgagggca

SEQ ID NO: 721210 - DNA, 326 bp, Homo sapiens
ttgccggtcctcagtcctctttttttttctcttccatgttttgttttggaattttaataagtactaagacagccgggcgtggtggctcgagcctgtaaacccagcactttgggaggcccagatgggtggatcacctgaggtgaggagttcgagaccagcctgaccaatgtggtgaaaccgtgtctctactaaaaatagaaaaattaagtgggcatggtgacacatgcctgtagtcccagctagtgaggtggctgagacaggagaatcacttgaacctggggggtggaggttgcagtgaaacgagatcacgccactgcactccagcc

SEQ ID NO: 721211 - DNA, 833 bp, Homo sapiens
  misc_feature (1)..(1): n is a, c, g, or t
  misc_feature (68)..(68): n is a, c, g, or t
  misc_feature (71)..(71): n is a, c, g, or t
  misc_feature (85)..(85): n is a, c, g, or t
  misc_feature (87)..(87): n is a, c, g, or t
  misc_feature (93)..(93): n is a, c, g, or t
  misc_feature (115)..(116): n is a, c, g, or t
  misc_feature (136)..(137): n is a, c, g, or t
  misc_feature (147)..(147): n is a, c, g, or t
  misc_feature (170)..(170): n is a, c, g, or t
  misc_feature (186)..(186): n is a, c, g, or t
  misc_feature (207)..(208): n is a, c, g, or t
  misc_feature (216)..(216): n is a, c, g, or t
  misc_feature (223)..(223): n is a, c, g, or t
  misc_feature (235)..(235): n is a, c, g, or t
  misc_feature (269)..(269): n is a, c, g, or t
  misc_feature (281)..(281): n is a, c, g, or t
  misc_feature (291)..(292): n is a, c, g, or t
  misc_feature (304)..(309): n is a, c, g, or t
  misc_feature (312)..(313): n is a, c, g, or t
  misc_feature (330)..(330): n is a, c, g, or t
  misc_feature (333)..(333): n is a, c, g, or t
  misc_feature (339)..(339): n is a, c, g, or t
  misc_feature (344)..(344): n is a, c, g, or t
  misc_feature (350)..(350): n is a, c, g, or t
  misc_feature (380)..(380): n is a, c, g, or t
  misc_feature (391)..(391): n is a, c, g, or t
  misc_feature (655)..(655): n is a, c, g, or t
  misc_feature (813)..(813): n is a, c, g, or t
nactattcttctacttagttgctatgttaatctatttgcttcttcagcaagttatcactgactcagtngtnggataatctaacanangatttnccttcttttggttctgtgggtnnggggtttgagcattggtctnnctgggctaangaggtgccagctgggctgccttnctttctggggactctnatggtgtttctgtttccttgnnttttcggnctttttntacaggtccccntctattccttggctcaaggtgtcttcctccttcnaagccacctttnaacttccttnnaaagtggttgtnnnnnnggnncaggatcactctgaccnccncttttnttttntttttnaaattttaaaaatccctaaaattatattangccctccaaantaattcaggataatctccccatctcaaggcccttaataacattttaaattaatcacttctgcaaaattcttttgcaatgtggcataacatattcacagttcctgagaattaaaaacattggcatccttaggcaaatctgcttaactttttcaatttagcttcatatctttttttactccaagatagaagagtgatgtttaaagtactcaagttacagccagcatttaccaattctttgattcgactttttaaagtacttatgcntgaatccagaacccgaggattttcgattatttgtgaaatgctaatgttttcttccatgagggagtgtattttatcattaaactttttctctgccaagaagatcacatctggatagcttaagaaaaacttctgtacctcttcttcagtacatccaaganaaacagctctctttgacgtt

SEQ ID NO: 721212 - DNA, 871 bp, Homo sapiens
  misc_feature (871)..(871): n is a, c, g, or t
gatctcggctccctgcagccttggcctcctgagctcaggtgatccttccacctcagccttctgagtagctgggaccgcaggtgtatgccaccatgcctggctgtttaaaaaattttttgtggagacagggtttctctatgtgctcaggctgggctcaagccaccctcccacctcaacctccaagtatgggttaaaggtatgagccattgtgccctgcctgatatgctatgtaaatgaaactgtgtaaataatttaaaatcaaaattataaactttggctgggcgtggtggctcatgcttgtaatcccagcacatagggaggctgaggcgggtggatcacttgatgtcaggagttcaagaccagcccggtcaacgtggtgaaaccccatctttaccaaaaaatacaaaaattggctaggcatggtggcgtatgcttgtggtctcagctacttgggagcctgacgtgggagaattacttgagcccaggaggtgggaggttgcagtgagccgaaattggaccactgccctccagcctgtgtaacagagtgagaccctggtcttcaacaaaacaaactaaaactttttacatctctcttcagaggcacaagcctggtaggtgtcaggcagaaaaaaggtgcgtactacaactctgggcgcacgcggatgttggcaaacaaaccgcggggtttcagtgcacgaactcaagcaaatttgccgtaagaagataaccgctgtatcttgacagctgtgtcccgtctccaggggtcacctggtcggacatggctgttccaatggcgaccatggccatgttctgggcatggtcacccagggtaaggttgcacgatacgacgagagccgtatgtaggatttcn

SEQ ID NO: 721213 - DNA, 509 bp, Homo sapiens
  misc_feature (200)..(200): n is a, c, g, or t
  misc_feature (272)..(272): n is a, c, g, or t
  misc_feature (305)..(305): n is a, c, g, or t
  misc_feature (318)..(318): n is a, c, g, or t
gcacgactagtctatatgcttgattatgtcagaaaggtcctttgacttcaactctactcatttgaggatctacctcgagtggaagtgtcaagtcattcttcaaaagggatttatctttacaattcagttttcttttgttcagaaatggcaaggcaatattttcatttcacactcttcgctggcgtttctgattctgtggnctgtctcccatctgtccaggcttcccgggtactctttagagccaaggtcttctgttggtcaacaacaacatnatccactctctcatctgctacactgctgcctgngccactgctcttntgctaaaacacaaagaaaaaacaaaaagtccaacatataaaggagtgttcctgagtacaactcagtcttaaaacacaaaacacatccactgtgaatactttttttttttgagaaggagttttgctcttgttgcccaggatggagtgcagtggtgcgatctcagcctgggcaacagagcaagactctgtctc

SEQ ID NO: 721214 - DNA, 792 bp, Homo sapiens
  misc_feature (82)..(82): n is a, c, g, or t
  misc_feature (192)..(192): n is a, c, g, or t
  misc_feature (198)..(198): n is a, c, g, or t
  misc_feature (223)..(223): n is a, c, g, or t
  misc_feature (375)..(375): n is a, c, g, or t
cccctgaaacaagtttcgagacaggaatcaagggttaaaagccacagtttcccaaaataggccttaagccaggcataacttnccgccagtggtgcctgaatgtgttcttcaagacctccacttggcggtgtccagaatgctcagcttgtagcccccatcgttgaacagctttataaagactcaagcaacccntgcacntgccaggtgttgaatgggcctaagnacacctgaggaagtgccgcacacggggtctaagactggcagtgatctcaactttgaccgacggctagagggcatcctgaagggccttggcctgcgtgaacacttcgactttgtgctgacctccgaggctgctggttggcccaagcgggaccnccgcattttccaggaggccttgcggcttgctcatatggaaccagtagtggcagcccatgttggggataattacctctgcgattaccaggggcctcgggctgtgggcatgcacagcttcctggtggttggcccacaggcactggaccccgtggtcagggattctgtacctaaagaacacatcctcccctctctggcccatctcctgcctgcccttgactgcttagagggctcaactccagggctttgaggccagtgaggatagtggctgggccataggccatggagataaccttaaacataccctggagacagggagccccttctttctccacagctctggacctttccccctctccatggggcctttgtcacctactgtgataataaagcagtgagtgctgagctctcacccttccc

SEQ ID NO: 721215 - DNA, 344 bp, Homo sapiens
gtcaaaagcaagcatgtaggtcttggtgtccctgaggctcaccgtctgcacattcaggtaggtggtgttatatatgcactggtcctgtcgggtctggtactctctgagaaagatcgtgtcctctgtcttgttgggggtaatgtaaaaagaggtcgttgtatctcgtgaaccgacttattgcactcctcgtttcaaagaggcctatgcgatataacccccttccagtattgtccagggtgctggttatgggcagcggttctaggttggcacacatatggtatctgggcttacagcagaggtaggaggctcagctctgtaagcacacagcacagcgccattctgag

SEQ ID NO: 721216 - DNA, 1237 bp, Homo sapiens
  misc_feature (408)..(408): n is a, c, g, or t
  misc_feature (708)..(708): n is a, c, g, or t
gacaggtttatctttctctcaccactcaatctatatatacctcttgtgggcaaggccagtttttatcactggagcctttcccctttttattatgtacctctccctcacagcagagtcaggactttaactttacacaatactatggctctacatatgaaatcttaaaaatacataaaaattaataaattctgtctagagtagtatattttccctggggttacagttactttcataataaaaattagagataaggaaaggactcatttattggaaagtgattttaggtaacatttctggaagaaaaatgtctatatcttaatagtcacttaatatatgatggattgtgttactcctcagttttcaatggcatatactaaaacatggccctctaaaaaggggacaaatganatgagaaactctctgaatgtttttctcccctaggtgaattcacctgctgcttagaagcttattttctcttgatttctgttataatgattgctcttaccctttagttttaagtttcaaaataggagtcatataactttccttaaagctattgactgtctttttgtcctgttttattcaccatgagttatagtgtgacagttaattcttatgaaaattatatagagatggttaaatcatcagaaactgtaaacctcgattgggaggggaagcggatttttaatgatttcctgaccaagcttnaccagtatattaatcctttgtactgttctttggtataaagaaaaaaggtactgtccagcaactgaaacctgctttcttccatttagcataccctttttggagacaaattatgcacagttgcaactcttcgtgaaacctatggtgaaatggctgactgctgtgcaaaacaagaacctgagagaactgaatgcttctttgcaaacacaaagatgacagaccaagactcccccgatttggtgagaccagaggttgactgtgatgtgcacttgttttcatgacaatgaagagacattttttgaaacaagtaagtaatcagatgtttatagttcaaaattaaaaaagcatggagtaactccataggcaaaactcttataagaattaccataacaaaaatattttcaacattaagacttgggaagtgtgggtcatgatgatcttttaaagaagtaggtattgatacgcaaaaatgtctacaaagcaaaacatctgatcaaggatattcttgaagtttattggaacagcgatccat

SEQ ID NO: 721217 - DNA, 249 bp, Homo sapiens
gccttcgggtgtccgggacggtgttttccactgggcgagggaactcataggacatagtggtccttctgctaagccgaagggctgccacgagtgacacagtagccagatcctgcaattccaatgagagcagccaatacagaagaaagcatcgcacatcgtttgccacagttttcatggccacagcagccacagcagtcatcctgttccagcccaatgaagacaaatgctggcaggagcaccaccaataca

SEQ ID NO: 721218 - DNA, 653 bp, Homo sapiens
gattaggtgaaagtacgtagtctgtcttgcgtaggttaaaatgataagtgggccgaaacttactgtccttacctaaaaggcagcgcagtcaggatatgggctaggtcgtggggcgggcttcggtaaacccttagagtttacaagcatgcgcggactgtgcagtgctcattaggtcgccgggcgtcctacgtgcagctcctggaccctgatgcccgggcgtgcgtgggccggtgggccctcggggaaaggttgcgtgcactcggggactccggtgaagcctgttcagccgtctgtgtcatgtggccatcttgagtctactctgtcgctctggtgccctatgataccctgagaacctgtcagttgtgagccagatggaagctgagctgaacacgattactgatggatgatggaaacataagactatcaaggaaatccaagtggtaatgggcgaagttgattcgagcatccggcaatggacttatcgtgagttgggggaaacgggtgtgccgaataatatcctggaagtaatcaggaggagctatgtcagatataggcctggaatatcgtgagaagtaatatttaaggtgggtccgtgagtcaattaaagtaagactgcttaattcataaaaggagctaatgcgagagaatcgaag

SEQ ID NO: 721219 - DNA, 954 bp, Homo sapiens
ggcggccaagcaggcaagaagaaaaagaacaggagcaaacggcagacgaaacgcacgaagacaacgcgacaagagacgcacgactgcacgccgtggggcacagatcagggctcagggtaacgcccctcagcgatggggcggcccgcatgtgcacgaggccgcccggtacacggaagtccgatggaggccagcggcggcccggaggtaccgcaggggtcacggtgtgccgccaaggcggccctctccaggtcaagacatatgggccaacatagttggcgggagcgcgaagacacaagccgtctgcaaacagggatggtttgtcaccttctcgatggagatacgaaatgtccgtcgtcaccgccaaggggggcccgccccctgaagacccaggaccaggagcacgcgagtaaagaaacaagacgcgtgacttctggatcaataccaaacgggtccacatgtggaagcccgagagtaggtgcgccccaagggagagatccacaacataagcatggcacctattgcctaactcatctggggaaacatggggtggaaatatggcagacggaccaggtgcccgccagcatgccccggcggggaagatgccgacggagatcccagttcaacccgccgccgagcccccgaccctatgggaaggggccccgcgaccgccaccatgagagggcttggcgaccccaaggccaacccctaagtgggcgacggctcaccacctcagcggagaccacaacgatcaggggcccctttacttgagggaaaccaaaagacttctatggtatgaggagacacagtggggcccacacacgtgggagctcgcaccacatctaggcggggcacgaaggccgcagggcgagtcaaagatgggggcccccaacctggcgcggttagccccacgcccggggcaaaccagcaccccggattttcccacaaacatgacaa

SEQ ID NO: 721220 - DNA, 412 bp, Homo sapiens
gttacagctcacttggagctgtgggtatgggcttccacaactaccaccactacctattccctatatactactctgcctagtgatgataccgctgtgcatatcaatctattcaccacattcttcattgattgcattgtcgccctctgtctggcctatgatcggaagaaagtctccaaggccgccatcttggccaggattaggagaaccggagatggcaactcctatagtggctgatctcaggtgtccctcaggttcctttttcataaaccagtcaggcagaggtttcaagtgtctgttgtattacctgactgcatactgctaccaggatgctaatgatgatcattttatctcattccagtacagtattcttttataattctagagtattgaatgccggctattctgcctttat

SEQ ID NO: 721221 - DNA, 92 bp, Homo sapiens
gaatccttggttatctccgttacccttttcttgctggatggaacagaaagataatcagggtgcgtgtgaacatcagacttccgcagacagag

SEQ ID NO: 721222 - DNA, 262 bp, Homo sapiens
gtcggggagggggaggcgggatgagaacccccccaccctcctcaaattattcagagggaaactcagatgtccagactaattttaacaaatgaccccccacgttcactcgggcacctggcccagcagtggcactcgccccgccacccccaagagaacaagagcgccgatgatttctagcaggcaggaagtcctgtgaggtgtcaccatgagcacctccccaatgtactagtgcgattggaataataaatttgataaggtggtg

SEQ ID NO: 721223 - DNA, 98 bp, Homo sapiens
  misc_feature (46)..(47): n is a, c, g, or t
  misc_feature (52)..(52): n is a, c, g, or t
  misc_feature (56)..(56): n is a, c, g, or t
  misc_feature (58)..(58): n is a, c, g, or t
  misc_feature (61)..(62): n is a, c, g, or t
  misc_feature (65)..(65): n is a, c, g, or t
  misc_feature (70)..(70): n is a, c, g, or t
  misc_feature (83)..(83): n is a, c, g, or t
  misc_feature (86)..(86): n is a, c, g, or t
  misc_feature (93)..(95): n is a, c, g, or t
gccagcaccaaccagacatctatgtacctctgtgccagcagccacnnagacngggncnaanngancagtncttcgggccaggnacncggctcnnngtg

SEQ ID NO: 721224 - DNA, 274 bp, Homo sapiens
atgctgcagtcgatctaaggatctccaccgcatctcagcatcaatataaatatcaaaatagtacttattttttttattgggccgggggtggggcccacccttgtatccccagcatttgggaaggctgaggtggaagaataacttgagtccaggagcccaaaaccagtcggggcaacatagtgcccccccttgtctaaaaatattttttttaaaaatatatgggctgtgaaaaatggtaattttataggggcaaaatgttggcagttagagcaag

SEQ ID NO: 721225 - DNA, 192 bp, Homo sapiens
gacgactctcggggtcagaatgtctggttgtccagcagactcgccgcgcgctccaaccctggataatcgcgtagatcgattaaagacacgcaagagggtcgatttgccgcagccggacgggccgatcagcgcggtaacgcgattggaagccagttcgatattgacgttgttcagcgcctggacacccttgta

SEQ ID NO: 721226 - DNA, 211 bp, Homo sapiens
cattaaaggccttggtagttttccttatgactgattgtggtaccttacacacacccggaaggcacgagggaatgggatgtactttggttctctcagtatttggaaagtggggcaataaccaaaacaactaacatttgtaacatcaccaaggaggggaaagaggtgtttgaactatttgaacaagtaatggctggaccttctccaatttagc

SEQ ID NO: 721227 - DNA, 427 bp, Homo sapiens
ggctttgcataggggcgaagccgagcgaggtgagcagatggcaagaaggcagaagcttccagctgtaccaagaggctgctcagttggacatgctgtagagaagctgcccaggtgcagaggaaacagtgtcccttgattcagccaataagatcacactgtgtccagcggcagtgggaccatggcggcagccaaagtgactggggaagtactggacattctaactcgcctgccaagagagtgtggaaagactcacaggcgtgagcatctcccaggtgaatcacaagcctttgagaacagcctgagccttcagccctcacagatgcccagcctcatagctgaatgttgcctgaatgatcctcctgttgcatgtaacccactgggctccctgagcatgtccattgacggtgaggtcccacccctcatctct

SEQ ID NO: 721228 - DNA, 134 bp, Homo sapiens
ggctagaagtgcccatagcagaaacactgggtacagctcctcagggttcccccccatccagattatagtaacctgatcgacacctatcacagcgtactccagttgacatgctggcttgcagatcacacgcggcc

SEQ ID NO: 721229 - DNA, 545 bp, Homo sapiens
agtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccatttgttgaaaatgctgtctttcttccactggatggttttggctcccttgtcgaagatcaagtgaccacaggtgtgtgggttcatttctgggtcttcagttctattccattggtccacttgtctgtctctggaccaataatatgcatgcagtttttatcactattgctctgtggtatagtttgaggtcagggatggtgattcccccagaagttctgttattattaaaaattgtttttgctatcttgggttttttgtttttccgtcgacgcggccgcgaatttagtagtagtaggcggccga

SEQ ID NO: 721230 - DNA, 354 bp, Homo sapiens
ggaagcagagacaggtcggtggggcgaggcctcagaacacccaggaggcttggacccacgtctcaggagaggagagactgcctgcccgggttggggagggcgcctctgtcctttaggagcccaaggccccgggagcttcccagtgctcacttgggctgcagcctgcagtgtgtgggtttcacttcctgccctgcccagggttagggatgttctgtcagacaggccatctccctgccagacctgggtctccacagactgtttcctgccatcttttcgctctgttgtgtggctccctcccgccaggtgtctgctgtgagacagaccacaggcctgcagacagttgccagccagaga

SEQ ID NO: 721231 - DNA, 746 bp, Homo sapiens
agggaaggggcttctctgtgctccacacttaccaggaccacttgtggcggtctggaaactacagtcctctaccaccttccatatgctccactggcctctgtgattccagcgagatcgttcagtgagagagaaggggtctgtccatatggactccaccctggcagggatacatgaggcacatgaccctggacgggggaagtaggagaatggggaggttcaccaggcacgtgaagacattgtctcctctcagaagccccataagacaccgggcatccaggggcctgaatccaatgactcctagcatgagtattggaaaacgcttcaagaacaaatggatgaagctgttagcagcaatgcttcttacgatgccttgaaggtagccgagtcaaaaaggctgacctccctttactcaccagcatctttccttggtcagcgccacatgttctccgtgctgccccgaaggacgacaagctggacataaagaagtcaagctacaaaaagctctctaatgttcctgcagcaaatgcagcaggagcgagattgatacaggtgaaggagctgagcaaaggggtgtgagagcattgtggctgtggactggaaacacccgaggattacatctttcgtcatacccgagccctccccgactcccagactatccaggagggtagcagggaacagccctatcaacctccaaatataaaaccctctaatgtgtccaacagatgacctgtcttccaggagttgga

SEQ ID NO: 721232 - DNA, 219 bp, Homo sapiens
gtcagtgggatgatgtggttgaatgggtgatgcggttgaacgggtgatgcggttgaacgggtgatgcggttggcaagtgtggagcaacccccttcaatgacaaggcacaaactattctgtgcaatggagacgatgaggggtgggacctcacgtgtcaattggacatgctcatgggaggccatgtggtgaggatctgcttgcagcccagtgagttcttgg

SEQ ID NO: 721233 - DNA, 122 bp, Homo sapiens
cagccacctgacgtgcccacctggacgtagcccacctgacgtagcccacctgaatgtcactacccccaggcggttggggtccacaagtgctcatgatgcgggcaaattctgcttctccctgg

SEQ ID NO: 721234 - DNA, 163 bp, Homo sapiens
cactctaccgatcttatgtagaccaggctgagtaggctaagtcgtagctggctgtaacgaggtcagcacaatgaccacatctcccttcttgaagaagcctcggggcttgccaacattcatggcaaagttcacccggaggtccacgtcctcagcgctgggtctc

SEQ ID NO: 721235 - DNA, 567 bp, Homo sapiens
gggggagaaaaccgcggaactaaggactgaagatgcctgtggacagaacattcaggtctgactcactggtggtgtgcgaggtacacccacagctaacagaaaagctgcggaaatcccgattccgaaatgagacagacaccgcagccataataatgaaggcggacatagaccgtcacatggtggtgctgaccgtagaatgctcagaacatttacccataggagctcaaaatggctgacccggtaagacacgccaagttcgaggattacagctacaaatgcccacatgacaagcggtaccaatgacctaccatttgagtcaagtaatatccagtcctgtggactggatgccacaacaaatcatgatgaatgcagggtgtacaaacaagctagtgcatacagcagagcttacaaaagtgttctacgcaccacttatgacctgactgaggactggctgcaagaaacgccatcgttcatgcgtagatctacgatctgaagactgaattgacgatgtgctaaacctcgtgactggtgacttggaccctctaggaccttaacaaccaagactta

SEQ ID NO: 721236 - DNA, 384 bp, Homo sapiens
  misc_feature (384)..(384): n is a, c, g, or t
gaaaatatgcctgaccttcctgagtcaaaaaaccttcacaaaaaacttcgaactcacagaaacaagtcagggcaccctccccatagggaaaaaacgtaaagtggcccacgaaatgggtgtcacgcctgtaatccccagcactttgagagcccgaggcaggcagatcacttgaggtcaggagtttgagaccagcctggccaacacagcaaaaccccgtttctaaaaaaaaaaaaattggccaggcgtggtggcacctgcctatagtcccagctacttgggaggctgaggcacgagaatctcttgaacccaggaggcagaggttgcagtcagccaagatcatgccactgcactccaccctgggtgatagagcaagactgtatccan

SEQ ID NO: 721237 - DNA, 368 bp, Homo sapiens
tttcacccaggctggagtgcagtggtggcaatctcggcttactgcaagctccgcctcccaggttcacgccattgtcctgtctcagcctccctagtagctgggactacaggcacccaccaccacgcccagctaatttttggtattttaataagagacggggtttcaccatgttagccaggatggtctcaatctcctgagcttgtgatccacccacctcggcttcccaaagttgctgggattacaggcgtgagcaaccatgccctgccgtcagtgaagagttgccttcactgccaccgtgtgaagaagtcttgggtgggctccaaattagtcacggataagggatgtggctctatgtagttaatggggaa

SEQ ID NO: 721238 - DNA, 305 bp, Homo sapiens
  misc_feature (305)..(305): n is a, c, g, or t
gatgactccgtgcgctttcgatttctcaacaatatcccgcaacggtgtgatgtatcttgactgggagcgcccccccttctgactttggctcaagcgcctggaatccgagcgattcaaaacatcacctgacgccaccgacgaagcgattgtcctcaccgttcaggaactgaactggttactcgactggtttgacctctggcgcaatcgcccgcatcaggttttgacgccgcgattcgtcgcctgattcggtataatccgaggcatgatttccatgcccgaagaccttgccgatgaccccgtggagn

SEQ ID NO: 721239 - DNA, 1258 bp, Homo sapiens
atcctcaacagcaccttcttcgaacccggcggacggcaggagaccccatactataccaagcacctattctgattattcgagttcaccactgacacagttatactacttccttcatacctagcgcagcgacttacggacaataatacttcaccatagttgataccacttgaaactagctgccgagagataaacaacgaagcacaatgtctggattaccatagggctcatgcgatctgaacgcctctgattactcaaatgggccttcgcatagggggtgtatattcgctcgtagaagcaatcaacccattcaataatatgttacagttagcgtatactacgaagcggattagtatctacctagcaggacgcctattattatctccaacctcctccacgcccttaacgcacttcacattaccactccgcccgtaaattctcacgcgaacgcgggggcagctcgagacacgcttactatattaaaggcgtgaatcctacagccccagacaatcagtacactaaccgcgcataaggcaaaagttactcgcaaacattcgcatttactaggcactcgacttacgctggcattctgcatgcgccccattagcgagattatacctacttcttattttctatctccttgcaaacacgtttcaacgcatggagcctcgaaacttgaggcaatatagctaatctcgagaacaaacaaccttctatactatctcaaagaaccattcggttcacttatccacccgaaacaccgcatcacgtgactggtttcgttaaatggcttcaaccctcttccccagtaatcaataggttccccttcaattcaaggacttatacgtgtacaggccagtgttcatttgtcgcggtctccaaatccaattaaggtgcaccgagaaccgtggtcaagtttcctagcctggaactttctaccgccggcttatatataccgccaaggggccatacacgaggccctttaggaagcgcgaaaaagttcctctaaccggtccaaaataaacactttccggcagttttctcacaacccttaaatttccacattccttttccaaattccgtgggccgtttacaaaatctccggtaacacctgttttcattttcccttcaccaaacatataatgtagtcttccgagacccatacttcccgtgtagaatggtcccccggaagggattgtacctcccggaacttacctccggaattgtaggatccggaccggacgatgtataggaccttcct

SEQ ID NO: 721240 - DNA, 442 bp, Homo sapiens
  misc_feature (155)..(155): n is a, c, g, or t
  misc_feature (267)..(268): n is a, c, g, or t
  misc_feature (278)..(278): n is a, c, g, or t
  misc_feature (285)..(285): n is a, c, g, or t
  misc_feature (296)..(296): n is a, c, g, or t
  misc_feature (367)..(367): n is a, c, g, or t
  misc_feature (383)..(383): n is a, c, g, or t
  misc_feature (432)..(432): n is a, c, g, or t
tcatagtcaaagccagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagntatatgcaccagccccttgtgcatttattggtttctgcctgattttgtggcatttaaataggtccaaaatgcagaacctttgtgatcttctctttggaggactatggcagcnnacagacatgncccccgntgacctgcctngctgtggtatgagcatatgaccaaagagcaggacttctctgctctcatggagttcctgaagttgctctggnggcagggcgattacgnttatgaaacactaaccactgtgtaacatataaatctacccttagcaganaaaaaaaaaa

SEQ ID NO: 721241 - DNA, 142 bp, Homo sapiens
tgagctcatgctgtatcccagcactctggaatgctacgcgggtgggttgcttgaacccaggagtttggccaggctatggcaacatggcaaaaccgacctctacgaaaaatacacaacattagccaggtgtggtggcatgcac

SEQ ID NO: 721242 - DNA, 144 bp, Homo sapiens
gaagtgcaccacacgcatttcattattcatttcattatttcatttcatcatgttcatatcatgtcatttcgagccaggtgtggtggcgcactccagtcctgggtgatagagcgagtctccatcttgaagtgcaggaaacaagag

SEQ ID NO: 721243 - DNA, 209 bp, Homo sapiens
tgacaccaggaagacggatctatctttctgcagcataccccattgagttatctggatcccctgagactgacgaagaaccattaggcgaggagcaccagcacaatagcaccagcacgaatacccttagcaccagcacgaattcccttagcaccagcacgaatacccttagcaccagcacgaattcacttagcaccagcacgaattccctt

SEQ ID NO: 721244 - DNA, 628 bp, Homo sapiens
tcttatttaagaaaagagagggtctttttttttacccctgtcatcgcccggtgctgttccctctaacaagcccccaagattgtttttaaactatttgcacagagtttgtttcagtccccactccttgtaatcatgcgtgtggttgagaccctcccaggcgtccgcctccctttattcgaggaaaatttatttttacaagaatttagaaaggacaaacaaaaatttttctgcctgagatactctagcctctcaaacccgctgttcaccgcgaagagataaatgtgagagtttgaggaacctgttacttttattgtcgcggcacacctttttgtgtatggagattgatgcccagtttttcttccagcctgtgggatgcttgtgctgctgtccgccgcgtgtggaccatcccgccccctttgtttggaaatgtggctgtgcagccctgcttgcattgtcacgcccggtggagattccccggccacgggtggtgaccccagaaaaaagaattttttgggtttgcggttaatgggttcaggttcaccccacggaaaaaacccccctttggtttaacccataaaattttttcggcctggttttttttttaccaaaaaaattctgtaaaccccca

SEQ ID NO: 721245 - DNA, 1140 bp, Homo sapiens
aatttcgaagaatgattagtgagcctgaatacccagcatgccaaagtgttattgtcacatagcattttgaaaattttcattgtattgtagttgtgttttttgagacaagtctctctctgtctcccatgctcggagtgcatggggtatgatctcgagcgtcactggcagcctttgcctcctaggttcaagtgattctcctcccttagcctcctgagtagctgggagctacaggtgtatgccagcatgcctggctaattattgtatgtttttgttaaggtagagatggcgttgcaccggggtagggccaggctgatctcaaagtcctgagctcaagtgatccacctacctcagactcccaaagagctgggactataaggtgtgagccaccgccacctgccattaggatgggcaatctgcaagatttcattacttcaacatgcaacagatgttctcattcatggtctctgaagcttggagtaccaatgaacaacattaaggtggagaactgagttcaacaaaatgcccatctacacgggtcaacgatacaaagcaaagaaactaacactacactcgctgacatgcacacgaacaaaggccctacacactcaaacacacacacgcggcaagaaaggagatcccaccacagacgcaaagacacagcgcacacaatccagcgcacacgccaacacacaccccagacaaaccccgtacccggcaaaaacacactgcccagagcaaacggccccaactcacacaaacgaccgacgcgaacagaacgtcacaaagcaacacacacgaacgaaggcaaacaaccagacaaaacagaggccaaacgccaaaacacgcaaaggaacgagaggggacaccagagaaaaagcacgcacgaaacacgcaaacagggacgcaacgcaacaagacagaacagagaagggcagagaccaagacaaacgtgggagacgaaagccaacccaaaagaagaagcacagaacagcgaggcaaagaagcgaaaaaaggtataaaagcagcgagagagagcagagagagaaaaaaacgagcacgaacccaaagaccagcacaagagacgaaaggagagccaaacagaagcgacaccgtagccaccacagagacccacgaataccg

SEQ ID NO: 721246 - DNA, 664 bp, Homo sapiens
gtcagcaccagcggaatcaccccgggcaggcagtgccatcgcttcgacaccatcatggtgcccttcggcctgatctatatcgttcttcgccgtcccagttctaccgctcattgggtttagccataagatgaccgacagttccgggagctcaagcgagctggggagagtaggcccgcttaccaggaccagctggaccacgagaggggcaccaacccttgacgccgtggaaggcagtatgcctaaggcccattgtgttctggggcctttccatgttgcttgtggccttagcgcccttcccccttgactcttgtcctggccccagcctcaggggacagccttgcgccaggggggctgagccctttcagcacacggggcgcaagacgccatgggacgggaaaagaaggcacttttatacacgacgaacattcttcctggcacctttgtgaacaaaccgttggttctcttccttaaaacgaaaggaacaattttaaacaggggccaatttttttccccccatgtggattttcccttttccccccaggggtctttccccaaggtgtgtttccccaaaacatctatttcccattggggattgtgggcgacaaaacgcggccgagagttggttgtgtgcccccaacgagggtggggccccacaacaactccc

SEQ ID NO: 721247 - DNA, 187 bp, Homo sapiens
ctaagtacataacgggtcgaactgaggcgcggtctagaactgtataatacaacaaggtgacaggaatacgctgccagtactagcctggctaacagcaagtgctatcgacagctgggccagtatcagcaccggcggccctagggctaccgcagctacgagatatcgtaaatacataggtacataagtc

SEQ ID NO: 721248 - DNA, 430 bp, Homo sapiens
ggaggttgtggctgtaatgagctgtgattgcaccactgcgactccagcctgggagacagagtgggaccttgtctcaaaaaaaaaaaaggtttgcacatttcattgtatggaaattttaccttaaaaagaaaggtctaggccagagtgtagtgggtcactcgcggtagccccagcacttggtggacggcaggacgagtgaatcagctgaggtcaggagtttgagaccagcctcgctaacatggtgaaaccccatctctactaaaaacgtaaaaattagccgggtgtggtggtgcacacctgtaatcccagctacttgggaggcccgaggcaggagaatcgcttgaatccaggaggtggagattgaatgagccaagattgtgcattgcactccagcctgggcaacagagcgtgactccatctcaaaaaaaaa

SEQ ID NO: 721249 - DNA, 843 bp, Homo sapiens
  misc_feature (792)..(792): n is a, c, g, or t
taggacaccggtttactagctagctttacaatttgccaaaaaaggatttctcccggaccccatccggggttcaccctcttttccccccaggcttttggccctagtttataacaaaggaatgatgatgatttaaaaagtagttctgtatcttcagatatctgggtcttccagaaccctcgggtggggaaaggggactcattttgcacgggtcatttcccttgggagtgtaggctactttaacaagatggaaagaacctcttgggccagggaaacagccgagggtgtgtggcgcccagcagtgcttggacaccgtctcggacatcgggctgtgatgggtcgggctgccgttcatggtcagcacagtggccagggacaggggaagacttgactgcacagccaagggttttcatgatgattacagaatacacagggatcacttacaagcgatgacagatatggggcacacaggccatgcgcttacatgcctcgatcaggatgggatacatgcttggttagaaaagagacgagaaccctatttgtattaagagcaagaaccccgaagaatacggtatttccaagtaccggaacccgaatcttcactaagacatatacacatacacaacattggtttacaggtggatcacttcctctaatcccgtggttgtggcaggttcccccagtcacaattcgttttacggaaactgggttgggcgcaatagagacagactggactatgggtggtcacttcctgattgggggtgcaccattcgtgagaccccggaaccgtgtctncacgctggtacatccatgtccgcttcgggaaacacaggggtgcgcattctg

SEQ ID NO: 721250 - DNA, 1710 bp, Homo sapiens
tggtggggctcaattttaattgggaatcatttaaaaaaaaatttcacagcagccataagtgtggggtctcaaaaggaccagaagggtgtgggtgtggggcccgaagggagagggccaggtggaggtgtgggtgccaccagccacaggtgtggacaggcccaagggtgtggccagggaagacacgagaggcgcaggaagccgtgtgggcaagccgcaattgttccactctcaagaggcgggcacacctcctttttgtgcctataggagaggggagacagtggtgtgtctcccaaggccccagaagagcgacgccgctctcttctcgagggtcttcattctccaccgcctgttgggctctgtgtttatcgccccctctctatatggtctttctcccccccccaactctctgtgggaggccctctcctctctgttgtccaacatgtctccctctctgtatctctctctctgtggcgcgcatgttgtccttctcaacagcccctctcgccggtgtgttgtgcgcggcgggtcgccccagcatcatgtggggggcctcttcgagagagttctcctctctccctctgatggtgcggcgcacaacccatagtccccccgcggcgatagagctgtgtttgtcaaccgccggcccgcacaaggtggtgctgctcctcttccgcccgggacccatcttcctcctgcttcctccaaggcagggaggtctcctacttggtggtggtagttaggcggtcccccaccacaccatagtcggtggttcgttgttcgagtgacacccggctctttgttgcgtctcttccctcaccccccggcacacaagcaggcgccacccttcttgcctgaggcggccattctcaagcgaggaggacgacgtatgttgatgggagggcccccctggtttgtacgacctcccccccctgattggttggacggcagctacttctcttctctctggcggccggcgcccaccactccgtgtgaggagagcggtcttcctacacagcgtgccgtcctccctggttggttgtcacacccaaccacacctctatgttctgttcttcctccctcagtgtgtgtggagggcacccctttcggtgggagggcgttcttcccccgccccgacacgatttcatacaaactagtggttgtaatatcccgcgccgcggactcttcatctcgttgtgggcggggctcccttactccacctacgaacagggcgtggtggcgatcttctccccgcggggaataacaaatccccccccctcgtagttgccatgctagcggccgttgctcttattaattttccaccaaccaccatggcgatccgccaccaaacacaaagagcgggccgcccagctctccaccgtttgtgggcggcacgaggcaaacatttggatgcgagcagacaaacaacgtgcccccctatgtgcgtccgttttgctgaagacacgaacaccgcgttcccccaagactgaggtagtggggcaggttggcttatgacaccaggcggaggactatagagaatgacgctagtggcaccttagtcaacatgaggctcaccaagtgcaataaacgtgagaaaacagtcctgtgggaggtaaactattccatcacccccttgttgtgaaatcaaaaacctgatgtgcatagcgggctacgttagtagcacgacgcagtggtggtgaactctatcaacag

SEQ ID NO: 721251 - DNA, 696 bp, Homo sapiens
  misc_feature (485)..(485): n is a, c, g, or t
  misc_feature (606)..(606): n is a, c, g, or t
  misc_feature (644)..(644): n is a, c, g, or t
  misc_feature (693)..(693): n is a, c, g, or t
tgcatttctaacagcaatgaatgagagttcctgttgctccacatccccaccagcatttggtggtgtagtgttttgaattttggctattctaataggtgtgtagtgctaccgcattgttttaatttgctgtccctaatggtatatgatgttggtcatcttttcctatgcatatttgctatctgtatatattttttggtaaggtgtctgttaagattttttccctttttaaaataggatttttttttattgttgaatttaaagagttctttgtatattttggatacatgtcctctatcagatatatgttatgcagtattttttcccagtgtgtggcttgtcttttcattctcttaacaatgtcttttgcagagcagaagtttttaattttaatgatgtccagcttatcagttttttctttcatgagtcatgcctttggtgttgtatctaaaaactcaatgctaagaccatggtcacttagattttcntgtatgttatcttctagaagttttatgttttgcattttacatttatgtctgtgatccattttgaggtaatttttgtaaaagatgtgaggtccatgtctagatttttatattttattttaantttgttttgcacgtcaatgtacagttgttccaagtacnatttgttgaaaagaccgtccttttccccattgggatcgcctttgcttcnttg

SEQ ID NO: 721252 - DNA, 767 bp, Homo sapiens
  misc_feature (20)..(20): n is a, c, g, or t
  misc_feature (22)..(22): n is a, c, g, or t
  misc_feature (24)..(24): n is a, c, g, or t
  misc_feature (28)..(28): n is a, c, g, or t
  misc_feature (31)..(31): n is a, c, g, or t
  misc_feature (35)..(36): n is a, c, g, or t
  misc_feature (38)..(39): n is a, c, g, or t
  misc_feature (42)..(42): n is a, c, g, or t
  misc_feature (693)..(693): n is a, c, g, or t
tcggcatggtgcgtggctgngngnctgnttncggnncnnagngatggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgagacaccctagcggacaatttaaccctgtgtctgaggagcgtggcaaagtccangattgtgtctacctctttgagatggatagcagctggctgttcaccagagatctcaacctcagtgtggggttcca

SEQ ID NO: 721253 - DNA, 153 bp, Homo sapiens
gagttgccgtcatttacataaatattatacacatttaacatctcacttctaggaatactagtatatcgctcacaccgtcatatcctccctactagtgcgctagaaggaataatactatcgctgttcattatagcaactcgaaagccccaagcg

SEQ ID NO: 721254 - DNA, 367 bp, Homo sapiens
gcctagcttacttgagtatcccctccttctgaccacgcgaagatgtagagacctatcacttgctgggccagctcgtatcgccgaggatcagtgcgtaaagcgcaccgctcttgtcggcttcttgaactggctcttgaagctaccagcgccggcattgatctgcaggcgcaggttgggcaactggtcacgtactttttcgctcaaggccagggccgccagttcggcagcctcgccgaaaagcgcacaggtacacgtccacctgacgggaaatcacttccggaacctgctccaaaggtttccagcagcaggatcagccgctcgatgcccatggcaaatgcctacgcccgggtgccttggccagaaagga

SEQ ID NO: 721255 - DNA, 140 bp, Homo sapiens
ttcggcacaggcctcgctgcatcccaagcatgtgtaccgcgtgctgcagtggtgacgcctcctcctggcactgacagaaacttgtgacctgggtgaccgtgtagtccttctcttccatccggtctttgatgatgcggatc

SEQ ID NO: 721256 - DNA, 380 bp, Homo sapiens
cgatgggtctggcaggcagagacactcctcacttcccagacgggatggcggctgggcagaggctgcaatctcggacactttgggaggccaaggcaggcggctgggaggtgtaggttgtagcgagccgagatcacgccactgcactccagcctgggcaccattgagcactgagtgaacgagactccgtctgcaatcccggcacctcgggaggccgaggctggcggatcactcgcggttaggggctggagaccggcccggacaacacagcgaaaccccgtctccaccaaaaccagtcaggcgtgcaaccgggtgcctgcaatcgcagggcatcggaaggctgaggccagagaatcaggcaggaaggttgcagtgagccaaga

SEQ ID NO: 721257 - DNA, 872 bp, Homo sapiens
ctgtgaccttgccttgacctcagactttacataaagagcaaaaaaaaaaaaaaacaacaacaacaaaaaaagccaccccaagaaaatctctacaaggaatgcatttctctgaagtcctaagcagtgtgagtttagtggtgataaactccagaactttctctcatttgatggtgtgctgccatcccagttcattattttaatagtgggctttaaaactagaattaggtttcgcaagaggtaggggtggtttggataaaaatggtacaaaagaagtcagagaacataagattgaaatgtccctaccttaggagaggtaccagatgcccttatgagcatctaactctttacaccaattttctctctttgcaactgaccaggccgtggtggctacgtatggtccctgaaaactctgctaatccccccatgaaaagatgaactggagtgtccacctgtggtaaaacaggcaaacataatctcacctcagaaaccccaagcctgtgtactcaaaggtcccctgggggtcacaggtttcccagcacgtgaggctgcacatagagcactggacggagaactgacggagtcccattttgccaagatctagtttacctccactgcgatccatcttttcctcttcctaaacccccccttttcatttttacggaatacccgattttgtctcactttctgtgtcacaggtttattactgcccggagacgaattttgcggccatgtatagacctgtccacccgtgcattctgtccggacccctttaacctgttggaaccccaggcgagtttcgatgccgtcgcactttggattaccccagacctgggtgatgctgcattgctgcggtgtggtcctgtcttctgtcc

SEQ ID NO: 721258 - DNA, 234 bp, Homo sapiens
cgctagaggatccgccttcatcatacctaccctcacacacacacacacacacacttcacaaggactgatatttttactatgtccatagttttgcctttgcagaactgccacgtagtggaatactacactatgtaggtctgcttagattgaattctttccattagtaatatgcacttagggggtaggtatgacgaaggaggtaggtatgatgaaggacggggtaaccgagctcga

SEQ ID NO: 721259 - DNA, 128 bp, Homo sapiens
taactggggcccggttatgtcatcatccaagatttccacagacactcataccagttgggattaaagtctcgagacaatactctatcaaagtattcctataccactgggctatgcagagcaagcgagga

SEQ ID NO: 721260 - DNA, 821 bp, Homo sapiens
tgaggtgccgccgccaataatcaaggtggtttgccaggttcgccccacattttcagggctttttatgggcccccccacgcgtagtaagaagagttgaaaaaagtggccctccagcacccgcgaatgtgtctacgtgcgaggttactggagggaccccaacaatttctcgcgagccagaggcttttctccactgggaggagagtagacctcccctcgcagtggacttatgccggttcaaccgtggttatccctcagcgctcccccaacacacatcaagagggagggatacgtgcacctctcccccaaatggtgagggagaaagatggagcccacccgggccgcccaccgatgcaaaacagaccccaaacaggggggccccaccacacatggggggggggtcaccacacgctcccgtgcacgagctctaacatgtaggcaacaacagtctctgtgcccacacgttattgtatgtttaataacccgcacaattttccggcgggtcgctcacccactatggggaggtcctcgtgcaaaaatccttgtcccccgggaggcatctccccccacgtagcgctccacacacgggggttggaggaagagacggccacgagtcagataactcatagtcgggaattcccacgcgtaagccagaaaggttagtggcgcacagactttgaggctaaaaaagcgataaattttagtatagtttgagaataataccaagggtagtcgcctacgtggtacaaaagcagcaacaccccgccaggcttgaagggggaaagtagccaaaacaccgccaccctccggacaatacaaagaca

SEQ ID NO: 721261 - DNA, 1022 bp, Homo sapiens
gggccggagcgtggaattcttcttgggaggcagtgtgggatcttcttccagcagggtgacctatgacaaggctagtatacagccggggtgcgccactccatagctgtgcgcctgagtttgcgagaaggacccaatatccaggatttcaaggagtggcttcactactcatgtgcatccatgtaaccacgctcatggcgtttctctttgatcatagaacgaatcttgagatgacaccgtttgcttgcgccgtctggggacgagtgtagttgtcgaaataggagttgcatcgaatttgctgcattctggatcactggtctggatccggggatccaatataacgttataaactgtgtggccgtcatgagagggcaggagcgcaatgaagatctctctagggagatgcagatgaacacatgtagtgaaaatcctttctctctaactgtaggtacaagaggatgatatgactcgcgtgcagagttaaaggtggtgatgatataggaaggaattaccgttccgtagcacatgtcttggccatcgacacgtgaaggtatagggttgaccactgagagacgattgacacaagatgtaatggcgccatgttgcacccttgcatgtgaacttggggaactttggggtacgagagatgacctgggctgtgacaataaatcatgccaaaggaagaacgacaagcgactacaggtagagtgaggctcagcatgatggagcactgaggcggctcgataattggatgaagtggtaccctagtccctgatctgtgtcacgcggagttcacgtcttctgtgcctcactagtcagtagcatgggggtgccttgtaatcacactaccatttgctatgacgctggtgcatatgggaactcggggacgacaatcctacagttggatctcacaaaggccagtaccagaaacaggagcaggaaggcaggattgacgaaaagagagaaagacaaagaatggcggcacacacgagaaataagccgatagggcagacgatagaaagaag

SEQ ID NO: 721262 - DNA, 416 bp, Homo sapiens
accaagaaacacgtccattatcctctcttccccagaggcaaacccttttcctcctttgccgctagataccacttcgccctctgactgtgtcccacctccagccctcatctgccagtgaagtccagctccatgatctgacaccaccataaaacgagccccactctggacgcctgaccctatccacccaacgtgtgcccagagcacagggagttccgtgtagaggtgcaagacctggggtcttagtgggactaggacgtgtgcatctgctaccaggtggagccagccccaggtatgtacttgaaggtaggctagaagcaaacgtgtggagtctgaggtcctggccagctaccgtgagagccccaatttcactgagcttgtcaggcatctgacagtggacttgccggagcagccttact

SEQ ID NO: 721263 - DNA, 639 bp, Homo sapiens
  misc_feature (105)..(105): n is a, c, g, or t
  misc_feature (134)..(135): n is a, c, g, or t
  misc_feature (137)..(137): n is a, c, g, or t
  misc_feature (169)..(170): n is a, c, g, or t
  misc_feature (185)..(185): n is a, c, g, or t
  misc_feature (222)..(223): n is a, c, g, or t
  misc_feature (227)..(227): n is a, c, g, or t
  misc_feature (232)..(234): n is a, c, g, or t
  misc_feature (266)..(266): n is a, c, g, or t
  misc_feature (280)..(280): n is a, c, g, or t
  misc_feature (293)..(293): n is a, c, g, or t
gtatgtgtttaaaaaacaacttttaagtgtggacactggatccccaatatctaaaaaatcatttctaataacaaacacaagtttttgaggaaaaaaaactgtttnaaatatagacaatggatccccaatacctnnanaaattatttctattaacaaacacaagtcttgnnggtggggtggtgggnaggaccagaaagagcagcttcgaaatgcagggaagcnnagtnaaatnnnaaagaaaaagtaactcaagtttactaatactnaaactttcaacagncaaagtttcaccnttttagaatctagagcaactcatttggaattttaaataaataagcttaagtttatttatttagaatctagagcaactcatttggaattttaaataaataagcttaagtttattcacatcttctggtccaagcagagttctaggaccatgactctgcttgctgttggtcaaattcacctattagccttttgatgtgagccagcttgttatgaagatattcacatctgtatttttcttcatggttaattgggactagactgctttatcttctgatattcttgtaagacttcttcatgaacattctgatactcttttgagcctggagaaaggcgctttctttgtgcatc

SEQ ID NO: 721264 - DNA, 580 bp, Homo sapiens
  misc_feature (105)..(105): n is a, c, g, or t
  misc_feature (134)..(135): n is a, c, g, or t
  misc_feature (137)..(137): n is a, c, g, or t
  misc_feature (169)..(170): n is a, c, g, or t
  misc_feature (185)..(185): n is a, c, g, or t
  misc_feature (222)..(223): n is a, c, g, or t
  misc_feature (227)..(227): n is a, c, g, or t
  misc_feature (232)..(234): n is a, c, g, or t
  misc_feature (266)..(266): n is a, c, g, or t
  misc_feature (280)..(280): n is a, c, g, or t
  misc_feature (293)..(293): n is a, c, g, or t
gtatgtgtttaaaaaacaacttttaagtgtggacactggatccccaatatctaaaaaatcatttctaataacaaacacaagtttttgaggaaaaaaaactgtttnaaatatagacaatggatccccaatacctnnanaaattatttctattaacaaacacaagtcttgnnggtggggtggtgggnaggaccagaaagagcagcttcgaaatgcagggaagcnnagtnaaatnnnaaagaaaaagtaactcaagtttactaatactnaaactttcaacagncaaagtttcaccnttttagaatctagagcaactcatttgattttaaataaataagcttaagtttattcacatcttctggtccaagcagagttctaggaccatgactctgcttgctgttggtcaaattcacctattagccttttgatgtgagccagcttgttatgaagatattcacatctgtatttttcttcatggttaattgggactagactgctttatcttctgatattcttgtaagacttcttcatgaacattctgatactcttttgagcctggagaaaggcgctttctttgtgcatc

SEQ ID NO: 721265 - DNA, 348 bp, Homo sapiens
  misc_feature (84)..(84): n is a, c, g, or t
ttgagcagttcttggagtccccgaaggtctggcagctggcccaagtgagcatgttgatagtctgtgcagagctgaggtggctgnagggcagggctgaggtgggccaggggcaggtggtggtggtgcgtcaagagcaggtccaggtggaaagtgagtcacgacaatggctgcagcaggagcagcagctctgtgtgacaggtaggtttaaccaccgcgggccagggagaaaaatcctgttggcaggtacaggagggagagcaggcctggtaaagagcaggacaacatcagctacctgtccttggacctagtcccataagtacccccagagcagcccaccagtcagtacac

SEQ ID NO: 721266 - DNA, 270 bp, Homo sapiens
  misc_feature (101)..(102): n is a, c, g, or t
  misc_feature (186)..(186): n is a, c, g, or t
  misc_feature (246)..(246): n is a, c, g, or t
ggtagtagttctcaggtcggcgggctgttgtggtgatcagagtgggagtcaggcgggcttggccggacccggagggaggaacacgtcccacggggtgtttnngcggctccgacggctctttgaccttttttttttcccggcagagagagaccccgagtcccccgtagtccgactcgctacgcggcncttgcgagatatctggccgcctctgccgcagctggaggcgcccctggtgtaggccctgangccctacgagattcacaccgtctt

SEQ ID NO: 721267 - DNA, 177 bp, Homo sapiens
ctaaggatccggtcgacgggatacaggcgtgagcactgcgcaggtggaagttattacttctgatttcccagataggatttgctctacatgctgttgatagtcatcgggtgttttgtcttctgcatactcagataagggattttgtctctagggcctgttcagtggtcaccaagtgat

SEQ ID NO: 721268 - DNA, 425 bp, Homo sapiens
  misc_feature (402)..(402): n is a, c, g, or t
cacaatcacgcaaccatatcaagctgaaaatgtcacccctatctggagagttggacatgttttattgggaatatattttttatctctgactctgttaccgaacgcattggttggctaggttcggtaataaatatgtgaaacattttatttaaaaaaaaaaaacgtcgtgagccactgcaactggctcttttaaatgtaattttatttatttatttatttttgagcctgttttgcagcctttacaaaaatcagggttttcccacaagatcatgaagattttcatataagggacctctgaccatttgtgttgggcgttggcagtaaaggtcaaggcagggattaaggtaattaacattccaagctccccacctttgggccagggttcctgcctttctagttccnattttgggccaaacctagctact

SEQ ID NO: 721269 - DNA, 224 bp, Homo sapiens
gggatgagactggctgttactacgcgggctagtgtgagtgctagaagagtatgcaatgagcgcttttcggtctgtttgtcgtatggcgatgagcttgttctaattatgcctcctagggatcgtacaaggcaggggtaggctatgtgttttgtcacggggttgcgactgagtgtgaggtgtattataccatagccgcctagttttaacgagtactgcggccagtg

SEQ ID NO: 721270 - DNA, 1715 bp, Homo sapiens
tgaggtccaagagtttggagtttgtgaggtcacgaacttcacaaactccaaactcttgggcatcagtgctgaaggtgaggtcatagcctagtgtgagagacagtcagtttgccagcgagatagaccagacctaggatagcaagtggtaatcatctcattcgtccactatctgctatactctgacgtgagcgttgacgcacagagtttggagttttgttgaagctacgatgaccctcaaacagcgccaatcggggaccaaaacaatcaaagagcagaacaagagggagcaataacgaaagagagaagtagatacaccgctgcgacatggccagaactaagagagactgacaaggagcacactacacgccaacacacgaaacggacagagacaacaaacgactaagaaaacgcgccataacatactgaaagcactccacataccagcaaaaagacaagaccacaaacaaaaagaaccagatacatatacaatacatagacgacacgcagaagacaatacgcacgaccagcaaacaaaaactacaaggagacaatgcacacgaaccgacgagctgaccactacgcaatagcaatcatcggaacacacattcacacacacacagtgaaaaaatacacacgaacaaaacggataacacaaagaaacacaaggtatccgataacgatcacaaagccaagtcacaaagaatgacaaaccaatagggaaagcaagaaaaaatagaagaattacagttagacaggcaatcaaaaagcacatgagaccacagaagaaaccaacacgaacagcaccaatcacacacagccacaacggactcaacagacggagcgaaaacacaacaacgccaacacgggaaacaagacccacatatgaacaaacaggagacaaaaaatggcaaaagaggccaccaaacaaaaaaaagaggcaacatgcagaaaatgagaaacaatcaccaacaggcacacagcgtacacacacagagaacaccgaaacaacaagaaaagaacacagcaaccacagggcaccaaacacacaaaaaaaaacgagagcgaggcacccagactcaagcgagacaagcagcacaaacagcagccagcgacgaagacagtagcagaacacaacacgaacatagaagaacaaacacagacaagacagtaacacagatcaaaggaacaaacaacagacgaatatggcacagcaaagaaccacaccaccagaagcagcaggaacgagaagcaccaacacgaccgacgacaggcagaaacacatactacacgacaccagcgaaagaagcacaaccaaaaaccgaagagaccacacgacgcaggaacgacagaaggcacgacacataagaggacgacacaacggaccgcacaagagatcacagacatgagaaagactgatacaccgaaataacaagaacgaacagagaccacacaatgcaggaacaaacgaggtagaagaaaacacaagacgagaacacactgactaagagagacaaatatacaaacaaaaccgaccaatacaaacacaaagcatacccagccatcggtcagaacaacacacactctatacagcagcagcccaacagaacgacaaacagtacatatggcacagaacatgcaagcaacggacacaacatgtgaaccacaaaaacgagcaaactaagagccgaacacagaacacacatcaaccacagcat

SEQ ID NO: 721271 - DNA, 379 bp, Homo sapiens
  misc_feature (53)..(53): n is a, c, g, or t
  misc_feature (62)..(62): n is a, c, g, or t
  misc_feature (83)..(83): n is a, c, g, or t
  misc_feature (95)..(95): n is a, c, g, or t
  misc_feature (117)..(117): n is a, c, g, or t
  misc_feature (138)..(138): n is a, c, g, or t
  misc_feature (269)..(269): n is a, c, g, or t
  misc_feature (276)..(276): n is a, c, g, or t
  misc_feature (303)..(303): n is a, c, g, or t
  misc_feature (308)..(308): n is a, c, g, or t
  misc_feature (338)..(338): n is a, c, g, or t
  misc_feature (343)..(343): n is a, c, g, or t
  misc_feature (375)..(375): n is a, c, g, or t
ccaaccgaaccccctttgaccttgccgaaggggagtccgaactagtttcaggnttcaacatngaatacgccgcaggccccttngccctatttttnatagccgaatacccaaacattnttataataaaccccctccccnctacaattttcctaggaacaacatatgacgcactttcccctgaactttacacaacatattttgtcaccaagaccctacttttaacctccctgtttttatgaattcgaacagcatacccccgattccgttangaccaantcatacccctcctatgaaaaaacttcntaccnctccccctagcattacttatatgatatgtntccanacccattacaatttccagcattccccctcaanccta

SEQ ID NO: 721272 - DNA, 113 bp, Homo sapiens
gtgctctggaacttctgaccaagcagcttcaagttggggttctcatgagcccccgcgttgggttcaattaattttgctacagcagctctcagaacttaaaaaacacaagcacg

SEQ ID NO: 721273 - DNA, 191 bp, Homo sapiens
ggatgaccttgcccacagccttgcagcgcagttagaggcagggatgatgttcttgagagccccgcggccatcacggcacagtttcccggaggcccatccacagtcttcttggttgcagttattgcattgacttttgtcatgagtgccttccaggtaaccaagttgtcatggatgaccctggcccagggtgc

SEQ ID NO: 721274 - DNA, 112 bp, Homo sapiens
aaggcagttatacagactcaaagctgtcacgaataagaatgtaatgctatgcatgcgactgttgattctagttctctaaacctccacatgtacactcctacctttccactcc

SEQ ID NO: 721275 - DNA, 480 bp, Homo sapiens
  misc_feature (10)..(10): n is a, c, g, or t
tttgggtttntctccccccctcaccaaatctcgcccggcttgtttcacgcccctttccccccccgcccaggggcgggttgttccccaaatggttttccaaccccgcgggttccaaaaacgggtgttttccggggggttcccaatccccggggggggttttttaaaaccccccagagccccctcgcgaccccttttttgccggttgtttcccccttagaggggcccgcgcccaactttggcaccccttcttttcctaaagggggtggccccattttgaggggggaattttctcccttgccccccctcttgaaaggggttttccgggaaaaaaaaaaaagggagatgtggccaagaagtatccctttgttgaaggctctggggcccccctttttgaggggggttaacctctaaaaaaacatttttaaaaatttttgggccgggggggttttccttttaaaaaaagtccttttttttggccca

SEQ ID NO: 721276 - DNA, 814 bp, Homo sapiens
tccacttcagactaaatttaattaaatatgtggtcttgggctacaatgggtttgtttttataaaattagttacacttatttggtgttaaaaacaaccccaacccattgcccctcttgtggcagcccttgaaaactcagttcaaagctaggccgggtctccctggccagtggccccttgtgcttagtcggttcacgcctgctggagcgctctaggaagccttcccaatgtcccaagtgtccaggcccccggtagttccatcacgctcttgcctcgaagacagctcaagcccaggggcttgggggccgcaggttatgacggcccctccgagtgagccacactctgtgtcagggctgtgccctggggtcctggcgaaatccccccgtccccttgaaccgtcaggaacggggacaaaatcgcgcaccaaaggtgttgagcacagggggcgtgacatccccattctgagccggggagaccctaggggacgctggagaagccgggcagagaaccccgggtggggctagtgtacacgggatgtcgcaatggcacttgggtccatcaagtacaaaccccccacactcttagccagaatgtctgaaacctccggcactccccctggaacttggtgggggcagaaaaaagggctccaaggacaggaatggaacaaacccggggggggacgccccacaaattgagggcgctctgaccgtggtacacccattggcaaccccacccagaaacagcctcaagtggacgaaggcaccaggaagccaggaatgtccagaccaaagaagcgcactctgtcataccacactg

SEQ ID NO: 721277 - DNA, 254 bp, Homo sapiens
ccggtagattggacctcccaaataccaacactttcatttttcactcttagctggaatataaatacatctgcagtattcctaatctttttctattatattgtgattttttggaaaaatcccctccaagaacccctggtggatgggcatggaataataccgggtgcaacggaaacatgtgcttgataggttaatcccatttcgcgggccaaagcccccccaagttgctcagacctttagtgcgccgcactttttgc

SEQ ID NO: 721278 - DNA, 396 bp, Homo sapiens
tacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcattcccctacctctctttctctccttgggccttcctattctgagacacaacaatattgaaattatgccagttaataaccggactatgggctctaaatggttaaaggaaaacaagaagtggca

SEQ ID NO: 721279 - DNA, 142 bp, Homo sapiens
ccagatatgcggaatgaacaatgaaaagaaattgtgaaagaaggcgctacccgtgaagcaggaactaatgaactcctgtgagtcacgtggtgcgcacgcgccaaaggcacacggcagcgttccacaaacagcgtgccacaag

SEQ ID NO: 721280 - DNA, 133 bp, Homo sapiens
tgttcatgagcaaacacactgaaggccaaacactcacagtaaggagatatgcaaatattaaagactataattcaacgttggtgtaactgatcccatgaattttcctagtttaaacagaacctatgttatttct

SEQ ID NO: 721281 - DNA, 1664 bp, Homo sapiens
  misc_feature (597)..(597): n is a, c, g, or t
  misc_feature (829)..(829): n is a, c, g, or t
  misc_feature (948)..(948): n is a, c, g, or t
  misc_feature (1182)..(1182): n is a, c, g, or t
cggagagtgtgctgctgtgtctcttgctagtctgcgctgctgcatatcaccgagtgagtcaaaccaagaccgcggtgtgcgggaccctttgacgctcgtgggggactccgctggtggttggcaccagacagcggcgtcgttttttgagccccgtcgcgcccctcttatctttagtccgcgtttcaattggtgtagcgcggccgcgtttgtgggtgagcaactattttgcggccaaccaggggctgaaggcacagcagcaccccaccagcggccggtgcggttggccagaaaaagaaccacggcccggttcctttttctcgcaaatcgcgccgcgcttcaataagggggagccccaccgaacaagaagaaaatggggtgaagaacacacccatgtttttttacagaaaaaagaagaaattggttgataatatagaattgagggaagaccgaccacccctgccctaatgggttcgcgaaactaatataagagaaatattattttggggaaagaagacgaccgccttgtctgtcccacccccgtgggtgctccctcaggggggacaccccaacagaagtgcgcacgatcgtaggagatgngttctatcacaccagagggttctctcgtgtggttttttggaaagcgtgggagagttccctgtcgccttggaaatttttgcccagagaaagatggaggtggaaggtttgccacatttttaaggaaaaaagtgttccacaagaccgtcgtagttgtatccctggaaagaaaatgtttctcccacagcggtgtataaaaaacactggccccctcgagcctataatgactgtctcnccacatcggcccacatcgggagttttgtgtatgacgcgcgcgtggggaaccgacaaatagtggtttccccaactagggtccccacaccaatatatggggcgcacagaccccacataggngatgtgtgatagagcttctcacacgctctggaataggtctcacagagagactctacaccccgcgataggggtttacactctggcgtcttcggttctcgtttttcctggtttggtttggggtttttgtatacttatataatatatccggcctacccccactctctagagagatactctgggagatagagcgctctcttgtattatggccgctctatagcgacccacacacacagngtctccgcgccacatatctctccgagatagagaagagatggatagtgtgagaaaatcacagtgagacgcgccgagagagagtgccagacgacacacaatggacattgtgaaagaagagatgggtccacataaaatatggattctccagagaccagcccattgtggaaaagacacacattagaaaaaagagcgcttgcccacatctttattttatctctttctcccatagagatagttctttcgcttagaaaaagattaataatgtgctgtaagaaagctcccagatttgtaattgtggaaagagcttcactggagactttcatggtgtaaggccacgactagtttctgggaaagacccctcggggaagagaacaccggtgctaaagattgaacgagctgatggatatgaacccccccccccagaatctgttttaagttccagacttccaattagtggccaaattaaaagtgctatttgtgaa

SEQ ID NO: 721282 - DNA, 314 bp, Homo sapiens
acccagttacagaagtatctgtacagaagtcaacaacaccactggcataacccactctgaaaagaatgacaaagagcgcggaatccctacaagtctccatttaacacccaagcccatggctgcgccctgccatagggtctgcgagcatcttctgcactcagaatgtgctaagtacatcaaaagcacgacggactgacagagcagcaggtccagataacagaaatcaaagtgatatgcaaaaaaagacttacaatatcacacatgaaaatactagtttacaattacaaacgtaaaccttacattataaaaaagag

SEQ ID NO: 721283 - DNA, 197 bp, Homo sapiens
ggccaccctataatgtaatgttatcccacaaaataaaatatatcttatccccacgcaactatagaatgtatgtattttttctgtactataattggagatttcctataatatctgtcacatcctcacaaagaaaagtgtatattggtttttttaaaaagaaagtgtatttgggaataaagtccagatgggaaattcca

SEQ ID NO: 721284 - DNA, 174 bp, Homo sapiens
ggatttgctggtgcagtacaactaggcttaatagggacatggtgacgcacacatttgtagacccagctactcagagggatctcttgagcccaggatttcaagactggactgagctaggatggtgccactgcacttcagcctgggcaacagagcgagaccctgtctcaaaacaaa

SEQ ID NO: 721285 - DNA, 811 bp, Homo sapiens
  misc_feature (30)..(30): n is a, c, g, or t
  misc_feature (103)..(105): n is a, c, g, or t
  misc_feature (183)..(183): n is a, c, g, or t
  misc_feature (188)..(189): n is a, c, g, or t
  misc_feature (195)..(195): n is a, c, g, or t
  misc_feature (212)..(213): n is a, c, g, or t
  misc_feature (225)..(227): n is a, c, g, or t
  misc_feature (245)..(245): n is a, c, g, or t
  misc_feature (259)..(260): n is a, c, g, or t
  misc_feature (271)..(271): n is a, c, g, or t
  misc_feature (277)..(280): n is a, c, g, or t
  misc_feature (289)..(289): n is a, c, g, or t
  misc_feature (313)..(313): n is a, c, g, or t
  misc_feature (321)..(321): n is a, c, g, or t
  misc_feature (327)..(327): n is a, c, g, or t
  misc_feature (338)..(339): n is a, c, g, or t
  misc_feature (346)..(346): n is a, c, g, or t
  misc_feature (350)..(350): n is a, c, g, or t
  misc_feature (353)..(353): n is a, c, g, or t
  misc_feature (356)..(356): n is a, c, g, or t
  misc_feature (378)..(379): n is a, c, g, or t
  misc_feature (383)..(383): n is a, c, g, or t
  misc_feature (402)..(402): n is a, c, g, or t
  misc_feature (418)..(418): n is a, c, g, or t
  misc_feature (440)..(440): n is a, c, g, or t
  misc_feature (447)..(447): n is a, c, g, or t
  misc_feature (514)..(514): n is a, c, g, or t
  misc_feature (523)..(523): n is a, c, g, or t
  misc_feature (532)..(532): n is a, c, g, or t
  misc_feature (555)..(555): n is a, c, g, or t
  misc_feature (577)..(577): n is a, c, g, or t
  misc_feature (811)..(811): n is a, c, g, or t
taaaactacttggggtctttttagtagttnttttagggctgtagccacagaacggtcattctagtgattctgagcagggtggagaggagtggagcatccctgnnnaggtgggtcagtgaagacacgcccagttcacctgatattctgtgactggttgcagaacacaagtccctctcgaaattntttanntttttngggagatatttgtaagnnagagtgagaaannnttatggaaaaggggaagnagtgctgaggaggnntaggagaaggntcaggnnnnccaccgagngcatccctcatttttgggtttttnttcctggnaatttnagggctcaganntgcatcnaggnggnggnggacggcagtgcttctgaaggnntctnccagtgggacctggggggntagtgtgcccacaccngcttgggtgagagaggccaatnagttgtnaagcttatgacttccaatcagagtggtggggggctgaaatgacttggtctttgggtcactgtatgtnaaggaattnggagctagnggcactgggggggtgagcctgcntgagcccagtgaggaggaggtngtctgcgtggggtgcttccaggacctgtttggaggggaccacaataagaacgggttcaaaatgttcgactcctccaactatcatggccaagacctgcttttcaaggatgccaccgtccgggcggtgcctgtcggagagaaaaccacctaccgcggctggctggggctggactacgtggcggcgctggaagggatgtcgtctcagcagtgctcgggcgcaggtaggacaggcccn

SEQ ID NO: 721286 - DNA, 243 bp, Homo sapiens
  misc_feature (218)..(218): n is a, c, g, or t
aaagcaaaaacaaaaggattttgagatcagtgtggacaacttagcaaaacaccatctctaaaaaaaaaaaaaaaaaaaaagattagccaagcttggtggtgtaagcctgtagtcccagctacttgggaggctgaggtgggaggattgtttgaacccaggaggttgaggctgcggtgagctgtgattgtgccactgcactccaggttgggtaatgcagncgagctgcgtctcaaaaaataaata

SEQ ID NO: 721287 - DNA, 939 bp, Homo sapiens
  misc_feature (15)..(15): n is a, c, g, or t
  misc_feature (182)..(182): n is a, c, g, or t
  misc_feature (194)..(194): n is a, c, g, or t
  misc_feature (210)..(210): n is a, c, g, or t
  misc_feature (213)..(213): n is a, c, g, or t
  misc_feature (258)..(258): n is a, c, g, or t
  misc_feature (264)..(265): n is a, c, g, or t
  misc_feature (270)..(271): n is a, c, g, or t
  misc_feature (372)..(372): n is a, c, g, or t
  misc_feature (389)..(389): n is a, c, g, or t
  misc_feature (424)..(424): n is a, c, g, or t
  misc_feature (436)..(436): n is a, c, g, or t
  misc_feature (438)..(441): n is a, c, g, or t
  misc_feature (474)..(474): n is a, c, g, or t
  misc_feature (485)..(485): n is a, c, g, or t
  misc_feature (622)..(622): n is a, c, g, or t
  misc_feature (694)..(694): n is a, c, g, or t
  misc_feature (696)..(696): n is a, c, g, or t
  misc_feature (700)..(701): n is a, c, g, or t
  misc_feature (704)..(705): n is a, c, g, or t
  misc_feature (792)..(792): n is a, c, g, or t
  misc_feature (811)..(811): n is a, c, g, or t
  misc_feature (852)..(852): n is a, c, g, or t
  misc_feature (871)..(871): n is a, c, g, or t
  misc_feature (932)..(932): n is a, c, g, or t
gtgaaggtgggaggngagatgtttcctccccttttcctttctccctcatcttatttcctccaagggcgtaaaaaaatatggcctgtgaccccaataacctacccaaataaaaaatcaaaaaactgaggttccaaaaagttacagcatcttatttcctcatagaaaaggggaaggagccaganggaaggggagtncctggggtgggggggngtntcaccccgcagcccggtgagacatcccctccccttaaatagctgncccggnnggggnnagcccagggctatagcatttaaaaactcccacatcccattttatcaaaaccaaagagaaaaaaaaatttcccttttcccccaaaacccaaatatatatatntttttttttcttaaaanaaccaaaactttgaaggcatttagcgttaaagtgnatcttgaacttngnnnngtgatattccctccttccttcccccttcctgtnggggttcattngtgcatccccagcagagggaccggccccaaggggatggcagaggggaaggaccaaagggagagaaggggcgggggcctccccagccaatcagcagccagtgtgtgtgtgagcagggaagccacacccccttggagtnttccaagtgagatggggagtgggaacgatgcattcctgtgtagtcttcagccaattccaagtcaaataaaancngggnnagnngggtgacaggccgggtgtgcggaaaggagaagcgggtcttctgggtcctgtggtcagagagaacccgctttctcagctctggacgangcttcaaatgatttctctntcactctctgcgattcctcttcacctcttccagaagctctngtttcacctctgtatgtcngagtgatcactggagctgtgcgtgcagggttgtgtctcgggaagtggtcacgaagaagacncttcatc

SEQ ID NO: 721288 - DNA, 287 bp, Homo sapiens
  misc_feature (62)..(62): n is a, c, g, or t
gcactcgaaaaagtgggaataaaacagattgttgtctttgtaggacagctgggcaaaacaantggtgtgatcttgccccccccgcaggggacattaggcaatgtctgaatatattctgattgtcacaactggaggggccgggcgcggtggctttttcctgtaatcccagcactttgggaggccaaggtgggcagctcacctgaggtcaggagttcaagaccaccctggccaacatggtgaaaccctgtctctattaaaaatacaaaaattagccggctgtggtagaa

SEQ ID NO: 721289 - DNA, 116 bp, Homo sapiens
aattgggggggggggccaccctttttttgaaaataacctttttttttttccccttgggggggtgaaagcccccctttaaatggaaaaaaagtttttgggctcgggcctcccctcca

SEQ ID NO: 721290 - DNA, 679 bp, Homo sapiens
attgagacaaagtcgcgctttgtcacccaggctggagtgcagtggtgagatcttggctcactgcaagctctgcctcccaggttcaagccattctcctgcttcagcctcccaagtagctgggactacaggcacgtgccaccaggccaggctaatttttataattttagtagagacggggtttcaccgtgttagccaggatggtctcgatctcctgacctcgtgatctgcccacatcggcctcccaaagtgctgggattataggtgtgagccaccatgcctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 721291 - DNA, 1512 bp, Homo sapiens
  misc_feature (1)..(1): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaaaaaaaaaaaaaaaaaaaaaaacaaaacaaaaaaaacaaaaaaacaacccgcgagggacccaataagggagggggggggacaaaagaggaggcacagaaagagggacaaggggcacacaagagggatctccggcacccaagttttgtggtgcgacaaaggggggcgaacaactaggagagggggaccccaaataaggaggagagaggagagaaataaatccgagagaaaacgccgagggtgaacaccggggtttaagtggctccgctccgaaacagcagcagaaagagacaagacgagaggagagacagcaggaaaaaagaacaagaagagaggggggaactcaccaaaacaaagtggtggaaaacacaaacaaaacaccgtcggagggaaaccagcaagaacaaagagatgactcgacacagctagcacccagacagacaaacaaacacagagacagcacagcacatccagaccaccagccaacaagccaatacagcacagacgaacgaggagaacgataacgatgaagaaagagaaacacatgagctaaccaaatgagcagagactgagaagcaatagacggcaaagacagataaaggagaagaagagaagaagggagacagggaagaggagaggaggcgcgacgcaagagaccgaaggagaggaggggagacagagagtgaagagagaaaacgaagaagaagaaaccagggaagaacaagagaagaacggaggagagcgagagcggcaacagaggactcagcagacacagaggagagagaggaagccaggagcagacgagcgcaaaggagacgacaggaaggcagagcgcggagagggaggcagaaaa

SEQ ID NO: 721292 - DNA, 753 bp, Homo sapiens
  misc_feature (1)..(1): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaacaaaacagaggcgcacaggccgcacagagacaaaaggacaaaacaccgcagggggcgcacctcagcgggggcgggaaaaacgggacacacg

SEQ ID NO: 721293 - DNA, 488 bp, Homo sapiens
  misc_feature (351)..(351): n is a, c, g, or t
  misc_feature (392)..(392): n is a, c, g, or t
ggaaggggccagacgggttcagatgcgttcatggggctgttcggaaagacccaggagcagagccgccctgagaactggtcaatgaggggtcattgaagataagaaaggaagtgagagttgttgacaggcaaataaggggatatccaagagagaatgaagaaaataggtgaaagcgactctgtgaaaggagtgctgccagagaagggccagaaggatgtctgcgtagttctggcgaaggagatgatcaggtcaaggaaggctgtgagcaagctgtatgcatccaaagcacacatgaactcagtgctcatggggatgaagaaccagctcgcggtcttgcgagtggctggttcnctgcagaagagcacagaagtgatgaagccatgcaaagtctngtgaagattccagagattcagggccgacatgagggagttgtccagaagaaatgatgaaggctgggatcatagaggagatgttagaggacactttcg

SEQ ID NO: 721294 - DNA, 664 bp, Homo sapiens
  misc_feature (1)..(1): n is a, c, g, or t
  misc_feature (584)..(585): n is a, c, g, or t
  misc_feature (588)..(588): n is a, c, g, or t
  misc_feature (591)..(592): n is a, c, g, or t
  misc_feature (603)..(603): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagannatngannataacagaggnctcagaccacggatactggtcgagccattaagatgttctcctcaacaaaaacacgatatgg

SEQ ID NO: 721295 - DNA, 288 bp, Homo sapiens
tctctgcatggatattgtggccaagcagctacagcaatagctccttactttcttttcccaacttcagctccgtcacacaacatgaaggcctccatagagatgtgtgcggccatgatgccagtcatcatatgaaagctccatcaagacccttccatctaaacaggggctcccaacacctctcaggtctagagacgcacgcactggaaaccccattcttcttcaggaagatgccaacacattctctagaagcagattcaaggctctgaggatacggtctttccagaagtc

SEQ ID NO: 721296 - DNA, 782 bp, Homo sapiens
  misc_feature (122)..(122): n is a, c, g, or t
ggtatttcgcgccacgggtacgatacgtattacacactcgtcattctatcgtcatttgtccctatggattataaacgacgggagctgtgttgttccttgcctgctacgcgtagctcagacanttcagtctcctgtcacgttgcaggtgtagagcgaagatgatttagccttccaatatagaggtatatttcgttctgaactggccgtcgaagagcgagataccgtcagtctagatatgtctttgaggtagaatatatgatggaccacatagtttaagattacaaggtactttccctcttctctcaggccatgcattatgaataaagtgcctcccttagcctgagctcctaaagacctcttgtacttggttgcaaacctcagatctctagtctagtctaagtctagatctagtctagtcatgtgtgacatgtgtactagagataccactagacccagtattgctgggtctctatagtttaggaagattgggggtttaataatatttaatgtcttttaggatcataagacataaataggttaggcgatattcaggccttcagaatttaagggtttgaaagtatagcattcagattgtaataggatatgtgaagcacatcatggtccacatcaaatagtatatgtatcatatatgcacaaaacaagcccaaaactttacgtttacgatagcgtatttgttccgataccatgtgtgaattccccccagaaggagtagtctcacaaaaacaaaacatgccagaatggaatggtcgcgtcttcaatgg

SEQ ID NO: 721297 - DNA, 663 bp, Homo sapiens
  misc_feature (1)..(1): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctccagacggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 721298 - DNA, 582 bp, Homo sapiens
  misc_feature (1)..(1): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggtggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 721299 - DNA, 668 bp, Homo sapiens
  misc_feature (1)..(1): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggctggacctgtgcgaggttatgctagcccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgccttggctcacgacggtctggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcaaaa

SEQ ID NO: 721300 - DNA, 766 bp, Homo sapiens
  misc_feature (507)..(507): n is a, c, g, or t
gctctgattcattttacattgtctaccagctattaatatttaatttgggtcaacgatgcttaagcttctgcacagcactactgtttttcatcacgtaaagtgaggatactagcataaccaactccatagtcattctgacatgattgagagcgaggaagactcaggtgtgaacgtgcgtattcgcaaagggtctgacatctggcatgtgctcaacatgttatcatccttatcagcatggttcacaccctctggttacactagaggcctgatacatgtgggaagggagtctggtctctggagtcaaacaagctgggtgcacattatggttccagtattatgaccatgcgcaaacttattattacctctcgtgagccttaattttctctatttgcaagaatacagataatgaagtaatacacagctgtgggatcctgcaggatcaagatgaatcgacatgtctaaaattccaagcacatcatgcagcttcataaccatatctcaaggtgnttagctatcgtgactcatttatacatgtgcactgaggcagtaagggagttactgagaggtatgtggagccaggaatgtgctataatccaaacctaaacgcactgattaactagatagagaagctatgcttagcactgtttgagcagcatacttatataggacccatgcaatctactgtggaaatgtcctatgagcagtaaggtgtctggatgaggcaggagcaaggtacaagggatgccttggtagtctttccaaagga

SEQ ID NO: 721301 - DNA, 521 bp, Homo sapiens
  misc_feature (498)..(498): n is a, c, g, or t
acttcctctcctcccacctctactaaaaatacaaaattagccaggtatggtggcatgtgcctgtagtcccagctactcggaaggctgagataggaggatcacctgagtccagggaggtcaaggctgcagtgagccatgaattgtgccactgtactccagcctggcaacagagactgtgcctcaaaaaaaagaacatttgtgattcatagaagaaggctaaaatattaacaggaacatgagtttggaataagttgattccaactctcatgaatgattttgaggggattcaagacttcagtggaggaagtaactgcagatgtggtacaaatagcaagagacctagaattaggctaggcacggtggcttatgcctgtaattccagtactttgggaagccagggcaggaggatcacttgagtatgggagtttgaaaccagcctgtgcaacatagcaagaccctggtctacaaaccattttttaaaaattagccaggaggtgngaggagaggaagggtaccgagct

SEQ ID NO: 721302 - DNA, 121 bp, Homo sapiens
ctctcatactggtgatagctagaggtgatgtttttggtagacaggcggggtaagatttgccgagtacctttatacttattattataaccttataccttataagcatagcctagtgttaggg

SEQ ID NO: 721303 - DNA, 326 bp, Homo sapiens
  misc_feature (1)..(1): n is a, c, g, or t
  misc_feature (218)..(218): n is a, c, g, or t
  misc_feature (305)..(305): n is a, c, g, or t
  misc_feature (323)..(323): n is a, c, g, or t
natttcggcacaagcggctgccgaagatggcggaggtgcaggtcctggtgcttgatggtcgaggccatctcctgggccgcctgcgtcgtggctaaacaggtactgctgggccggaaggtggtggtggcccctctgtcatgggcccccgctggaggtcagtgatgagcaacattcaccatctttcgtttgagtctcacggccatgagattcaaccccantgcaccgttcttgagaaccttgcaagcaactctttcccaagggttggggactccagggcttcaaggagtaattaatggaattagggntaggttttcaaatttaancgg

SEQ ID NO: 721304 - DNA, 968 bp, Homo sapiens
atcaagttagagatgtaactgccttaaaacatgccagcttaggctgggcacggtggctcaaccggcctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccaggaggcagaggttgcagtgagccgagatcacaccattgcactccacctgggcaacaaaagcaaaactctgtctcaaaaaaaaaaaaaaaaaaagggttggccgggcgtatgaggtaattaaatgggttctccccagaaggtaacctgccagaaaagaagaatgctatagatgttactcctatacggtaaacccttgggtgaaaatcagattcactttctaagaaggatgttttccaacggttttgcaaaaaacgcagtggtgactatggaaagcccaggtttatatcccagctctggtcttacactaaattgtggcgtacaggggttcccactccggtccataaatgggagctaatatctccaacctgtgtgcctgacatgatggttaagggcttaacgcaacaacaatagtgggtatttcattctgtgcagagcaaatggtgggtaaattagaggggctaggtggacgacaatagttttagaaagtaataaaccagctcgtatttttactggttccacttaacagatgtgccacaaaagaaaaggggggggggtaaattcctcagggcaagtgggtaccggttttgtcaagggccaaggggggataaaaggaggcggggtcaagcgtgaggaaggtgggcttggagcaccttcgtgggttggcacccagtaggggaaaatagtagggaaggtggggagtggtataaacagagcact

SEQ ID NO: 721305 - DNA, 207 bp, Homo sapiens
  misc_feature (198)..(198): n is a, c, g, or t
ctggtgatctaaggatctccgtcgagctcgccagtgctccacgtgcacgggtacgtgcagcagcacgttgccttggctcctcataagcagcgcaggactcctcgtcagtggatctggagctcccgccgctttgggaagaacacgttccttcggaactgcaggaaaggctcatccagacagaggggagaccaagccagnagcgcgcga

SEQ ID NO: 721306 - DNA, 370 bp, Homo sapiens
cgtctgaccctagacatgggcttcagtgacactacagcactgaccactgtgcaggtaaaaacgtgaatcatgtgatgatgtctcccgtctttgggtttctaacctgatactcctcttcgcaaccagagagattgggtaagtgtgtatagttgcttgtgattaggcctggaactttgtccatgcttattactgacgcagtccttcccatagtatctgagaatgaatcatttggggcccagatatcttgctgagacaatctgactttgtcttccttcctatgagatttctctcattctgtcacaatgttgtcttcgcgccggcccagccctgaaaatgtgtgagtttctagcattttcattttttctctatt

SEQ ID NO: 721307 - DNA, 1192 bp, Homo sapiens
acggcgtctgagaactcgctggaagactcggtccgggatggctcaacagttcgcaaagtccgggacttgcaggccgggcggcgcagaggctccccgggcggctgcatcccggggactgccccggacatgccccgaaccccttgtcggacgcccgcgccgcttcaccggcatgccactccccgaagtgctctgggactagagcgccctccggcccaacttctgactttggggatcccccagacccatagaggaacgggcgcccggcatggccggagccccgaggcactggtgctgaccgggcgccacgatcagcgtaagcattctgccggcgcccaccaaacatccagcccacccgatcagactcatccgtagcaccatccagcaactgaagctgcctgaccccgcggcacccccggacctccacgccacagcagccctccgaccaccatccagggcactccaaccacgccacacatcaccgccgctcctcatcagcgcaaccccgcccgaacgctctccgcgcctcccccggacataccaagagctaacgcggacccaccgcccgccctaccgcgaccatccgcgcgacatccagaccagccggacccccgaccaacccccacaggcataccagcacacctagacaccccggctgcctcccccccaacacacccccagcagactccccagccccgaaccgacctccagcacgacaaccctggaaggcaatccaagcccagccagcagacacaaggataccgccgccccaccaggaccgcagcgcccacccggcccaacaacccccggccgcgcccacacagacgcccccaggcccggaggcccacaccaagcccgctggcgacaacataccccggcgggccaccacctacgaccgcgccaaccgctccaccaaacgcccacgaaccatccccacgacaggccaccgccagcagcaaccacacacgaacacagcggacgcggtcagagaaggaaaagccacgaccaaacgccgcgcccctacgcaccccaggccccatccccgcaccgaaatcagacccaagcgccacacaagagcccactacccgcccacgcaccccaaagcaacgcaacagcgcacagaaagacacatcacacgcggcagaccgaacaccacacggagcacccgcacaccactcccccgccgacccaccct

SEQ ID NO: 721308 - DNA, 318 bp, Homo sapiens
attcgcggccgcgtcgacctggtgatgaattgtattggcatgcacctgagctggggtctagatacggtcctcgtcttctggggagagggtggcagagaggataatgtagaggtcatgccaagttagttcataacactgggtgaggtactgaaactctaatataagaggtagggtcttctggaaatgaactgagtctttttgttaatttgagagatatcagtgagggagaagggaatgtgaactctaacaacatgttcagtttctgccacttcctgaagggggcagggactgcttcagtttctgtcgacgcggccgcga

SEQ ID NO: 721309 - DNA, 286 bp, Homo sapiens
ggggatggtccccggggcccccacccccaaaatttttaaaaaagcaaagagggaaaaaaagggggcggggggccggcccctgaacaggggggccccgaagccccccccgcagaatggggagggttttggccttttggggatattgggccccgagggggaaactataaattttgtttttttttgggaaaaggtttaagaaatttcccctaaatcttgtttggttggttgggatgaaaagttaactttttttcccaaaaaaaagggggaatttttcttgttaggttta

SEQ ID NO: 721310 - DNA, 142 bp, Homo sapiens
aggcctcatctgacactgtgtgttctgtgcgccaagggcatcatcatcgtcctgagtgcgaaatgcaaatgcaagctttggccacgaagtcctggtcagccatccaggggcagactccaccttctcatcaccccgaggctca

SEQ ID NO: 721311 - DNA, 494 bp, Homo sapiens
gccgggcttcagctgtgtggctggttcggtggtgcctccgctgagcgtgcgggagctggcccaggctgcaatggacaaggatggccatcctgtgctgcacggggcgggcgaggcggtgctgagcgtctagcctgcctgggcgatgcgcagggcgcagggtcccgggggccggggcggaggctgtgtggcggtggcgccgtgggttcccccggaggccctgctggcgcccctgatgcagaacggcttgggccaaggccaccgctgctgcagggctgggccccacgacactggactcggggctgctagcccacggcccgatgcagacgccggcttggggccgcaaggaagggctggccgttgcccccagcttccccgggaaagagcgggaaagcacggagaggggaactgagggagaggcggggaggggcgattagggacacgacagggtagaagggacagagggagagcgcgaggcagagcaggaagagtgaagg

SEQ ID NO: 721312 - DNA, 231 bp, Homo sapiens
tactatccttagaggttcatctctctcagaattgaggacacgcacgctgggggatgaacgctcgctttgccggtactatatcttccggtaatcccagtagtgctgtgagttcctctagcttgcctaggagacgtaggaacctctagtctcatcctacctaggaaccttgctagtcctagatctagtgataagttacaccccctggagaatcccctagagggcccagggtag

SEQ ID NO: 721313 - DNA, 258 bp, Homo sapiens
catttcagaaaaaatacttatatgaaattgccagaagacatccttactttcatgtcccggaactacttttctttgttaaaaggtataaagctgcttttataaaatgtcgtcaagctgctgataaagttgcttgtctgttgtcagagttcgatgaacttcccaatgacgagcagaccttaactgccaagttaaaactaaagtgagcaatttacacaaaaaaaaaaacaacaatctaagcgcacgtgttgtgcatatgct

SEQ ID NO: 721314 - DNA, 317 bp, Homo sapiens
  misc_feature (49)..(49): n is a, c, g, or t
  misc_feature (154)..(154): n is a, c, g, or t
  misc_feature (246)..(247): n is a, c, g, or t
  misc_feature (293)..(293): n is a, c, g, or t
gataccgttctgtagatctggtccatagggttggtgtactcttaaacangaacataggttgttgtacccgttctacgtacgagagagagtcagtaggtgttggatagacacttataattatatgtaacgtctgtgtttagttcgtagactgatngatgatactcacagaaagtttctctgtacgattgaatcatatcgaaagactatcgaagagtggtcggaagagagtattctagcctcaaaaanngacggacgacctgtggacgaagacctaaagggtgttatggagttgnagttcttctattctatgtcgaaaa

SEQ ID NO: 721315 - DNA, 286 bp, Homo sapiens
catcaggatgtgcacacacacatgcgctcacaggaacatagactggctctcatagcgtctacagacccagactgtgacatacataggctgtgacgtcacatatactgaactgagtgtctcacagtgtcacacacacacaatgacttggagtatcagtgtctctcacacagactcacatatacacagagtatcacatacccgtgtctatggtgtcgtcacacatgggatctagacacacactctcacacacaatgtcttagagttcttgacactttgcatcctggga

SEQ ID NO: 721316 - DNA, 618 bp, Homo sapiens
  misc_feature (607)..(607): n is a, c, g, or t
agaaaacaacagtaaatgtgaaaatttcattaacatgataagaaatgagaaaaagtagctaagcataagctgacagtgttcagggtgtatattcacggttcatgttaaaacattttaatattattaatgtatgtatttaattgtatatagccatttccttaatagcttggtatatggtagagtttttagaaaataatatattgtaaatgtactagcgtttttatgtgattattcagtatattacaatgatgcgctgttatttatgggttaaaatatgcttaattgcttccttccttgtagcatttattttaatattctttgcagttgcattttctggcaaaaatgttccctttcaagatatttaagatagaaaataatacctaatatattttatgtcctcattataataattttgttagctacttctctttaatattacagtcctatttaaaaattctagcattaatttgtagataacacatatcttctatttgcataacatagtttttttgttggtgctattaattcaaaggaaaatgttctgtaggattaaaagatgttttaatgtttttataaaataattgtttgaaattaaaaaatgatttangttactaaaaa

SEQ ID NO: 721317 - DNA, 141 bp, Homo sapiens
  misc_feature (8)..(8): n is a, c, g, or t
gcactagnctcatcacttcttcaggtctggaaaaaacatttggaagcaaggaaagaggagaaaacacctacaccagagagccatttgggtatttggcctttaaataaaaagcctcctttatctggctgtgcagcctgtgct

SEQ ID NO: 721318 - DNA, 431 bp, Homo sapiens
atgctgtgtgcaaacatgtctgtgcctcaggccctataaggccacagacctcacattcgtggagcgcaccatgtgcactgtgggtcctggaaaacaccaactctggcacaaaactctctgacatttgtgacacagaaacaaggtatattggagacacactgcgatcaggtgccatatcactgatcttctcacttaaagagaaagttggtgcaatggccaaagcattgcgcctaattgaagagaaagatgtgaacctggaccacattggatctagacctcttcgattaaagaaagattagtatgaattctttaaccatttggataaacacaacctggctgctctgacaaacattatctagaacttgaaggatgacatttgggccactgtgcatgagctttcacgagataagggacacacggccctgtgtccc

SEQ ID NO: 721319 - DNA, 223 bp, Homo sapiens
  misc_feature (64)..(64): n is a, c, g, or t
  misc_feature (192)..(192): n is a, c, g, or t
aattcgcggccgcgtcgaccgcccgttcgtgccccgtatccatggcggcgcactctatggcttntcccggcccacgcaacgcgctaccggggctgccttgcgcgcccgtagttcaactggatagagcacgagccttctaagcttggagttgcaggttcgaatcctgccgggcgcgccatttcagtacagacntgcgaaccggcaaggccggttttccgcccgc

SEQ ID NO: 721320 - DNA, 127 bp, Homo sapiens
catagatgactggggcgtttgggtactagaaataacgcacggtctccttgctacgcaccgtatctaggccacgacagacctcatgcttaccatatgacaccagtgtctcactccacaacaggtagac

SEQ ID NO: 721321 - DNA, 259 bp, Homo sapiens
aaattgactgtatgtatattaataaatctaccttcatcacgaaggtgtgcgggccatggtaacttccaacaacttacatatacctatagtcaatttattttacccggcttttaggaagcctaacgtgaaaataaaggaatttggcctttttttccttcagaaggaaaattagggataattcatttaatcaaaaggacaccttgactttacagggtcttaaaatagtattcagcggggtgcagttcctcatcctggggag

SEQ ID NO: 721322 - DNA, 373 bp, Homo sapiens
aaaatgagttgagcttctatccccattccagagagcaccacaacttgaggcccccatgaattcacacacaattgtcaatttctatatgccggtttaaatgttaattgacgcgggtaagtttattatctcaaagcctactctcgtgtaagagtgagaggcatttaaagaatccatacgtgctttcaaaccccgagttcttcctctggccaatgccatatcccagaaaacacagattttttttgaaataatttgtggggaaaatagaaaaatgcctgccttcggcttccctctcttcatatatcctctctctccctcgcgccctctctcatttccccatctcctcctctctaagagtactcagcacatgtggtct

SEQ ID NO: 721323 - DNA, 394 bp, Homo sapiens
tgcaagtcactgctgagtttttgtgtctgcattgacactgctagtgactcacctgtcattccttggtataaggcttcagcttccctgtgctgtgaagaccccatttgtcatcactttgcactttagcactgtgtgacagcgctggatatcatgcttgggggggggcctgtccttgactcccatccccttaataatgtgttttgcttggagttgttctacgtaatgcagtgcatggtttagaaaagttataaatatttgatccgttgtcctctgtgaaaaaaattgcgcccggttttctctttgaaaattttgttgcttcgttgtagtaatgtcattgttggttttgcctgcttttttctaagaaaataatgttacataattggtgacttcaaca

SEQ ID NO: 721324 - DNA, 572 bp, Homo sapiens
  misc_feature (13)..(13): n is a, c, g, or t
  misc_feature (41)..(41): n is a, c, g, or t
aaccgcggctttntgctttaacccgtgccgcctggtcatgntgctggggcttttcgtcccgcccgtgttcgtggtgactacgccaaggacctggcgtgcccgacaccaaggccgccttcctgctcaccatcctgggcttcattgacatctttcggcggccggccgcgggcttcgtggcggggcttgggaaggtgcggccctactccgtctacctcttcagcttctccatgttcttcaacggctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccttcgggaggcaaactcctggatgcgacccacgtctacatgtacgtgttcattctggcgggggccgaggtgctcacctcctccctgattttgctgctgggcaacttcttctgcattaggaagaagcccaaagaccac

SEQ ID NO: 721325 - DNA, 410 bp, Homo sapiens
atctcttcgctcatatatctctcccgctggccgtggccttagcaggcgacttagaactggtgcggaccaggtgaatccgactggtatacttaaagcaaagcatcgcagaaagccctgcggagggtgcttgacgcgatgttatttctgcccaatgctctgactgtcctcttgatgacattcaatgaagcgcgggtaaaccgcgggagtaactatgactctcttatggtaccctaatgcctcgtcatctaattagtgacgcgcatgagtggctcatcgatattctcactgtacctacctagtatccagctaatacacagccaagggaccggccttggcgcaatcagcggggaatgaagaccctgttgagcttgactctagtctgacactgttcagagacgttagaggaaaga

SEQ ID NO: 721326 - DNA, 128 bp, Homo sapiens
gataatattccttaaagacaactagaaagaaaagggtccccccaacccacctttatttttttttatactaggaaaatcggccagcaaaacaggatttctggaggtaaatctggtcttcttgtaaatcc

SEQ ID NO: 721327 - DNA, 108 bp, Homo sapiens
  misc_feature (42)..(42): n is a, c, g, or t
cgaggccgtcccggagccccacacaggcggtccgacaatganaccgcagtgccggcgcggaaagtggggcagcggctgctccggtccggtcgtgcgtacggcggccgc

SEQ ID NO: 721328 - DNA, 808 bp, Homo sapiens
ggatctcagctcaaatgtcacctcctcagtgaggctgctctgacctctgtctataagaggctcttcagtgactttctctcatatctctgcattatgtcttcatcgcactcatccctctctaaaatatcctgtttctttctttcttttttttttttttggaaagggagttatccggacccaggtggagtggggggtgatctgttaggacctgtgatcccaaacaaaagtgattctccggcctcagcctcccaagtagcgggaactacgggcacgcaccaaaacacccagctaattgggtatttcagtagagacggggttcaccatgtgggccaggagggtctgatctctggacctcgtgatctgcccgcctcggcctcccaaagttcggggatacagacgtgagccaccatgcccggatatatgaagtttcaaaaaatcagaatacagacacaaaatttatggggagatgagcttcttcttctctctcttcaacaccatcgccagatcacctccagttatacacacactgaaaagatactggaaagacttaatacccaggggaatgggcgatacacgggatggtcaatggtcctttttggcgctgtcactgatattctcataagcttgggcctagttagtgaacccggaactttattttggataggcaaaacatttttttacgcttgacacttgtacagtactagaaggttgcttccaaattgtagaaatcatatccactagtggggaaagttgttttaacccacacctgatatggccccactggggaaccttttgactcaaatgttaa

SEQ ID NO: 721329 - DNA, 820 bp, Homo sapiens
gacgacagctgataccatgcatcgttcaagtctctcttcatcctgccgttcctggtctaagtcatgaggtctccctaagatgagctccgaatcagtctgacgtgaagctctttcactgtgcgagggtcgagctttgagactagactgatgatgagcctgatggagccatttgtgagccgtgccggaactgctcgtggagtgtgtggtaggagagatccactccccaagtgctccagcgccgcttgggggttatgtcacttattgccattggttggatggtagtgtgagattgcactgattattggctggggcacgcaagaggtgggtcggactaggttgttggatatccatagagagatgcttgtctcccaagagagacgatttcgctaagacccaggtgcccaactttaactgtgaaaacagatatttggtggtggcattaacaggaagacactgaagaacatcacctaaggagatttatcttgaaacaagtatggacaaacatttgacagtgattggacgatcatgacttgaccgaggcagtggcaagaaaaaggggctttgcctttgtaacccttttgacgaagcatgactcccgtggataacgattgtcatttcaagaaattacccataacttgtgaattgggccaccaacttggtgcaagttagaaacagcccctgtcaaaagcaagagatgggtaaggtggctacccttcccacccaaagaggtcgacaggggttcttggaaacattttggtggtggacgggaaggtggcttccggagggcaattgacacacttccggcgggcaaggaaactcc

SEQ ID NO: 721330 - DNA, 294 bp, Homo sapiens
tttatccaaataaatattactaattgatttttttatgagggcccattcccaatatcctttgggataataataacttagtgtaaacctttatatttgctgatccagcatgtccccctttatggagtagctaaaggagttgagatccttggaactaaaaaaaaaaaggttgagtggaagttgatagtgtaaggtagtggcaattttccctttgtttttagaattccccccccctcctcccgcttcatccctttcaagtaatgggtcagctaataaaggggcccatgactcccgtca

SEQ ID NO: 721331 - DNA, 740 bp, Homo sapiens
  misc_feature (32)..(32): n is a, c, g, or t
  misc_feature (332)..(332): n is a, c, g, or t
  misc_feature (361)..(361): n is a, c, g, or t
  misc_feature (370)..(370): n is a, c, g, or t
  misc_feature (387)..(387): n is a, c, g, or t
  misc_feature (445)..(445): n is a, c, g, or t
  misc_feature (477)..(477): n is a, c, g, or t
  misc_feature (482)..(482): n is a, c, g, or t
  misc_feature (527)..(527): n is a, c, g, or t
  misc_feature (539)..(539): n is a, c, g, or t
  misc_feature (550)..(550): n is a, c, g, or t
  misc_feature (560)..(560): n is a, c, g, or t
  misc_feature (645)..(645): n is a, c, g, or t
gcacgagaagccatctgtgaagggaatcactnttcttttctggacttgtttccaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatctacctgttctccttgaacttcccagctgcctttccaacccatatcttcactccattnttctctccaatccaccctttggttggatnggatctctntcttctgcttccttccncctcctacccacctttgcccctaattattctctgtagctatagcttcagaagcatttntacttgcaagacgatggacacattcccctggngcttnttgaactgtgaccacagaagacaggagtcatcgaaggctgctcgngaggtgcaggcngaggactgctnggagaactcnagagatggatgcttcaagcagatcttctagtgaattatatccaaggacctatgcactgcaacactgagcatgtactagtgtcagnatggactcacagcatccttgcaacctagactgagctgactatcttcacacataggagatgactgctgtcagatgatatctgactgatagcactgg

SEQ ID NO: 721332 - DNA, 246 bp, Homo sapiens
ggttacagatctagaggatcccgccgattgtcatatgacggccgttgtcagtgtggtgggggacatgagtgtggcagtgactccccagcagtgagggtctctctcttacctacttgtgctcttgcatggggatagatatgtccatggggttcttacctccttggaggccatgttgggccagtgaggtccaccacctgtgttgctagtagccacaattcgtatgtcataccagtgaacatgagcttg

SEQ ID NO: 721333 - DNA, 1525 bp, Homo sapiens
ctttggtgggcggcctaatttatgtatagcctcgtgttgtttcgctgccgctgtgtcttgctattttcgtggttcgtgttcctactctctgtttgttggtttactgcggtgtcgtaataattgtgtacttgccctctgcttctttctcctcctggggggcccacttgtttttcttcccgtgggcgccctcatggggggcccttttttttatagagaatctttttttcccccaggacttagggaggcttgtgggggccaccaccaatgggttttttctcttctcggggcctcttccggggagatgttgtcatgaacatggggcgtcctctggtgtcgccagtcggtgctccttcgggggggcaccacacgcccacatagtatggtgggttctttttggcgggggtactttctctccccgccgccttgttttgttgacaccacgagtctcctcgttgggtttttttttgtgcacacaccccggccccccttttttgtattggtgggggtggcctcccccccccactatattgttgtgcttcccgccacggcgcgtcgttgttgctttttgtgggcaccgatctaccaccccccccgccgcctgggggggtttacacaacaccaagcgagagtggggaatctatttgggggtgctcaccgatgttgtttttgtctcccgcgcgcgctactctaatcttgcgtctcttgccctgggccctccctctctttattgtggggggggtaatacccccccccccctccctccctttgttgggggggcgccacccacttctagtattggtggttcttctcctcgcggcgagtaccccccccccgcgacgttatgctctcgtcggtcgcgttgttgtcgcgcgctggtggcgctcccccccgcgacacgatatatatttgtgcgcgcgccgcccccactactctacgagaggagatgttttctcgcgcgacgacgatgtgtattatattatacacacagatctatattttctatacacgcgcgtgttctttatgtggggcacacatatatatatatatgtgagagatataccacatacacacacgcggggtgttatatgtgagctagttacacacacacccgcgcgggaggagagatattgtgagggcatatagcgagagttttgtgtgaggagagaccccctccccggcgcctctttttatccacggcgcgctctctcactctctggtgcgcagacagaagggcgcgaccacacagagagaggggcgccacccccacacaatactccttaagagagagaaacaccacaccctctcttctccggagagataagagattcttgtttcacaccgtgtgttccccaagagcccgggggcattttttataaaaaaaaaaaacatggtttgtgggctctttttttttttttatagaaaagataagaagagtgtgtttataccacacaaagtttatatttggggcgggtatgttaccccctcacttcccctgtgtggtgggaacagggatttgggggttgta

SEQ ID NO: 721334 - DNA, 198 bp, Homo sapiens
gagagcgagtaagcgagctacagtcagtctactcgacagagagagtgcgacatatcactgcgcgtcagaattgaagtatcccatttagacggatgtactcagttggtctacgcacgatgagcatacttcgaacacttagtgacgtagcttgcacggacgtgtatctccaggagcagcgagactgcacatgagactcac

SEQ ID NO: 721335 - DNA, 135 bp, Homo sapiens
  misc_feature (44)..(44): n is a, c, g, or t
agtggggcccaacttcacagcccaggtctggcctcagtctttgnctatgttgcccagatccacccctcccctggacacgaaggaggacaagcggaaattatagagagaggttatcttcttgggagcatttgcaaa

SEQ ID NO: 721336 - DNA, 1382 bp, Homo sapiens
tgctcgtcttcacgtcggctccctactgtgacatgcgtctctggtggtagtttatctctcttccttgtcgtctctagtcttcgtcttgattcttgctcctatgtttgccgtctcgctcttgcatgcctgctgtctccctgtcgtgggatctctttcgctcctctcgtcagctatatggggccctttcctctcttttcctcggctggcccattgtgttgtataccttcctcttgatggggttctttacctctgcggcgatcttcctgattctgcccatcgatggaggcgcaccttgtttcaaggactgcctaaattgcttccctggccagctgcttgtggaatcccttgataaaccatggggcccactttttagtatgtctaaggtggtgattcgtaggggtctcgatctgcttccctgggacacttccgaaaagtgtaccaccctaccagattgtactatgttgtgttcattcgcctttctttccctgcaaactttttggtcaactgttacctaattgattcgttctatttagttatgtcgggatgagggctatatttatagaggaccatggacactgggaaacatatgccatagtgggactcacgagggcctgggtccttgtacacttacctggctgtataattcaggctcattgcacagcagttgcttgtgtttcttttccccgtgtatcggccctcccctgcggacatccgtctcgtgaggtagtaggcttgcattccactgcgaccctactgcccgtcttacaatcaaggtaggcctgtgggcagggccatgtccctttctcctcgtcccctcgtacctcttactgcatgttctccctttctccgtcagtcatggaagccctgggagataaaccatggcttcctggagttcgatggaatataaggttggcggtggcacataatcgcgtcttgttgtggagtgtcgagggtaaaataacccacagggtacaccagaatgattattgttgttcttcttgtctttctttgctgtaccatagtcaactgcacgtgtttaatatttttaagagatcgtaggcaacttacgagatcgacagcctcctatctccacattctctgatagacacgcttcgaggggtcggggagacgaaaaagtgatattctagcctttcatctgcagtaatcggggggaccatatactgacctcttcagcagcgcgaattagcaacaagtttctaggctgtggttggataaatctcacaagagacctgacgatcatcttccacgctcagcttaaccatgaccgtgaaacctccagcgtgaactttgggggatctttcagtggaaacgtcgcccgccaaatgtcgaccagcccccaaatgtaaagatttgtctctgca

SEQ ID NO: 721337 - DNA, 119 bp, Homo sapiens
tctcgttcagtgcattgcgttaggatttcattgagtcgctcctctgtccccagcatagccgccgcctctgtccccaccatagccacccccacttctgtctccaccacagccgcggccgc

SEQ ID NO: 721338 - DNA, 144 bp, Homo sapiens
cccccccccccccccccggggggatggggggggccccccccccccccccccgggtgggtttgttttcgggtttttttttgagccgtccataaaaaacccggggttttttttccccgctttcccataaaaggggggaaaccggga

SEQ ID NO: 721339 - DNA, 216 bp, Homo sapiens
aacgtcctgggctgaaatgatcctcctgcatggtgctcccgaagtgctgggataacaggcatcagccactggccctggtcaggctccataaacttgacgtgtcttgcaatacactgtttactcttagcccaaagcacccaatgacatatcttaccctacctgtatcaccagatttttctggccctgactctgttctactgtcactcttggcccaat

SEQ ID NO: 721340 - DNA, 426 bp, Homo sapiens
  misc_feature (426)..(426): n is a, c, g, or t
ctgacttcaagaatgaagttgcggaccttcacggtgagtgttacagctcttaaagatgacacagacccaaagagtgagcagcagcaagatttattgtgaagagcgaaagaacgcttctacagcatggaaggggacccgaacaggttgttgctgctggctggggtgaccagcttttattcccttattggccccgcccatgttccatttctgtcctatcagagtgcccttttttcaatactccctgcatttggctacttttaggatcttgctgatcggtgcattttacagagtgttgattggtgcattttacagagtgctgattgttgcattttacaatcctcttgctagctacagagcactgattggtgcattttacaatcctcttgctagctacagcactgtttggtatgtttttacaggcgctgn

SEQ ID NO: 721341 - DNA, 944 bp, Homo sapiens
tcgacccaccaatcacatgcctatcatatagtaaaacccagcccatgacccctaacagagcgccctctcagccctcctaatgacctccggcctagccatgtgatttcacttccactccataacgctcctcatactaggcctactaaccaaaacataaccatataccaatgatggcgcgatgtacacgagaagcacataccagggcacaacacactgttcaaaagggctttcgaatacgggataatccttatttatttaaccttcaagaaattttttttccttccggcagggattttccttggagccttttaaccacttccgagcttaggccctaacccccccatttaagggaagggcactggcccccaaaaaggggattcaaccccggttaaatcccctaagaaagttcccactcctaaaaacattccgtataactcgcatcaggagtatcaatcactgagctcaccatagtctaatagaaaacaaccgaaaccaaataattcaagcactgttattacaattttactgggtctctattttaccctcctacaagcctcagagtacttcgagtctcccttcaccatttccgacggatctacggtcaacatttttttgtgagccacaggctttcacggacttcacgtcattattgggtcaactttcctcactatctgcttcatccgcaataatatttcacttacaatccaacatcactttggcttcgaagcggcgctgatactgcatttgtgaagtggttgcattctgagtgctccccattgtggggtggtaaacaacaaaaacaaacaaaaaaaaagggggggccgaaaaccggggcccacccccctttgaaggcccaaggggataaaagagcgggtacgggaaagcgctctggaccccgcggtggcacccaaccgaaagtatggacgcgcggcccctaaacaagc

SEQ ID NO: 721342 - DNA, 314 bp, Homo sapiens
aaacccggggggggttccccccccgggttttttccttggcccgggggggggtaacctttttcccccgggaacccctttttccctttggccctttttgggggcccctttaaccccgttttttccaaaaaaccggggggggccgggccgggatttcccgggtttttttccccccccgggccccttttttccttttttttttttttttccccccgggggccaaggggaaaactttttttttttttaaggggcccttttttccccccgggggggggccctttttttttttccctttttttttttttttcggggggcca

SEQ ID NO: 721343 - DNA, 1640 bp, Homo sapiens
  misc_feature (859)..(859): n is a, c, g, or t
  misc_feature (1057)..(1057): n is a, c, g, or t
  misc_feature (1118)..(1118): n is a, c, g, or t
ggatgttgtgtgatgttggtatgtgctacggtgtgctgctctgcaagaagaccgtgcttgatcaacaccgcacgctgggtgtggctcactctatattcctccggagaggtgccgcccaggtggtggtcacaaagagccccggtgcgtgttttttaccgcctcggcctcctgtttttatctcccggttctcttaagtggtaaccgcgcccctcgtggggcccagattttcttggcccacgagatggttggcgaccgacgaacacacatcggccgcggctggcacaaagaacccaacgccgcctcttttctgtataatgccccgccccaccaaaaggggggacaccacacgaaagagaagagggggatgggaaccaccacatttgtttgctgagaagagaaagcaatttggggttaaaaggaaaaggggggagaaagcccacccccgtgccttaatggggttcccaaataagtaagagaagaaatatattatggagaaaaggaacagccttctgttgccacgctccacgggggacacccccaaggggggacacccccaacagagtgggggccacttactcggaaggggttccttccccacaagaaggtttctcctttggtgggtttttgggaaagaaagggggaggttcttcttctgcccttggaaatattttgccgccccgggagaaatatgggggattgggaaagatgtcggccgacatattttaagaaagagaaaatatttctccacaaccgcttggtgattatttacccttggagagaagatatgattttctcaaagagggtgtataagatacactcgcccccctgggactttaaacatttcccctcagggccatangggatatttttaccccccgtggcacccacaaataagtgggtgtgcccacataaggtgccacaagaaataggcgccacgcacccacataggagtgtgtgagagcgttccaccgtgtggagtatgtgccacaggacatttacccgcagtagggtgtgacatatggcgttgtgtcgtgtctctgtgttctctgtggtgttngggtgttttttacattataaaaaacacgccccactctcattctcacgatataccgcgagangcacactctctttatatgctctccacgcgcacacaccacacacggtggcccgccccacatatcccgcgaagaaagaatatgtatggggaaaataccatggacaccgcgagagagagtgtcccagacaccacaataggacattgtgaaagagaagatggtgcccacatataagatatgggatatccccaggaccagacccattgtggaaaagaacacataaagagaaaagagccttttccccccatactttatattaatcctcttccacttgaagttcttcgcttatgagaaaggtataaaaatggctgagaagaaggccccacagtttgaaattgggagaaagctcactggaggcttcactggtgagaaggcacctatagtttctgggaaaagcccctcggggaacgagagaaccggtgctaaaattgaacgagctgatggatatgaaccccccctcccagaaatctgtttataagattccagacttccaatagtggcccaattaaaagtgctatttgtgga

SEQ ID NO: 721344 - DNA, 179 bp, Homo sapiens
  misc_feature (98)..(98): n is a, c, g, or t
tcacacaggtaactcggaagacaaaggcgctttggctaacgttgatggaagcgtcgcgcatatgcgcgagcttccatcaatccctacaggtaccaggnagagcaggatccacttcagcacctggaacctggatcacataatagaaaagaaacgcaccatcattcctacactgatggaag

SEQ ID NO: 721345 - DNA, 537 bp, Homo sapiens
tggccgcacgtggtcacacgtcgggcttgatgaactgcattgtgtcgtaatcgccatgccggccctcacgctgccacccggcagttgatgtaaacgagatgtcctttccgggtctcgcttcgaggaacagcaactggcaccacgagttggcggctggtcgtgcctcgccaccaggaaaatgatgcgctccttgagcaggcgcgagtgattcataagaccgtcgccggcccgattgctcgacgaccatcgggatcatgccgaggccttgaatttcgtttgcgatcatgaattagctctccgggaagatgaaatcgttcgctgtattgaactgtacgcctgagtgaaatggggctcgtgccgcaaagcacaagccccattggcgatgcgggcagcgacggaaatcagccctgttgctgctcggccaatcagttcgtcgaacgagaccgacttttcattgaccttgggccttccggagcacgaagtcgggtacgttgtgctcgatcacaacgggttcgacttccgccaggcagtatttgt

SEQ ID NO: 721346 - DNA, 801 bp, Homo sapiens
  misc_feature (29)..(29): n is a, c, g, or t
  misc_feature (84)..(84): n is a, c, g, or t
  misc_feature (88)..(88): n is a, c, g, or t
  misc_feature (91)..(91): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (129)..(129): n is a, c, g, or t
  misc_feature (138)..(138): n is a, c, g, or t
  misc_feature (140)..(140): n is a, c, g, or t
  misc_feature (177)..(177): n is a, c, g, or t
  misc_feature (185)..(185): n is a, c, g, or t
  misc_feature (210)..(210): n is a, c, g, or t
  misc_feature (217)..(217): n is a, c, g, or t
  misc_feature (225)..(225): n is a, c, g, or t
  misc_feature (246)..(246): n is a, c, g, or t
  misc_feature (250)..(250): n is a, c, g, or t
  misc_feature (255)..(255): n is a, c, g, or t
  misc_feature (277)..(279): n is a, c, g, or t
  misc_feature (288)..(288): n is a, c, g, or t
  misc_feature (291)..(291): n is a, c, g, or t
  misc_feature (298)..(298): n is a, c, g, or t
  misc_feature (304)..(304): n is a, c, g, or t
  misc_feature (358)..(358): n is a, c, g, or t
  misc_feature (454)..(454): n is a, c, g, or t
  misc_feature (542)..(542): n is a, c, g, or t
  misc_feature (547)..(547): n is a, c, g, or t
  misc_feature (619)..(619): n is a, c, g, or t
  misc_feature (644)..(644): n is a, c, g, or t
  misc_feature (647)..(647): n is a, c, g, or t
  misc_feature (674)..(674): n is a, c, g, or t
  misc_feature (711)..(711): n is a, c, g, or t
  misc_feature (713)..(714): n is a, c, g, or t
  misc_feature (740)..(740): n is a, c, g, or t
  misc_feature (778)..(778): n is a, c, g, or t
gggagagaggggggaggggactggggggnggggacgaacttataaaactgaaagggccaggacagaactgatagcaccctcccngggnggngagggggnggaggnggngggcacagaagttcaccagcngcccaaggngncctttccccaaatgtccatggggtctgcgtgcttggnagccaagnagggcgtgtggcccttcacgctggncttgggntgcctggnccctctggcccttctcacacngggnggggnggtttctccctgaatggggggnnnggggggggnttnggggggngggggntcccacctctgctgagccttcacccagggggtccttgacctttgctctcagganggagcccgtgccagctgatactggagtaggagtgggtgaagaccctccgggctcccgagctctagaggaaggtggtcctgacatggtttgggagcngagaagaaaggaggttgaggttggggaatccacccctgttctgggctgggaagcacttgcagaccacagagatttccagtgggaagtnatgtngcccctccctggctatgttcctggctggcccctgcgctgatcagagccacagaaagtgggccacttttgggncccctagtccccctagtgacaaaanaanagaaggtggtggcaggatggtggtcangcaggacgtgtcaatccttgcccgctggggccaggcngnnggggagcagcttggtgtggccaaaangcgacagagcggtccctgcaggggagtccagcttcacnttgtccaggatggtcttcttgat

SEQ ID NO: 721347 - DNA, 419 bp, Homo sapiens
cattattcatgcttgtggtgatgctggtgtaaacaaacctccggctctgccagttagataaaagtatagcatatagaattatacatataatacataatacttgccagtgataattatattattgatttatggacatgctctactttttattgttattttagagtgtacctcttctacctattaaaaaaaggttaactgtaaaacagccacaggcaggtttttttgaaggcattgcagaaaaagacattgttatcatataaggtaacagcttcatgcatgttattgcccctgaagaacttccattgtgacaagatttggaggtgaaagaaaattatattgatgaccctgattctatgtagaactaggctgatcagtatgtgacttagtttttaccaccagcaagaaaaatgtaaaatcca

SEQ ID NO: 721348 - DNA, 519 bp, Homo sapiens
  misc_feature (519)..(519): n is a, c, g, or t
tcatgcatcttgttctaggaatcaccatgatttgatgacttttttttttcattgtacgtgcatgggggataggcctgtgaacaagaccaacccaaatgaattccctcttgaccccgccggctccgataattactcgaaccgggcacaacaaccaaggttttctaacacccttaaaaaaagccacaaacttttggtatcgaaaagaggggggaaaaaacccccctttatttgaacaggtaaatgtttgccagcgctttccttccactagggggagagtcaccaaaagcccacccttcctgttgggaaaaaaaaaggggtttggggtaaagcggctctaaacgccccccaaaacacaaggaaaatggggaaaaaaaaaacctttggccccccctttggcgggggggtttaaaagggcggttattccccaataatttggtgtgactcttggaaaaaaacgttgttaaacaccggggggaaacaaagggtttaagccaagggggggctatttctgtaatggcn

SEQ ID NO: 721349 - DNA, 232 bp, Homo sapiens
cacgaggccactgttcactgatggagagcaggggatcccaaccgcttgcgctgcctttatgcagaagccggggggcggccacgtcggggtctgcattgggaacgagagggggggccccagtgcagttgggtgacctagcgttggacactggagtttctggtgtctttgcttggaactgaactagctcgtcgtaaggagaattcggctattggtcccagagaccctgctgacg

SEQ ID NO: 721350 - DNA, 1773 bp, Homo sapiens
  misc_feature (1)..(1): n is a, c, g, or t
  misc_feature (1019)..(1019): n is a, c, g, or t
  misc_feature (1053)..(1053): n is a, c, g, or t
  misc_feature (1262)..(1262): n is a, c, g, or t
nttccgtaccctgaacgtgttatcatctattcgcgcggggcgcagccgcgggtgattgctcgcgccctccactgttgatcgtggggcacagcgggggaccacagataagtgctcccccgaagaggatttctctgcgggagggatcaatagttgctccccagcagggatatattagtcagggagcgcgtgtgagtagtgtctccaccccttgttttctatctacaatcaatgtggtgggagcgcccgcgccttttgtggtttatataacgtgaatgtcctctcttcttattagataagtgatgttactacagttagtttcgccttctccgtagtagaggtgagtaagggttggctagtttagtgtttttgtctgtgtttttgctcccctcgtcggcccatccaccttttatttatgaggggagtgatgtctccgcgacacggaggtaagttgcacctctgtgaggtggttggttcgttgttgcttcccctctgtgggggggaggcctcgtctcttttttctgttactaaagatgatgatggtagtgagcgtgctgctgttgtaggtaagacgtagtttatttgttggtgccctagcgcctgtcgtctcgtcatgagttacgtctacagtatgatcgctccgtttgtttctcccgcagtcgtctacgtagcgtgttgctaacactcccacgacgggttgtttttacaagaggagcaacatattttgtttgttgcggcgctcttatataatcggcggcgggggtgattagtatctatcaacaactaagggggatgagccaacaactattcttcggcatacttctcttgctggggcggtgttatgtttttataaggatatgctgcttgttccaccaccaacacggagaggatgttggtgggttcatctacacaccgcctcgcacattactacgctgtgggggcgcacaacatacttatatctcctcatgtggcgctacacagtatgttattctctccattatactgtgtgctactctcaccgntggtggcacaacagagaggggcgctattcttctngtggggggggggacaccacacaagagattactcgtcgcattataagtctgctccatcacacacaactagtgttgctcactctcgtgtcatcacgagtggaatactacacgggtcgcttctctctgtcagcggtgtctctgctgtgtgtgtgtggtgagataacgcatcttcttctactattctctctcgtgcgacgacacacacagcgngggacgacactctgcggcgtactaatctgtgtctctcctcacccacactactctgtgggcgtcttcacatagagatatactctgtgtctcacattgagatgagaggtgggggtgagttccgagagtgagactcggttatacacacactctcacacctccgcggggtgttgtcacactctgccacacacactcgggcgacacactcttttctccacaaggcccacacctcttatgagagagccactcttttataagagacctctcacggtatcctgagacccccgagactctcttgtgagaagagagagagccgtgaattttcccacaagtgtgttccctatattcaagagaggtgttacttgtagcgcacaccttctttcaaagaacccacacaccccagagagtgtttccgggcacacggagactcacgggcccacacccggggggaccacaacacataaggggttttaataaccacaagaaaaataaaagggagaaataaggccggaga

SEQ ID NO: 721351 - DNA, 1192 bp, Homo sapiens
  misc_feature (636)..(636): n is a, c, g, or t
gacccacgcgtccggacgcctaccatgggactggctgtcactgggagcgcttcatgtgcaaccttgactgccaggaagagccagattcctgcatcagtgagcaagctcttcatggagatggctagagctcatggtctcagaaggctgcgaaggatgctggtctatgagtacctctgcattgactgactgtcaggcatggtatccccaacatgatgattcagacaaggccatgacttcaggcagacccctcagcgctttcctcactgggattcagcccagcctatgctaatatatgttcacgaggcaaaggactgaagctagggatttatgcagatgttgtgcatagatataaacctggcgcaggcttaccgctgggcagtttgtggataacgtacgagcattgtatgcccccagtaccttatgctgtactggcgcgagtctgcatctgagtaataccattatcgagtggtcgttcactgctgacgagtagccgtgaatacactttggccatgcatcggttcatatatgccctattgttccttaggcccttggaatatggacttggcacgaaagccattagtgtaactccttgtgcagtggcgctcgtcctataatgtggcccctttcgaggaagcnccaattgatactagaaaattccgacaggtactgcaatcactggcgaaattttgctgaacattggtgattcccggcaaaagtataacgaggatcctgggacctggaccctctatcttaaccccgtgggaggacatggttgcttgttgcctggacgccgctggttcgtggcactatacgcccacttttgttggcgaatgggccacaattgggcacaaagggtggaactcccaacactcaaatggcccactgggcacaataaggagacaccaaacagacgttaaggcccccgcgaaaaatagcgaaacaacaccccctacaaaaaagggaagctaccaacaaggcccctgtagaccaggcgcacacacggggaacgactacgcggggagacccacccacatcgctgctggtgtacaccacgcggggatggtctctcaatacccctcgaggaagcatacgaaccccctacagctcgtcgacgccacaggacgtccgcgcttcgggttctcctcttttgcttttctcttgagcaagatgagagaaaaaagaaagaaagaga

SEQ ID NO: 721352 - DNA, 159 bp, Homo sapiens
gataagacctcactgccagggtgataagcgcgtcatcacgccagctattttgatttagtaagatgggttcacatgtggcaggctgttcgactctgactcatgatctgccgctcacttccaaagtgctggatacagtgtgagcactgtgccggctaggac

SEQ ID NO: 721353 - DNA, 885 bp, Homo sapiens
  misc_feature (9)..(9): n is a, c, g, or t
  misc_feature (65)..(65): n is a, c, g, or t
  misc_feature (72)..(72): n is a, c, g, or t
  misc_feature (102)..(102): n is a, c, g, or t
  misc_feature (115)..(115): n is a, c, g, or t
  misc_feature (132)..(132): n is a, c, g, or t
  misc_feature (136)..(137): n is a, c, g, or t
  misc_feature (139)..(139): n is a, c, g, or t
  misc_feature (143)..(144): n is a, c, g, or t
  misc_feature (147)..(147): n is a, c, g, or t
  misc_feature (157)..(157): n is a, c, g, or t
  misc_feature (168)..(168): n is a, c, g, or t
  misc_feature (182)..(182): n is a, c, g, or t
  misc_feature (188)..(188): n is a, c, g, or t
  misc_feature (193)..(194): n is a, c, g, or t
  misc_feature (196)..(196): n is a, c, g, or t
  misc_feature (199)..(200): n is a, c, g, or t
  misc_feature (208)..(209): n is a, c, g, or t
  misc_feature (212)..(213): n is a, c, g, or t
  misc_feature (216)..(216): n is a, c, g, or t
  misc_feature (221)..(222): n is a, c, g, or t
  misc_feature (225)..(225): n is a, c, g, or t
  misc_feature (227)..(227): n is a, c, g, or t
  misc_feature (230)..(231): n is a, c, g, or t
  misc_feature (233)..(233): n is a, c, g, or t
  misc_feature (236)..(236): n is a, c, g, or t
  misc_feature (239)..(240): n is a, c, g, or t
  misc_feature (245)..(245): n is a, c, g, or t
  misc_feature (248)..(248): n is a, c, g, or t
  misc_feature (255)..(255): n is a, c, g, or t
  misc_feature (269)..(269): n is a, c, g, or t
  misc_feature (278)..(278): n is a, c, g, or t
  misc_feature (287)..(287): n is a, c, g, or t
  misc_feature (300)..(300): n is a, c, g, or t
  misc_feature (303)..(303): n is a, c, g, or t
  misc_feature (306)..(306): n is a, c, g, or t
  misc_feature (311)..(312): n is a, c, g, or t
  misc_feature (314)..(314): n is a, c, g, or t
  misc_feature (323)..(324): n is a, c, g, or t
  misc_feature (333)..(333): n is a, c, g, or t
  misc_feature (339)..(339): n is a, c, g, or t
  misc_feature (344)..(344): n is a, c, g, or t
  misc_feature (459)..(459): n is a, c, g, or t
  misc_feature (479)..(479): n is a, c, g, or t
  misc_feature (495)..(495): n is a, c, g, or t
  misc_feature (573)..(573): n is a, c, g, or t
  misc_feature (586)..(586): n is a, c, g, or t
  misc_feature (732)..(732): n is a, c, g, or t
  misc_feature (884)..(884): n is a, c, g, or t
catttatancttaaatgtttcattgatgtcatcaatattacaaaaaaggaaaaaaaagtgtaggnaaagtgngagcacaggggccagcgcacacctaaagtngaccatgcttctntccttccactgccaggntatnntnccgnnttnttccccaccncctcgctttcntcctccgctttctntaattngtctnntnggnntatcttcnnttnnttntcgcnntcntnctnntnganctnnccttnttngttggcngttgtgtcctggtncttttggtnctcggtcancaggttgtttatnttnttnttggnntnggtgaattnnatcttgttnatgttntcgcncgtgtaccagtgcaggaaggccttgcgccggaacatggccgtgaactgctcggagatgcgcttgaacagctcctggatggccgtgctgttgccgatgaaggtggccgacatcttnaggccgcggggcgggatgtngcacacggccgtcttnacgttgttggggatccactccacgaagtagctgctgttcttgttctgcacgttgagcatctgctcgtccacctccttnatggacatgcggntccggaagatggcagccaccgttagtagtggccgtggcgcgggtcgcaggcggccatcatgttcttggagtcgaacatctgctgggtgagctcgggcacgtgagcgcccggtactgctggctgccccggctggtcaggggcgcgancggggcatgaagaagtgcaggcgagggaagggcacatgttcaccgccagcttgcgcaggtctgcgttcactggcccgggaagcgcagcaggtggtgacccgctcatggtggccgacacaggtggttgaggtcccgtagtgggggtggtcagnt

SEQ ID NO: 721354 - DNA, 284 bp, Homo sapiens
cagcaggagacggcaagtgctggggggtgcagtggacggcttccttcctgcgcaatgtgacttggagctcgctgcggtggaagacttccttggcgcgctgtgacaacgagtttgatacagttgtggaagaagggagtctgccccaggtgagccagcaaatgacgacccactgttccaccaattccagaggggtgactggggctgctctgagggacgactggcctcctgcatcactcagagaacaatgcacgggtcacagccactagcacttaagacacgctacg

SEQ ID NO: 721355 - DNA, 643 bp, Homo sapiens
ctgttcccaggttctagctttgtctccctgttgctactgccaggctctggtctggccaccatcatcttctcccgactctgcccaccagccttgtcctaataaaattaagttgcatcatttaaaaaaaaaaaaaaaaaaaaaaaaaaaaaaaaaaaaaaaaaaaaaaaaaaaaaaaaaaaaaaaaaaaaaaaaaaaaacaaagaaaaaaaaaaagaaaaaaaaaaacaaaaaaaaaagggagcaagcagcaccaccgagagcgagagcagagaaggcagagaagagggggtaatcaacagagagctcggggcggggcagcaagaccgaaggggtaggataaaccacgggcaagaatacgaaacggacgaggggcgagagagagaagagaggtggaacgacaagacaatcgcccgaagaggttgggacaacacgcaggagaaagcaaaactaggacgcgcggtcgagtagaagaccagacggagaggaagatccgaaagagcggacgacagagaagaaagagagaacgagcgaacgcaggagaaggagaagagagaagagagagcacaggaagagggaggacggagacaggcagagggacgagaggagagaaaaaaaagcgcgagcggcgcgaagcggaaggaga

SEQ ID NO: 721356 - DNA, 213 bp, Homo sapiens
gtacggtccggcacagtatattcagcagcaaaacaagaagtggtacgaatttattagagaacaaattcaacaatatggcattattatgcgggatcggacgtttcttttgtttgtagttgccggtattttagtagcgcaaatgtttatgcagctcgatttgctcacgccgggtgaacttcggggtaccgcagctcgacattcgctacatcatgg

SEQ ID NO: 721357 - DNA, 1073 bp, Homo sapiens
acatgagtgctagaggagggggccgaggaatggatagtggctctggccatcttctggatataaattctactccggaaaaattaaacttcacaattggaagaataattaggactctcaacgtgaatagtatctccattactaaaaaagtagatacttaacatgatgacagtcaaacagttccgtgatgcaaagctggtacgctaagtgtaagagtgatgcactactatttcctttatctacactcattcaacagggtggcaattaattggggctgccagattcaaataggcactttcaatgagcattatactggaaggacctagcttgaagtcggagaggcctgggtataggacacagtggtggataacgaggccgattgctaaggacacttaacatgtgctggttgggatttgagggttccgccccaccgatgtcaatcaattgattcaaactcggttagcaaaatagatgagtacgtaagtgcggattatggattgtcggaacattgcctagtcagagagtgatcatatataaggaaattgtgggatcatccctgtgggaatgttaaggactaaatattcgaggaacaccatgatacgtactggtgaaataatgcggggatatatgaagggtccatgcttcaagaaatgtacagtctagcgaggatgtgatataggctcccaagagaaaggggttgggattacgggaagtagattatctaggaaatggatgatacttcttgactaactggagtcgtacaggtagctgtgagggaaaagttaggcatgagatcgttaatctgcccaaggtttaaagagctgcattgtggagaatggacatattgttaggagaagaacaatcatgagtggattccggcaaggctgattgggtggcctgggcagaaagggtaagaagagaagaggggttgggtctgtaataggattccgagtggatgtgggtggagtgacagcatgtcatgtcgctagaatgaggagaaaggactgttggggaggggaaattttacgagaggggattttggagggaagtgtaggtatagggctagaggaaaatta

SEQ ID NO: 721358 - DNA, 304 bp, Homo sapiens
cctaatcatatgctgtcgaatatgatactttgaggagagagtgtgctcgaacttagacgggattgggtaggccaagtatgctaagtgtacaagtatattttttaatttcacacctgaaacaaagaaatgtggtcactaaacaataaaagtatatatagtaggaattaatgtactcttgcttttgtcaagctagtaggcaatagtttccaaggtattatgttactctaactctaaaaagtgatgtaatctgttagcaatgtagtatttcaaataaaggcatttacataatacatttagggttgat

SEQ ID NO: 721359 - DNA, 141 bp, Homo sapiens
ccaaatgcgcgaccgacgacgccggaggggttcgtgttttcgctcaaggcgtcgcgctatgcgaccaaccgccgcgaattggccggcgccaaggattcgatccagcgcttcgtgaacagcggcattgccgaactgggaccc

SEQ ID NO: 721360 - DNA, 819 bp, Homo sapiens
gtattatttttctctttcccccccacccaccccaaaagagtctgctctgcgccacgcgggtgcgtgtgcagcttgctcactgggctccgtttcccgggttcgggcagttctcgtgcctcagcctcctgagtgttggagatacgggtgctcaccattataccgggctagttttgtatttcgaagagatggggttccgtcatgttgcccaggtgtgtctaaaactcctgacctcaagtgatccgccccggctttggccttccagggttgctgggattacaaggcttgagccaccaaggcctttcttttgtctaaggagtatagtcagatacttctagtagtatatatttcctaatacatggaggatgtaccgtaaggattcaaatcttaaatcagtatactgcattttgtcattccagagataaatcttagaccctttctgtggctcttctgacataattctatcctacagtctcagagatgttgttgtatctggccccccaacccatgatagtgatagggtttgccttgaaggaattgctggaatttagctattcccccctctagatttctagttccctttccagtatggctgggcttgagactttgatacctagtactccaggttcagatgctcgcctctttgcaatttaccactcatcgaccatacgtccgtaccacccacacacacaaaaaatgttggcgccgcccgaaattttaacccttttgggccggcccaggaagaaactggcagtgtcaagaccggcgcgagggtgtgccaaaaaccgggcgcggtacacaagggtggtggttacggcgaac

SEQ ID NO: 721361 - DNA, 570 bp, Homo sapiens
atggctttgccttttgctttactgatggccctggtggtgctcagctgcaagtcaagctgctctctggactgtgatctgcctcagacccacagcctgggtcacaggaggaccatgatgctcctggcacaaatgaggagaatctctcttttctcctgtctgaaggacagacatgacttcagatttccccaggaggagtttgatggcaaccagttccagaaggctgaagccatctctgtcctccatgaggtgattcagcagaccttcaatctcttcagcacaaaggactcatctgttgcttgggatgagaggcttctagacaaactctatactgaactttaccagcagctgaatgacctggaagcctgtgtgatgcaggaggtgtgggtgggagggactcccctgatgaatgaggactccatcctggctgtgagaaaatacttccaaagaatcactctctacctgacagagaaaaagtacagcccttgtgcctgggaggttgtcagagcagaaatcatgagatccttctcttcatcaagaaacttgcaagaaaggttaaggaggaaggaataa

SEQ ID NO: 721362 - DNA, 239 bp, Homo sapiens
aaacggcacctccttcaggatgacgcgtggttctgcaattggatctccgtgcagggtccgggagcaaacggggacgagttcaggttcccctgctaccgctgggtggagggcgaccgcatcctgagcctccctgagggcactgcccgcacagtggtcgatgaccctcaaggcctgttcaagaaacacagggaggaggagctggcagagagaaggaagctgtatcggtggggtaactggaa

SEQ ID NO: 721363 - DNA, 473 bp, Homo sapiens
cgtgacgcgtgggtcggacgcgtggtgtcgaggactggaaggactgagcccagccagaggcgggcatgggcagactgacggacggacgacggacaggcggatgtgtccgcagcttctggacactgcctacgagtaccggccagagaccacagctatcgagacacgccgatagaatcgttaccctggtggactcctcggtacagcaaccgcctataatctccggtgcgtgacccactactctgggcgccacatgtaccaacggaaatttaacaacgtcctatatgctgatcaacatgtaaaagatgtttctaaagctgtttctctcacggggcataacaaccctacagcgcggcccattatgtggcctggcccgcctcttgagctacgtcctgtggcctttaccccgtgacaatattgccttatatagcacaacactttctttctcacccagcgagacccaagcggaaaataag

SEQ ID NO: 721364 - DNA, 741 bp, Homo sapiens
gaggagtacggaaggatgctgcaggctgaccccaataaagtttctgcaaggggcgaagaaaagaggacttcctcagatggggacccgtgggagcagcatactcattgaaaatctcatccacaacctggacctcgtgccgaattcgtgcactgaggccggactacgtcggcatgcggcatcttcaaagacggagccgggagttcttggactacagtgtttcgccaccatgatgtcgcagctataatagatgagctgcagatacttggatgaagatcaataaaaagctgctggatggatcaagaatgggctgtctttgcccaacagtgcacggtggaaaagagtgtgctgctatgtgactgactgctctggcagaaaatgagtgctcagacggacataacgaggaagtgcctgtcgaggcggctgcgcgttgggtggctacctgccatgccattgacacagattggcacaagtggcaagcccttgccttggaattagtccagtctgatcgtatcaggtcgtttccttgattgtccaattcatgtgatctgtgtgtttgcatactaggggaacatgagcaagccctgcatggatattgcattgacctatgaaagcagtaagtatacccacaggggggtgtacgggtatgccatcagaatgatcgtgtacgcttgcaataaactacttcgatgaatgtgtgtccagactgtgagtgaccactggccgagcatgtggacacatact

SEQ ID NO: 721365 - DNA, 127 bp, Homo sapiens
ctttttccggggcccccgggcgggagtggggaagggtgggcgcacgaaaaatgggggcctctgtacagttgttactgactttgatttttaaggagccaataaaccccgtttcagagaaaaaaaaaaa

SEQ ID NO: 721366 - DNA, 650 bp, Homo sapiens
  misc_feature (465)..(465): n is a, c, g, or t
gccttgggcccgcacccccgggggtggttcactcacgctttgtggagagccacatcgctctctcggaggccgcactgccgctattgaagggccttggctggcgtttcacaggtcccaggcccactgggcctggtatgcaccacatgtctcgtgccctccacagagagccacaggggcgcccagaatagattttcctccctggtttgcagctgttttccaaagcccccgataatcgctcttttcccactcccagatgccctccattaacccattagtggccagactactggacttctatccatggtgactctaatccagtccctattgatccccgcttgctgaggggcagggagagcgcctcttcctctgggcagcgctatctagataggtaagtgggggcggggaagggtgcataactgttttagctgagggacgtggtgccgacgtcccccaacctagttaggntaagtcaagatcaccattccagggttggtaatgttggatgatgaaacattcatttttcccttgtggatgctagggctgtagagttccctgttggacccagtctgttttctatttgttaagaaaaactccagcatccttgcataatttttgatggtaataaatttgaataatcagattttttacca

SEQ ID NO: 721367 - DNA, 109 bp, Homo sapiens
ggagtgcagtggcccaatctctgcccactacaacctccgtcttctgagttcaggcgattatactgcctaacccttccgagtagctgaaactacaagtggccaccgacga

SEQ ID NO: 721368 - DNA, 382 bp, Homo sapiens
  misc_feature (46)..(46): n is a, c, g, or t
attgttaaaagcttcgcccgcctcattgagttttataagcacggancttgtggccagtgtccccaaccccgtgagggtgtggatggttaaacaaggttatggcctttttgtgaggggggatcccggccggccaaatttcctccttgtgggggatagcaagcaaataaagggccatacattttgtgttttgggtgcgggggccccctggcttgtgcagggtttgatccccccctttgggggggggtttaaggaggggattcaggggttttcccaccagctttggggcgggggggttgcttttttgccccccccccggggctgttgttttgggtttttccttgtggaatgttgggcatttaagggggttttgccccccttccca

SEQ ID NO: 721369 - DNA, 136 bp, Homo sapiens
taccctattgtggtgaaacccatctctactaaaaatacataaattagccgggcgtggtggcgggcgcctgtagtcccagctacttgggaggctgggactacaggtgtgtgcatcacacctagcaattttttttaat

SEQ ID NO: 721370 - DNA, 972 bp, Homo sapiens
cggaggactgcatggcaggatgacgcagaacacggtgattgtgaatggagttgctatggcctctaggtcgcatcccgagtccacccacgtcgacgtccacaatccaccaggagtcagactttgacacaactgctgaaagctggaggttctctgaagaagttatcttttctcaccctggaggtacacgtgtgtcgcattcgcagcagccaggattggttatgaggcatgctgtgctctaggggtgactctagtatattagctggtgggtttgtgatgttggtcgttcattgtgagtaagtgtctcgagtcttggggccctggactgtgctgagtgccgtcaggctgatgccttctgggcggggtcgtgtggatgatcgcaggcaggagctggggccatggtccatgagaaggcacccgggacaagactgtgctggctatatatccagacctgcatcgaaacactggcgatggcttgtgtgctacagcctatggcctgcctgttgtccgtcgtgccggtgaactagcgtgtacatctggcagaagctggaaccctttttatacatcgacgactgtgctgtgatcgcatcaggaccctgtccttcccgtacctactgggcgtcactagcatggatgcgggcagaagtccaacgaggaaccgataatgggcccagacaggcaggaagtgtagagcttacttgcagatgctgaggaagttgttcgacaaagctaatgcgtgcccatgttccctggctgtgtgtgtctcggcaaggtcaatggggtgcgttgcgtgtcctttgggcagtaggtctgcggaaacgttgtgtagggccagaagctcccagccggctggaaatgagggaagggactcggagcaaagaggctaaatgggggagaacttcagtgcacgccctacgcccctcaagggaggcgagaacctcccagtgcccatgtcctgggagctggcatagaacc

SEQ ID NO: 721371 - DNA, 1177 bp, Homo sapiens
  misc_feature (433)..(433): n is a, c, g, or t
ggcggagtctgggcctgcatgccgtctaggtggtcccgtcccgaggcgtcccgcgcatctccgtgcccgaatcccggagtgccagggtcgcgcctgcacctggaaggtcccggctcctgtgccctccctgcagcctgtcagggacctgtcgccccaactccaccatattccgctcagtgcagggtcctcgctggaccatgctaggacactgctgtgggaccctgcgcagcccagaccgttcccaggtgccggcacagccggccaccatggtggcccatgagtgccttgtgcagcaaatccagggggggctaaagggctcagagtgcagtgcctgttgggtgtggcgcagagggtccctgggcctgagccccgcagccatggccgggggcccatcgcttaccccgcactgatgcttcagctctctcacagaggngaagcaagccaagacgttcacccgtggaggatcgtacacaatggaacaggccggagaatgggaagttcaaattggcagaagaattgaaggtgggaaaaggggagagggacactaattgtgaatatgggttggttgcgcagggaaattctggggagctccgaagaaaacatgggtatacttttggggaaattgacaaataaggagcaatgaagggaaaaccgaggtaggggaaccttgggagttcgaaagaatagtacgagagaacagggttaccgtgtgaatcacgttgaagtgtttatcaaaaaggggaaagaaaacccaagaatcaacgcataattaacagtatagctttggggacactaacgaattagtgaattcgcatgtgaggaaattggctaatgaagtggacgcgaaaggcatggggttagacagggagggaattacaacgaagaaaaaaagtataaaacttacgttacctattaccacgagggtaaaaagagacgaaacaggaagtgtagacacgaatcgagaaaagggagatagtatgctggtacagatcattgggagggcttatatattgtggcaatagattgggttgatcattttacggctggtaacaaggtagccaagagttcttggggatgaagataaagaagagcaagtgagggaatagaaaaatgtgtgtagagataaatgtggggaacacaggacaggaaaatggttactgaaaaccgcggatacatt

SEQ ID NO: 721372 - DNA, 377 bp, Homo sapiens
ccgcgttgggccgtccacagtgctgggatcacaagcatgagctaccacgccaggccgatttattcctttttggttactaaattggaccggaggcgcggtggctcatgcctgcaatcccagcacccagggaggcggaggcgggtggatcacccgaggtcaggagcttgagatcagcccgaccaacacggagaaaccccgtttgtacaaaaaaaaaaacaccaaaattagctggcatggtggctcatgcctgcaatcccagccactcaggaggcttaggcaggagaaccacctaaccgggaggtggaggccgcggtgagtcgagaccggaaaacactctagcctggaaaacaagagcgaaactccgctcaaaaaaaaaa

SEQ ID NO: 721373 - DNA, 600 bp, Homo sapiens
agcgggagcggaacatggcgtcaggtctaagcggcgtccgtggaaagtggggtccgcagccgcggatcccccagtccagcgcgacgaggaagaggaaaaagaagtcgaaaatgagatgaagacgatgatgacagtgacaaggaaaaggatgagaggacgaggtctgacaggagtgaatatgaatgaacttatccctatcagataatgattatgacggaatttaagaaattactgcagcagctttttctaaaggctcctgtgaacactgcagaactaacagatctcttaattcaacagaaccatattgggagtgtgattcaacgccaacggcatgtttcagaagacagcaatgatgatctggatgacagatgcggtccggttttcataagcctttaaaatttaactgagagcaagggtaccagtgtgttgaccgaacttcaagagttggttctacgccttctgtgagaagaactgggagaagagcatggttgaacagctgggacaagttttaaatgacaccaccaagcctgggggcctctcctacagtgaacgattcactatgtcctccacagatagtctgcccatgtaccagagctcaaa

SEQ ID NO: 721374 - DNA, 405 bp, Homo sapiens
tggcaggtgaaggtggcttgagccaggatggcgccactgcactccagccgggaacagagcgagactccatctcaaaaacaaaacgaaacaaaacaaaacaaaggccaggcaatgcagccaaccctctacaggaggaacataacttccccccagaccattatggcctccctgcagttggtgatctcttggcctgtatgcagcttaaagtggataaagagaagtggttatatcgaactcctctacagatgtgagggaatggacaagagtggagcagcctttctgctgattatcacacatcatgagctgagggactgcgagtggccaaatgcttggggtgtctggggtctgaccaattaagcttagttcttctccggccagctggctcagccctgccagctggctcag

SEQ ID NO: 721375 - DNA, 675 bp, Homo sapiens
acttctgtatttcaatcatatcatgaacatttgattttgctaaagtcttgtgtcatgtgtatgagcgtgtaactatggtgtacaattgatgtgtctaaggagaaataatgaaatcccaacatggccgcgcgattttcactgaaatcgataattctgcagttggaatgtgaggaggaaagatagcttctatgggtcagacagtccatggctataaggacccgtggtgacgtggtacactttctgcgctgcggcggacaataaccttaaggaaaattgcagaaaaatctttatgcggttacaaccttgggaaggaacgcgtgtccctttccccaaggccccattcctttcccccttaatttgggggacaaagttcgccaacaaaaagtgtgggggcctttccccgttgggtgcgcccaaggcatttacacgggcgggacaacatgaatcaaccgaacacaaacaggggttttttcttaacaaaagaagccgtttgaacccagatttttgccgaattgtgtcttttcgcccttgttggcggtatctccccttgggagtgtggtttttccagccgtttccccggaggaccccaccagtgggggccgcattaaagtataccgtaaaccccaagttttataaccgttttccaagcgcgccacaaaaggcttgcccttgacc

SEQ ID NO: 721376 - DNA, 1557 bp, Homo sapiens
  misc_feature (523)..(523): n is a, c, g, or t
  misc_feature (534)..(534): n is a, c, g, or t
  misc_feature (543)..(543): n is a, c, g, or t
  misc_feature (604)..(604): n is a, c, g, or t
  misc_feature (697)..(697): n is a, c, g, or t
  misc_feature (902)..(902): n is a, c, g, or t
  misc_feature (1557)..(1557): n is a, c, g, or t
ggttcatggttcggcacgtcgctgggtagtcggggcgcgtgcgtccggggctgccagtggtagtgatctagtcatccgacgcgtgccgcgctcgatcggcgaccggctgccgcgtgctgcttcataggtccggccgtctgggcgtcctaatcccggtcgcgcgccgtcgtccggtgctctgccgctcgcacttgcttgcgtggcgtgctcaggggaccgcggcggtgcaggttgcgtccctaggagtcgcgtaggcgctccacgtaatcgtgggcgctagttgccgtgcccaggagacggctaggacgggagtcttccacgccttggtagggttaccctcattgcgcaggcggccggcagtgcgctgacgcagtctcgtagcacctagcctcgtccgatagccttcttcgtgacctgaccagccatgtctctgactgagtcggagcgtgcggtgctgggcgtctcccggaaggacggcacagcctgactgagctcgcagtgcagctcgcaagaacacctcacntgtacactggnaaaggaccnatatcccaccgaacgcacacgcatagacgctcaatgaatctatgtgctcaccggagtcacncaatgtctatacgacacggcacgggaaacgatgtggatatcggaattggtcattatttcctaagagtctctgaaaggctcaatcacgcatagntgaccgcctgtgcgtggagattcgcgataaataaataggtgagaacagaattcggtggcgatttagaagaattctctcctggtgattagaaagaagcgtgggtacagaaaactaccaggcataggtagcggctcaaattcatatcggggaaagggtagcgatatttttgtctctatccctcacacaacatggaacggaattcgcntggaacgatcgatagggaggggggattggaagattggggggagtccgagggagtaaggccatgagattggttggaggtttaaaggagttccaattggacaattggattttaccacttaaaaacagggaagattaggcaggagaaatagcaaagggcgtttaattggcttaaccattggggggcccaacaggcgggtagataacaagtaagaaggataggtttaatagaagtataatacagggagaagaggcatgaaatgagttaccaggatcgcagctccattaggggaacatatcaggcagtctgaaacaaggaatagaagcacactagggatatgttgtttagcaagcacaatccgcttcaccggtggggagggggaaaaaggagctttaagtaaagaggttggtgcctctgaaataggagcgaatagatgaatttaagacgcaaatttagggggaattatagagaagcgaatcacagggaggggcagctgaagaggaagaatattatcttacacgagatattacatataactatgggagggagtgagagaagacatgaggtggggggtcagcacgcaaaagagaacgtagaaatatcgagcaaaagaagagggacagagaggaaagagagcagaagagcagtagtaggatan

SEQ ID NO: 721377 - DNA, 1066 bp, Homo sapiens
gctcagatgtcgcgccagtagtatggttcgtagcccgtcttgtgcaagaagcccacagactagcggattccaagcctggcgtcgtgatctagacggtgcaatcctgacagtcgtcctgtcgagagaagaactaagagtcggattgttcctatgcatgacctcgtgggaggacctgatggaaagatggagaatgactgactgattgcacctctaatagactgatttttcctcaactagtgattgcatgcgaacgaccgaccggcacgtcctgtcgaccgtgaatgtacacgaatcaacagcgaacgttccggcaggactccaaaagcctaccatggtcgcatctcatcgctacgtagcgtgcaccgctagtgtgataggatacggaccataccgatgcgaacgcgtagaaaggagccaaccataaaggtacttatgaaaagcgtaccacgtatcgcagaacccaaagctgaccgtaactgtcgcgaagttgtgggcagagcacgctcgacttggtttgtaatgcatatttcgaagggactcgcgatgacccccatacatactcgcacgagaagttgctctaacacgtagtagggaaggtgagtctgtccgtcggtgtcttggtgcattctacaccaacggattggtggacattgtgaaccatgcgctagggcaaaccgcgttgaagctccgaagttgccgccctcgttgcgcaacaagggcgatcttgaaccctatggcgagcccagccgttggaggcttcttgggccagccattaaatttgagataacgctaggcgaggtaactatcgatttaacccgtgctctatgggccagttccctcccatgaaatagccggcgctagggcccattcatgccccgtgccacattcggtttgtcttggcgacaggggacccatacggggcgtttccactttacaagcgatttggttcccccctcacaattgtaaacttcgacagagtgaggacactaagggtttgagggagaaacctaatataggtccagttcaggggggtttaagaacaaaaggcaagggagcctgacatgcg

SEQ ID NO: 721378 - DNA, 436 bp, Homo sapiens
ggccgggttctggggctcgcaaaggtggcgcccgtggactacctgtcacaatatgggtacctacagaagcctgtagaaggatctaataacttcaagccagaagatatcaccgaggctctgagagcttttcaggaagcatctgaacttccagtctcaggacagctggatgatgccacaagggcccgaatgaggcagactcgatgcggactagaggatcccttcaaccagaagacccttaaatactctgctgctgcaccgctggagaaagacgcacctgacttttcgcatcttgaacctgccctccaccctttcacgccacacagcccgggcagacctgcgataagccttacaagactgtagcaatgtggctcccttgaccttccgaggtgcacgctggtgcggctgacatccgactctacttcctggccgtcgctcg

SEQ ID NO: 721379 - DNA, 882 bp, Homo sapiens
gcccccgccagtgtctggcgcccgcgagcgaggccgcgcgccctcgcctccgccgccactatcgccgtggggcggcactgcgtcgtagccccaagctcgacggtcgccgtggcccggtcgcgtctgccttggagaagaagacaaagatgcaaggtggccctactagtctgctgctctgtgcgccaatggagttcaagaacggctacaatctccggaggcacgaagccatccacacgggagccaaggccggccgggtcccctcgggtgctatgaagatgccgaccatggtgcccctgagcctcctgagcgtgccccgagctgagcggagccggcgggggagtggggacgcatggctgcggtgcctggcaggctggcgctgcctgaatttggcctgccggtggctgtggttgaccacgacctgcctcggggaagcggcatccggaaagaaaccatgcctgcgagatgtgtggcaaggccttccgcgacgtctaccaccttgaaccgacacaagctgtcgcactcggacgagaagccctaccagtgcccggtgtgccagcacgcgcttcaacgcgcaaggaccgcgatgagctaccacgtgccgctcaccattgaccggcgcttgtgcacaaagccctagaactggctccaatggtggcaaagagcttctcccggccgggatcacctcaacagtcacgttcagacaaggtgcgattcaacagaacgtgcctttcgaaatgtgagaaaatggtgaggcaggttccggcacgaaggatgggttgggggcgccacacatacgaaccggagaagaacgtgcctgtcacgtgtgtgcaagatgctgagctggtttattttcggaccaattgaagtgccagcaaggtctcc

SEQ ID NO: 721380 - DNA, 353 bp, Homo sapiens
tagagctgattctagaggatcccaatcagcggaacggaactgcacagctcattcaggcaggcagcacccgctcgttcatcagcgggagatgctcctgaacacgcgcttcagatctctgtggactgcgcaaactgctgcagcgtcagttgtccctcgggtgccagctccgtggcccgctcttgcttgctcagaagtgtggcacagcaccacttttgtgctttgaggtagggttgcttttgtccaccgtcaatggctgctgccaggtcatgcccatttggccaacagggagggcagcgggtgcacgccgaggggccttgtcaagcagattctcgggccaattaatggtggcaccg

SEQ ID NO: 721381 - DNA, 490 bp, Homo sapiens
ctagaggatccccatggaacaggctgatgctctatttatcatttgctttaccactctcattctctcacaagcgtacagtgttgttaggctaaggtcatgtgatacaggaatgactgaatgcagaacaagacacgagaattcacgcatggcttctattaagagagatcttataaagatctgaaaaaatgtaaaataatcactcctttccctggtattttttagcaaatataattggttttcattaaaaatgttatgttacgataattgcatgaggtaatggatactaactaccctcatttgatcattagaccaacatatacatctatcaaaacatcaaactgtatcccataaatacatacaattacaatgtgtccatttgtaattttaaaaatcttttttttttggagatacagtctgtcacccaggcttggagtaatctcagctcactgcaacctccgcttcccgggttcaagtgattcttgtgcatcag

SEQ ID NO: 721382 - DNA, 172 bp, Homo sapiens
gggggggggttccccccccctgggggggggggggggcccccccccccggccccttttggaaaaaaacagggggttttttttaacccccccttttttttttttgggggggggcccggggggggggggggggttttttggggggggggcccccctttttttttttttttcccca

SEQ ID NO: 721383 - DNA, 476 bp, Homo sapiens
ggacggcagaggcctctgcggcgcggtcctcggagcggcgcggttctcggagccacgcgtctgtcttcctccgtggtcatggcggactacctgattagcggaggcacctcttacgtgccggacgacgggctcacagcgcagcagctcttcaactgcggggacggcctcacctacaatgattttctcattcttcctgggtatatcgacttcactgcagatcaggtggacttgacgtctgctctaactaagaagattacactaaagaccccattggtttcctcacccatggacactgtcacagaggctggaatggccatcgcgatggcgcttacaggaggtatcggtttcatccaccacaactgcacacctgaattccaggccaatgaagttcggaaagtgaagaaatacgaacagggattcatcactgaccccgtggtccttagccccaaggatcgtgtacgcgatgtatttgaggc

SEQ ID NO: 721384 - DNA, 272 bp, Homo sapiens
ggggtactcgtatgatacagacacgcagtccacaatccgtcttcaaatcacgttgtatagtggacataaaaaacacagtttaagcctacgaagtcaaccataataacttcttcagctgtcccattagatttttgggaacttgctactagggggattcactgggtttcttataaagggcaaattcagtaaagatcattctctagcaatggttctcaaccagaggtaccatccctcaaggggtagctggcaatatctggagacattctatggtt

SEQ ID NO: 721385 - DNA, 394 bp, Homo sapiens
tctaactaatcttctatcaacgtcatatgagaattggtggcaataaaacctggaacaaagcctaagatggaaccatttttgcttattagaactccacgtccagtcattgtggaaccacttgtacaactagatgatgaagatggtcttcctgaaaaatcttgcccagaagaatccaatgtatcaaaaggagagagaaacccctcctcgttttgcccagcatggcacgtttgagtacggatattttaaagccgattggaaggtcctttggatgaaattggaaaaccaagcaaaggggaccaggttgaaaaaaccatgaaagatgcaaaagacaaattggaagtgaaatggaagatgcctatcatgaacatcaggcaaatcttttgcgccaagatct

SEQ ID NO: 721386 - DNA, 112 bp, Homo sapiens
  misc_feature (25)..(25): n is a, c, g, or t
ctctcgaggacacgctataataggngtaggacagtgactagcagcacctgctaggtacggccaggtgtctgcgcacttggcggcggctcacgtgcgagctactcttactgct

SEQ ID NO: 721387 - DNA, 835 bp, Homo sapiens
  misc_feature (79)..(79): n is a, c, g, or t
  misc_feature (84)..(84): n is a, c, g, or t
  misc_feature (97)..(97): n is a, c, g, or t
  misc_feature (101)..(101): n is a, c, g, or t
  misc_feature (104)..(104): n is a, c, g, or t
  misc_feature (130)..(131): n is a, c, g, or t
  misc_feature (133)..(133): n is a, c, g, or t
  misc_feature (139)..(140): n is a, c, g, or t
  misc_feature (150)..(150): n is a, c, g, or t
  misc_feature (167)..(168): n is a, c, g, or t
  misc_feature (209)..(209): n is a, c, g, or t
  misc_feature (212)..(212): n is a, c, g, or t
  misc_feature (222)..(222): n is a, c, g, or t
  misc_feature (231)..(231): n is a, c, g, or t
  misc_feature (240)..(241): n is a, c, g, or t
  misc_feature (249)..(249): n is a, c, g, or t
  misc_feature (255)..(255): n is a, c, g, or t
  misc_feature (267)..(267): n is a, c, g, or t
  misc_feature (269)..(269): n is a, c, g, or t
  misc_feature (278)..(278): n is a, c, g, or t
  misc_feature (287)..(287): n is a, c, g, or t
  misc_feature (291)..(291): n is a, c, g, or t
  misc_feature (330)..(332): n is a, c, g, or t
  misc_feature (338)..(338): n is a, c, g, or t
  misc_feature (380)..(380): n is a, c, g, or t
  misc_feature (386)..(386): n is a, c, g, or t
  misc_feature (388)..(388): n is a, c, g, or t
  misc_feature (399)..(399): n is a, c, g, or t
  misc_feature (404)..(404): n is a, c, g, or t
  misc_feature (415)..(415): n is a, c, g, or t
  misc_feature (424)..(424): n is a, c, g, or t
  misc_feature (428)..(428): n is a, c, g, or t
  misc_feature (438)..(438): n is a, c, g, or t
  misc_feature (441)..(441): n is a, c, g, or t
  misc_feature (444)..(444): n is a, c, g, or t
  misc_feature (447)..(447): n is a, c, g, or t
  misc_feature (453)..(453): n is a, c, g, or t
  misc_feature (472)..(472): n is a, c, g, or t
  misc_feature (542)..(542): n is a, c, g, or t
  misc_feature (547)..(547): n is a, c, g, or t
  misc_feature (563)..(563): n is a, c, g, or t
  misc_feature (565)..(565): n is a, c, g, or t
  misc_feature (570)..(570): n is a, c, g, or t
  misc_feature (572)..(572): n is a, c, g, or t
  misc_feature (576)..(576): n is a, c, g, or t
  misc_feature (581)..(581): n is a, c, g, or t
  misc_feature (593)..(593): n is a, c, g, or t
  misc_feature (595)..(595): n is a, c, g, or t
  misc_feature (599)..(599): n is a, c, g, or t
  misc_feature (634)..(634): n is a, c, g, or t
  misc_feature (636)..(636): n is a, c, g, or t
  misc_feature (641)..(641): n is a, c, g, or t
  misc_feature (789)..(789): n is a, c, g, or t
ggcttctctgagtcaccaacctgaggctgccccggccgcctgcgcacccggcagcaccatgacagatcaggcctttgtnacacnaaccacaaacgangccnacnccaaagcgcgccccggcccccgcggnncntccccnncccccccccngccccccccgccggccnncccgccgcccccccccccccccgccccccccccccctccgnccncgctttctcnccccccccncccgactgnngtcactcntcggtngactgtcttggncncgcggccgnttctgcccntccnaccttaatgaagaggccagagttgggtgtcacgctgacnnngctccnctgctggtcgcttacacagtattcaaaatgtgtattcatggntgccgntnctctggtcctngcccntattgatgatntttttgacngagnagaattgtcngcngcnccngacccngggtggcctgactgcttcnattccggagtcttcgtttatcagccttcagttgaaacatacaatcagctgttgcatcttgcttctgagcnaggtngttttgatggtggggncnaggcntnctgnacacnttttttagcatntnggcnacaacagatatcagaaaacacctgccatttatttntnacctnagcagcatctctatatactcctacctcccggcatttaaagtgtttggtgcaagtgccaaagttgtgcatttcctgggacgagtcaaaccatggaattatacttatgatcccaaaacaaaaagtgtcaaaagtgaggcccatgatcccnacatgactcatccagagtttctcatcctgtgggtggacatctttac

SEQ ID NO: 721388 - DNA, 175 bp, Homo sapiens
gtgtcttattgtagcattttcacaggttgtgcaaccatccccacagtcttaattttagaacattgttatctcctcctcaaagaaaccaaagcaaggagaaccccatacccgttactagtcatttcacattccgtcctgccctaactcctccctgaccagtacaacctgccggtgg

SEQ ID NO: 721389 - DNA, 434 bp, Homo sapiens
acgacaaggcgactcctaaagctgactccttacatatttttagtttttcctaaaggtctcctggtacatagtgaactgtgagctaactggatctgtaaacagacattagggagacataatctcccagcaatcaccgagtatcagccaatcacagcagccagctgttcaaatcatgttcaaataaggcaaatgccgggctgtaaccaatcggctgtttctgcacctcatccccattttctgtgcatcactttcctttttattaacataaatctccaaccatatggcagcacggagtcactctgaacttattctggtttggggagctgcaggattctcgaattgttctttgctcagttaaactctgttaaatttaaattgccttacatttgtgtttggttgtcgtttttgttggttggtatgtgtgtttgtctgaa

SEQ ID NO: 721390 - DNA, 446 bp, Homo sapiens
  misc_feature (103)..(103): n is a, c, g, or t
tcaccgctttatacttttcgatcccgacttcgagatctggttttctttctgatcgatcatggcttcgcttcttcgtcgatctctacttctgctccgccttctntctccctcgctcatagatgtggatagtctgcaataggtgatattcttctgactcctacttcagtgctctcctactcagtgaaactccatgtgtttctaaaaggacttcggagcaactgagacacacatagatagatagacagacagatagataaataggtaggtaagtagatagataatggatggatcgattcatgaaagggcaggagacattgtgtataggtttgtgtgtggtgtttgttcatgttgtgaagacagaggcataagctatcataaggagagaagaacaatgggaaaggaggaggaggacagattttatctgagcaacgcccagtaacaggtcc

SEQ ID NO: 721391 - DNA, 116 bp, Homo sapiens
ttttggaaacaactcaatgttcattgatagaagagtggatcaagaagatgtggcatatactcacatggaatattacttacgccattaaaaaagggaggaaataactggcatttgca

SEQ ID NO: 721392 - DNA, 849 bp, Homo sapiens
aacacgcccaatagaaaacattggctatggataggcgtggttaaatggccgaggacgggccgcaggagcgctcccactccaggcagcccacccggcggacgggccccgcgcgcccaggcgatggcactgggctcccgtctgctccccgtggtccgctccccgcgtgtggccactgcccccggccccgccatggtgcggatttcaagagcccaagacgtttcaggcctacttggatgattgtcaccggaggtatagctgtgcccactgccgcgctcacctggcaaagccacgtacgagcctctagtctccgaagtccttccagggcagtcagggcgcgtgcgctaccttctttcagagctcagtggttgaacgtgggctgcgggccatgccgaggagcggcgtgctgctgaccggcctccgatgctgtcgccgacatccattgcggagaactgcagagaccactttgggctggacatatatgactcatgggcctttgagagctaggccagaagtacaaagagggggacagtacattcattgaaggtcaagcactatgcatcaaagactaagcggcatgggactgactccccgttccccctgacgcattgtggtctccagcccggcgcttgtgccgccgggggaggcgccaattggctttccgcgccatccgaaggggcagctcgtggatccctcgagaagtccccctgcagaggacggagtctagctcgctgtgtcattctatgttatagcattgcgactgtgaccttggggggggagaacagaaggagggacgatgcccccgacctcctgcgatctggcttggcttgggatctccgtttaaaagcccgt

SEQ ID NO: 721393 - DNA, 314 bp, Homo sapiens
  misc_feature (142)..(142): n is a, c, g, or t
  misc_feature (173)..(173): n is a, c, g, or t
  misc_feature (299)..(299): n is a, c, g, or t
  misc_feature (304)..(304): n is a, c, g, or t
gtggcaaaatcaaaggcttttaaatcccttatttaactaaaataaactaaaagtatgtagatactacctcctgggccagggagactaattaaaaatgggagggttcgggaaacacttggctcggcggacgcggtaaaggtgntttaaaaggctaggtgcggattaaaagtggntagccttaccagtcaggggtggaaaaccacgactcagggtaactttttacctttaattttttctctttaaacgtgaaagtttacaaagcaaagtgagttgaggatttggcgttcgtgggacctggntcagncaggtgaatt

SEQ ID NO: 721394 - DNA, 91 bp, Homo sapiens
gaagttgtacatggttccctggccactggtgttaatgatctttaacatcagcgccaccgttctctacatcaccgccttcatcgcctgctct

SEQ ID NO: 721395 - DNA, 201 bp, Homo sapiens
gaggattcatcacacgccgagtcccagacaagtcggtatggacgaagttgttgcgcaacaacttcgtccatagagaccgcaacaacttcgtccatcgtagaccttgaccaaattagaggagaacaagtctgggcactcggcgtgtgcagcaacaacttcgtccatactgatttgatgtagtttggtgattcggcgtgtgca

SEQ ID NO: 721396 - DNA, 106 bp, Homo sapiens
gcctgcagctcttggggttttttgtgggcttccttcgtaatgtggagccaggctacaccccaagccaaccatgttccaaggcccctccagttggatttgtctttgg

SEQ ID NO: 721397 - DNA, 144 bp, Homo sapiens
cgacgggggggctgtaggtgtgtccaccgttagtaccggttggactaggactctgctctcatggtaacgcgtccaagttggaatggtcttccagtctccatggcatccacatgctactggcgttaccatgagagcatatcctat

SEQ ID NO: 721398 - DNA, 1530 bp, Homo sapiens
  misc_feature (45)..(45): n is a, c, g, or t
  misc_feature (664)..(664): n is a, c, g, or t
ggctcctcacacataggcgggaaaacggcggggtgcatcaaatangatattttgctccaacaaagtagtttaatagggatatagcgctcccaactgcgcgtcctttagtctttcctgttaggtaaaacccacaccagctgttttttaaataccacccccctcacgaccccgtgaatacgacgctgctggttggtgttgtgtcctgtgcctcccataagtcacacacgtcgtctttgttgctctcgttaatgacgcgaaacatattttcctccttgcgctcttttctctgtctgtgatttaagtaagtgccgttgctctttataatagacggttctccttctttgtggcgaaaaacaggtgggtttgatattggttcgcaccccccagtgtttgccacctaggggcttctgtccacagaaaactgctgtgtgtgtggaagagccttctccatcataggaagcaggtataatagtatgtaacacgaccccccttcggctgttttgtcattagcaaccttctgtaatagacccccaaccggcagcagtgtggttgtggttttgtgtatttgctcctttgtgcttctgtatatataatactactcgcctcaccacaatccgttcaccaacattgtaatatatgaggaggtaagagtatgtatatgagnctctggaagcaacacacacaaacagggggggagaatataagtgtgagtaatatggggggggctccctcggtggatagagacctcaacaccaccagcggcggaagagtgaccttcgttatgttcttcgtttagagtagttgtctccccccaccccccacccctggtaagatgctcccacaggagatgctcctctccactcccccgcagggggtccacacggctcgtccacggcggaagattacattgtggagaatagggggcccacaccacatgtgtgcgcccctcttcctcgtaggagattattcttgtggaggaaaattgctcgcctctcccctctgtcgggatatataattgtgatataccctggagagaaacccccacagcgttttgagatgtccccacatgcgcacagcccacagggagtagcacagcccacagcggcgggagacacgctgtgcctgtctcccacagcgagagagagagtttcggctcacacaaacaccattcacacggccgcacaacacaccgctttggcaccaccacacacagctcgtgtgagagagagagagggctggcacaccacacgcgagagagttctcttgtgttcttcccctctttgtggccacactgagtatacctcttgtgcctctatttctgagcacacacacgctatcccctccgagtccttctcctctccacacccccaggggctgtggcacgctgggctggaggctcttgtgtcacccctctgcttctggagggttgaggacccccactttgaggccacactcctttttttttgttcctttgatcccttggcatcgtcaccaacccaccggtgcataatctaaaacttgctgagtcca

SEQ ID NO: 721399 - DNA, 393 bp, Homo sapiens
  misc_feature (13)..(13): n is a, c, g, or t
agttcagggggcnttcccaccattccccagaactgatccaaagtagcttactatatctaaactgtaaaacaatatagtttctcctgaacacctgactttcttctgggagtctggaattttggtatgtgccaggcagagactacctttgtgaccagctcccagtaaaaaccccaggcactcagtctctaacaagcttttctggttgacagtgtttcacaagtgctgttacaactggttgctgggagaattaagctcatcctctgtgattccactggcggaggattcttggaagcttgcacttagtttcccctgacttcaccccatgtgtcttttttcctttgctgattttgttttgtatcctttcactgtaataaatcatggccgtgagcagaa

SEQ ID NO: 721400 - DNA, 191 bp, Homo sapiens
agcgggcttgcgtgcctcgcctcggtatcagcagcgggtcgtctctatctactccgggctctcgcctgcgccccagtccccgcgtccgtgtcctagccgaccatggccggagcaccctgtagctgccccgtttgctcctgcttggtgccatcgctggcctgtggccctggtccgtgagtcgcccgctggcc

SEQ ID NO: 721401 - DNA, 894 bp, Homo sapiens
gtcaaatcaggttaacaagcataggcaggcagtgttgtgcgatcagccttggtcaagaggcatttacggatttccttatgaacaatcaggaagacagttcataacgacactgatgctaggtttctgtgagtacaggcgatccaggctgctactgggtaactagtggacgtccgttgatctgcgatacaaggcttctcatacgatgggactacttgacacacatcatatggattcttctgcgtcggtgacccctctacatgtaatcagctgtagtttggatcttggtgctgggggttcatgtgtcaaactgactgactatgtatcccattattctgcaggtaatcgtccgcgagccaattacaactcagaggacttttctcatacggagcaatagcatcactaggtgcatacatgcgcctttgccagctggtgcgtgttgagattctatcactccatgtcaacatactatgctagaagtgtggggccacaacaagtcaggttacgacaactgtttccatatcacaggtatgcagtacagtgtgcagatgccgtacaggaaggaaggcctttacaacaggcacacttggtttgcaccaatatgaattattcaaccgacgtcatcgaatagcctacaattagtcgctatggggacccttgtggaactggactgcgctgcatggtactgtaccacgagagacgaactctcccctagaacttactatccgactgggagtgcaactggccacagccttttatgtccaatttcaatccactacttcacgtggtccagcgaaggtgcacatccccaagggtggacaggggagacccccccattcagcgccgaacaaactaataggctcacactcacgcggaatgcatcggatacatatccag

SEQ ID NO: 721402 - DNA, 785 bp, Homo sapiens
  misc_feature (178)..(178): n is a, c, g, or t
  misc_feature (443)..(443): n is a, c, g, or t
  misc_feature (676)..(676): n is a, c, g, or t
  misc_feature (682)..(682): n is a, c, g, or t
  misc_feature (690)..(691): n is a, c, g, or t
cctcgtacctcacgcagcgggcgcgcttcttcagcgccaacgagggcctggacgactatctggaggcgcgcgagggcatgcacctgaaggacgtagacttccgcgagtcgctcatggtcttcgccgacccccgcagcccgccctggtacgcgcgcgcctgggtcttctggctcgtgtnggcggccacgctgtcgtggcccctgcgcgtgtggccgcctatggcacggctcacgtgcactaccaggtggagaagctctttggcgccagctcgcccccgccgggggccgtgcccagcgggcccccgctgtcccgcgtggccacagtggacttcactgagctcgagtggcacatctgctccaaccggcagctggtgcccagctactcggaggccgtggtcatgggcgcgggctcgggcgcctacctcagaggctgccagcgctgcngcgctctgtcagcagcaactcgctgcccccgcccggccagcgggccccgcctgcccttcagccgctagccgcctctcgctgggcgctggcggccgggccacgccaggggtcttccgcagcctgagcggggggccgctggtggcgccgtggagaggacacggaacccctggagagcccgcctgctatgaggacgcctctacttcccggtgctcattgtccacggagacagcggntgcagngcgatggnnaggtgctccttgaaaccacgaaaagcacacacaaaagaaaaacacaaacaccaaaaaatacacgaaaagagataaaaattcgaaaaaaaaaaac

SEQ ID NO: 721403 - DNA, 956 bp, Homo sapiens
  misc_feature (217)..(217): n is a, c, g, or t
  misc_feature (474)..(474): n is a, c, g, or t
gggcgacaagccacgccaggtgccaagggcaagagacgtgagggcacaagctgtcccagtataataaagaaaatatatagaataagaatagttcatactcagaacatagattcagtaggatcatgatgtgtatagtgacgtatcgattagatccatgtcagatctagtagcgagtcacgtcgttctattccgaatcatgtagtaactacatctcttngtgtcgtatcaagttatcaatcccagtgaagataaccaggcgcactagcagcggatagtgagcttgaaaggggcaccggatgcaggaaggtgcacccagtatgcagatgttgatgcgccttcgtgtttgacggccgtgggacgagggaaccacttagcagggactccgcgtggctctgaagtgtgtatacagccgagtcgaactctggtggaagggtcgatgccatagtacctaagaacggaagctcttgcgttctnaggggcgttagtctatcaagtggcgctggcgtgataggcatcccgtttgagcttatgccagcacctggtgtaaagcgtgaagttctcccgcgttttccatggcgcggaaggcttagcaagcaaagactcctgacttccaagcacgaggctcttggtgtgaaaggcctgaactatcagatcagggcccaacctacaagccaatcatggatggccatggtctccgctgtgaatgctagatgcattcaagcgagtcactggtccctgtattcacagttcaatgttaatgctgctgttacacgctggcctctggccgttcttacgatagcatgatagcagtaatttagtcgaaacgtacttaccatggtctttcgcatgcgtgttcctgaagagagcagcatcacgaagaccataagtgatgctaaggcttgtccatctgttcttctccgggcttggccttacctaacagtggaaacagggccccc

SEQ ID NO: 721404 - DNA, 283 bp, Homo sapiens
taaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatc

SEQ ID NO: 721405 - DNA, 154 bp, Homo sapiens
  misc_feature (6)..(6): n is a, c, g, or t
accccncacgggggcgacatatacacacaccagaaacaaggctggtgacaacggactgcaacaccacggaacagggaaaacgagaaccatcgacatcacggccacacacgggcacagcccccacacagagcagcggcacccaacccctacagcc

SEQ ID NO: 721406 - DNA, 130 bp, Homo sapiens
gtcctttctccgtatgcccactgacatacattgtataataattgttcagtttactgtattgttactaacatcttgtatgttagatagtaaattccttgaagacaagagctatagatagttgtaaatggcg

SEQ ID NO: 721407 - DNA, 269 bp, Homo sapiens
ttacacctggtatcccagcactttgggaggctgtggcaggtggattccctgccgtcaggagttcaagaccagttgggccatcatggcaagggcccgtctctactaaaaatgccaaactttgttgggcgtcttgacgcacgcctgtgattccggctactgaggatgctgcgacatactaatcacttcagccctgggggcaaaggttggggagtgccaatatcacatgactgcactccagcttgggtaacaggatctcgacttctgtcttt

SEQ ID NO: 721408 - DNA, 869 bp, Homo sapiens
caggtgtggtggggtgtgcttgtagtcccggctgctcgggaggctgaggcgggggaatcgcttgagccctgggcagtggaggttgcagtgagctgagatcacatccctgcactccactccagcctgggtgacagagcgagattctgtctcagaaaaaaaaaaaaaaaggaaaaagggttttttcccattgacccaagcgggaattaaggaaaaaaggtttttttttcattgacccaagcaggattttcccggttaattccggaaaatacaagggttgactcaaattttgaaaggcccccttattgtaattacttccctttaattagacatgggggggcacaaacttgaaaccttgatgtcattggtgtgaagagaaccctttgggactttttccaccactctttcataatgaggctatgcccttgtgataaattcacctggtgtaacgaaattagagcggaaccctacgtcagttgtattaaaaccccatttttgaaaattaatacaggctaaatgccgacctcggggtaaaagaccggaaaagttatatcaggcataatatggaagttttaggcctgagaaataaggcataagaaatataataagggttacaggaatgggcggaagtgattttgggggcctatatgatttattgttgaaaaacactaaagagttcatccataaaaaggctggaatcaatggggtcggaggggggaataacaattcaaaccaaagtcgtggttgtttttctacagaaaagaaagaaaaaaaaatttggggggcggcgagagtttaaaaccgggggggggcaaagtaggaatgaaggtcaagaacggggtagggggtcccaagagggggtgacaggtgtc

SEQ ID NO: 721409 - DNA, 960 bp, Homo sapiens
  misc_feature (3)..(3): n is a, c, g, or t
  misc_feature (23)..(23): n is a, c, g, or t
  misc_feature (49)..(49): n is a, c, g, or t
  misc_feature (57)..(57): n is a, c, g, or t
ctngaggcccaagaattcggccncgagatttattaggacctttcttttnttcctctnttcattaaaaaaattaaaatattcaggactatcagctcctcttttgctttgctttttcttttttatataaaatatcagcaagctgcaaaaaaacaaaaatccaaaaaaaaatttttttaatggggttggggggaacaaaaaggaaaataattgctgaggtaacttcataccttgaggtagtttacttcgcacacagcattgcctgactacgcccacatgttgcggttgtcttgttgttactgttgttgcaatgttgaaaggaggggaactccacgcatgggcttttccatatgtagagaggccttcctcccttcccagcacacttgatagcattgtccagggtagctaaagtgcattacctggctaatatgcattgtcaatcagtatattaggaggagaggcctaacctcatttaactgatggcttctgtctcccacaagggctaaacactccatgggatcttaattaagcctggtaaattaataaattaagcttatttaccccttgctgtacaatgctgctggtattctgaattgttttttagacacacctttcatcatgctgataatgattcatggagacagaagccgtcagttaaaaattcctctcagatacaaacagaagcaagtactctccaattactgaatttgccagatgatggactttagctttatcgggagctcagggttgggttccaagtcccaccaccaaggtaacagtgccgtggctgggagtgccccacaacccctgcctctaggaaccagcccttatgggagcacatgggctggggtgagggcaccgtggcagcctttggggccactcaagtcctccatggaaccgagactttatcaaggggagttagcgtccccttcccagtgctcatatccaatcattaaaataaac

SEQ ID NO: 721410 - DNA, 482 bp, Homo sapiens
  misc_feature (140)..(140): n is a, c, g, or t
cggcaacattcccccgatgcccaattcatggcagacattgtctggatccaggctgtacattgaataaaagattcgaaatgcgcagttagcccagtataacttccttttagttgttggtgaaaaagagaaaatcagtggcnctgttaatatccgcacaagagacaataaggtccccgggggacgccccctttttgaaactatcgagcgggtacagcagctcaaagagttccgcagccaacaggcagaagaagaattttaatgaaaaaattaccccgattggctccatggaaaaggaggaacagggtttccgtaaaattggctttggactctgaaaacgtccatttatattgaacttggaggggtttggcaaagtttgaataggtcaacctgcagggggaactatttttggcctagtcagtttttaaacaatgggcatttgaaggggttaattaaaagagagcccataaaatggtttttctcca

SEQ ID NO: 721411 - DNA, 394 bp, Homo sapiens
gtgaaacgttgatgcttgtaatgcagtgtcttttgaccgtgcatctgtgttcaacagttggaaccgtacttatggtatccctgtacgttaatatgcgtaccaggttatgaatgggacctattaccacatgtagtgcttggtaccagctttggcagagctctgtatatctgctccctgcactgtgaataagaacacattgcacatgatctgtaacaggtgacactgtgtaagacgcctggaggccatatttggactatgactgatacatgctgatgaactttcgattaagctgacactgtatgacggatggtcgtgtttggacaactgtgatataggtagtagtcctatatgaacagctcacgctttgttggacatcggctgcacgtggggttgg

SEQ ID NO: 721412 - DNA, 144 bp, Homo sapiens
  misc_feature (135)..(135): n is a, c, g, or t
  misc_feature (138)..(138): n is a, c, g, or t
tggggggggggcggggtccgtcgtacgcctacgtagcataaatttttctaaaaatcccccatataccccgggccccacccaaccgcacacttttttctgcggtttcttatccacgcatggctttctaccttacanctnccgcgc

SEQ ID NO: 721413 - DNA, 122 bp, Homo sapiens
gagcagtgcgccataggtgtggtgctccagcacaccctgtggctagctgctgccagtgaagagctgccagccctcgtgccagtgacagtggtgcctcctgcagctccctgccacagtgaaca

SEQ ID NO: 721414 - DNA, 310 bp, Homo sapiens
actagaacatacaaacctgttcttttcccacagatctgatgtccatacttgcggacacacagatgcaactgctttatctcattcaaatgccccaagttatttgctctcaagataataaggtcatttccattatgaaagagaagctgatgaacgactgactgcagcgacaaagaatgatccttgtatattagaaaaatctgttaagaggaattaaaaaaaaaatgctaagacttgtttaacaactagagctgtacaaatggagaataattttgtgggacggataccaaagtgttattttctaaacgtacta

SEQ ID NO: 721415 - DNA, 820 bp, Homo sapiens
gaccagaggttaggggtcctctctccctggttgtgcccgcgccagcccctcacagcttataatgcaaacccagcaactctcttgcccctcttcccatattttacatcttccattgtgacccatttttctttttaattaaaaagaaacccttaagagaaaaatcatgggctcttaggcgggccattctcacttgagaaaaaaatctctttaacaagtgccactgttcgtgcacagcggctaatcatagcttcaggtggcatggatactgacttctacctgacctcgccctccttacatcctgatctcttggaacgagtcacgcatgccccctcggcactggccacgttcaccaaggcgcgatgcgcacaataagcgccgcaaagctcccctgacccacggacgccaacaactgccacacgtcacgggcccctctcctggctcctggcctggcccagaggtcaaagggctaacccccggtctccaagcctccggcgcccccgctccctatacagcggccgcgcttcagcggacaacaaaacgctcaggctcgttcacactacctctctcacagcgcgccagcaaaccaactgtgtgccatcgtacttgcacactggcacttcccgcactcttggttaagcaacacggccccgtccggcctctcacactgcaccgctctccccggccagcgggtggctcctccgcccatccctggcaagccccggctggcttcccctttcccgggctctgtctcccacaattttcactttcctttcccacttcacctctgggctgtcgccctgggtctcggccgcggcaagcg

SEQ ID NO: 721416 - DNA, 155 bp, Homo sapiens
cgatacgacttttttttttagttctccttttcttctcctcctcctcccttcttcttcctcctccttcttccttttcttctttcttctctccttcttcctcttccttctcctcctttagttcttcctcctcttccttccccttctgtcgtcttctc

SEQ ID NO: 721417 - DNA, 370 bp, Homo sapiens
  misc_feature (350)..(350): n is a, c, g, or t
gatagtcgttcgtatctcccttgtgacacgtctttaagcacatgaaagtagacttcggaaaatgacaatttttattttaaaaattgaaatgtttggaacctttagcacagatttgcttaggtgaaggacacgtgtcttcgtagttctcgcctttttaaggtttttgtgccatgataggatattaaccatgatttttctgttatgtaccaaaaactaaagataaagtccacatagaagacagattctgactacacaattttggatataactaggaaaaatggcgtaataccacttttgattcgttagagtactatatccatattgttatcttgctggttcagctattttanactcactgtagggggaaggg

SEQ ID NO: 721418 - DNA, 86 bp, Homo sapiens
cttgtgttctgtgcattgtagaatattgaatgatttgtattcattggtaaatagctgctgtcctgacccttctgtcgtcttctcgc

SEQ ID NO: 721419 - DNA, 428 bp, Homo sapiens
ggaacagcaggcgcggaggagggggcaagcgtgtgtgagattcagtggtccatgcgtgcgttgtcgtgtctggtgatgggtgtgaatcagaacgagtagcactgttgatgtggctacggatataggactgacatcggaggtgtcatcagcaatgaaggatgtatgcacccgacggcccgatagcttctgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggc

SEQ ID NO: 721420 - DNA, 1595 bp, Homo sapiens
gtgatccggggctcccggaacctcgagctgagtagactgaagcgcaggctgcggggtgctggagtccgggcatgtgaaggccttgagtagttccattccgagcatggtccgagagggggcagtccctagacaagtaacattgagcagtatggttacagcagctcaacaggtcagaatccgtactatcattctagtctactcatagtgctcttgtacagtcaaggttagagtcaacccatactcctagttaggatccgtgcacgagccatatccgtgccagacgtggcatcttcacgccgacgcacgcgtaaaagaaagacaggaagagctgcacaggactgaggtccgtgtagacttctgtggatagaagctcgcctcagtggtcgtgcctgcatgtgctatgaacagtagcgctgcatgcatagcatgaggtgcacatgtcatacgggcaatactggtaatcacagcgtgtgagtacgggaccacggtgagcactgagcactggaggcgcattgggaaactagcaagcaaggcaaagtgtggtatgaagcggtggttagatgtgaaaattggacagaggctacctgagggtatggccgtccttcgcgagatgcggccaccacgtaaaggcgtcaaccgacattgtcgcttgccccatgtgaacgaggcaaataaaagggggatgtgcgggtgtcctttcgggtggctttcagggcattaacacgttcgttggcactatcccacagatgtggggccacgtcccacttccatatccaaacactagttctggtctataacacataggctatttataccaagcccagagcaacttaggttctgggggtgccgttggcagccaagtttttaacacccaggaaaaggaagaccccacatgggggtgcgctcaacggggggcgtctcgaatttgtacccggatagaatcccaatcgaaggtcacgaagttaagccacagatgggttccacggtcctggtggtgtcaagcccttctcgatggtacagtgcgccacacgctatgtgcgctgcgtataaggcaccatggaaactccgagcacgaacatccggcagataccctagcaagaagcgaaatacggacagctcggaaacagcctggcaaaagacgacgggcaggccagatgggggcacacaggaccgccttttgcggtgtgccgaaccaaccacaagagtcccgaatcagtgcaactggccccgcgatacagcgcacgatatcccgtttgtgcaagccgtccacgttgggttggaagcgccccgcgcgccacaatgttgcacatcccgcaaagtgggggaacaaccgcgatggagacgacgtgtggttggacacacacgcggaagtcccgtgttaagatcacccgacgcgggagccaacgcggggaaaccgtcccaggtccacacagcaacgtggggcgcgaccgagtcgggggcagtccccgcggacgaaagcgacaaatcgagacaacaagcagcatggggggaacaagcacctcggggctgcgcgcggggaccacggagcgagccggacaagcgacgggacttcaacagccgtgcgcggtagagcg

SEQ ID NO: 721421 - DNA, 118 bp, Homo sapiens
  misc_feature (95)..(95): n is a, c, g, or t
atcagagtcaacaacatgtacgtcacatgtcaaccgggaattgccagagttaacctgaccacaacacgattgctgtgactcaaactctccctaantgctgcctatataaccgcttttc

SEQ ID NO: 721422 - DNA, 639 bp, Homo sapiens
tacagtggttcacgcccgcaatcccagcacctggggaggccaaggaggtggatcgcttggaggtcgggtactcaagaccagcctggcaacacggtgaaaccatctccactaaaaatattaacaggcactcagtagtggcgtatgcctacaatcccagccacttgggaggctaaggcaggagaatcgcctgagcctggaggtggaagctgcagtgacctaagattgggccactgtactccagcctggtgacagagaccctcccaaaaaaaaaaaaagggggggggggccctggtgcccggttggggttcaatggcttttatccccaccattttgggaaacctctgaggggggtggcaacaagaggggctcaacgatgttcaataggacatatgctgtgtccaaatgtattgaaaccctgttgttttcctatttaaagaaattccagaggggattaaaccgggacatggttggcagggcccttgaatccccaagacactaggggagggtgaggggaacaatttggttgtacccgtgagaatgttgttgcgttgagcaaaagaccggcattgtttcaagtggggtacaaatgtgagattggttcacaaaaacacacacagtgggtggggtaactatgttgtc

SEQ ID NO: 721423 - DNA, 178 bp, Homo sapiens
agagaaggcagatggggacaggagccggctcagttcagcctggcttgagccttgcccttggctggaagggtcccccggcttgggtagtgtcctcgtctaagtacggagaagagcagttaagggccccagccttgcataagattgaaagattaattgattaaattgatatgggtaaaag

SEQ ID NO: 721424 - DNA, 1024 bp, Homo sapiens
  misc_feature (564)..(564): n is a, c, g, or t
gctgagtccaaagagggtgtattgccgctgacggctgcttccgagcgtgacccgaatttcattcgggcttcactcgcacgtccgggacggaccgtggctgacccgagctcgggcagacggcggcgtcggccagtcctctcggtagtgaggaccacggtaatttcttgagaaagcgctggtgaagggagggagcttgcaggagctgttgacgtgcccagtgtaggcgcctgcgatggaccctcgctgcatcccctttgagtccataactgtgcagtcgcagggcagactgagcagtcccggacctgcctggagggcagtccatcatgatagctggggccttgtgcggatggggtggtgtcgccaaggtctgtgagaggagctcaattgacggtacagtccatccgtaatgtctctggacagtaggacgatgagacagtgcgggagtgctcgacacgccagcggcttcggcatagttccttccaatggactaccagaaaaaggtcactggcgaacaccctggtcggtgtgcacgtggagtgcagaccagcagaaagccgcgtggtnctggagtgactagcgggccagcagagcgaggtcttacagtttaattgcagtggctgggttcccccccggtgggtagggtggctaagtgggagctggggctcaagtgtcttgtggcggggggcacttggggcctgtggatgagccttgtgcagcaatcgtgaccctcgggagcgcaacgccttttcagagtcgactggtatggtgagaggcacccgggtgtgcaacactcaattgaaggggccccaaaaggtgggatctacgggcggcctgagggtggctcatacggctttggaacccgtgagggttcccccaaggagcccattttgaacccctctcattgtggggcaccctcgatccgccgcaagttgccctaagagaacccatgaattgacggaatggcacaaagatgaatcagcattaaggggaaacgaatcaagcttcttcaaccggtgcttgggtt

SEQ ID NO: 721425 - DNA, 246 bp, Homo sapiens
cacatgtgatataaagttcacaagtgtggcaaaataacaattttgatttgcctgtgaactcagcgtactattatatcatggaggatttttatatcaatgtacacccaaaataatggcatatagttttgttgttgttatcatcactagacttcggtatcaagatgacacaggtttttatgttattaattaatatatattgagatggagtttcactcattacctaggctggagtgcaacactgtctca

SEQ ID NO: 721426 - DNA, 690 bp, Homo sapiens
gttgtaaccctagggcagtaaaattctttttcaaccctgggttcttttatgatagacaggaagatatgattatgtatgagtttctacagtttagacaatggggtggaggtgcgctcaaggtaatatgattagttggctacatgtatactcaagacaggcatcacagtctcaggtctcctaatccacgtcctgtctgtccccccactgtgctcctcaggccttgtggatccattgactgtgatctgtgtggttcagctcccacttcaggcagataggacagctcgtgggtgtgagatcccacactgcctccaacccttgcttcctagctggcctcacagggcacctcgagggtctggtccaggttgctgttgtgcacgtggcagcagtagggggctgtgtcttgcgggggcattgccaccaccacccaggactggtaagtgccatttccattgtgaagaacatctccccgtaactcaggctcgtgcacctcgccggcccgagtccagtgcacatcaattttccctgggtagaagtcgtaggccaggcacttcagtttcttcttttctcctggggcctggtggctggtgaccaccacagagggaggctcttgccggtccaggatatttttgctgtatctcaggtatttccgcagagtcgcagggctcgtgccgactcctgcagcccggggga

SEQ ID NO: 721427 - DNA, 951 bp, Homo sapiens
  misc_feature (1)..(1): n is a, c, g, or t
  misc_feature (4)..(5): n is a, c, g, or t
ntannacatgatgacagcaaaactcaacacaggaaagatgacgcatgtcatcaccggaccgtatactgtcaccgcgctgttggccgccttgtaatatattctccccaatttcttccttccgccctcccaattttgaccccggtcagcgtgccccctatgacaacaagtgggcaactctgaaaattactccacacgggtcctaattcacgaacccttccgggctcacaataagcaacacgtgttggcttaacacgcgtcccggaacatgccccacctccatgtaagcctgggggaggccaaccttctattccccctgcgggtaggccgccttcccactacgccccggttgttcccgccccccccatcactccccgggatctggtcaataggacaccgagttagaatggttgctccaccgccgtatgacattacccgccgggtcgccacctgttagttgcgacagcggcacctcacaaggtggtgcacccccggttcacctctcatttctccaggtggggcacaacacactttcgatgcttttcagggacgcgccaatgaaccccgagctgaccgaccccactgtcctcggggggtcccgctatcgataccccgcgcggcaagttgtgaacccctcaccccgggcaagaatccccgaccaacagtgcttcttcttgtctcatcctggagggacggcacacaggagtattcgccaccggggatgatcatggacggccccgtgggctcacagagggaagactccccagaaagtgttacccagggcaaaaggcacaccccccacaaggagacagcccgtggggtcacacacacaaggccacacaacgatcgggtcaggcatcagcgaaacccggatcagccgccccacagtaaacccccggtgcgccccctccgaatttgatacccaaagaaggaggcctccccgccaacataaaa

SEQ ID NO: 721428 - DNA, 243 bp, Homo sapiens
aacactgttcagttcctcacagccaacagtgtatgtcttgagtgaacgcccctgcgctgagctaggctcaggctgttccagggagccacgagactgcaggtagtgatatgcaagagtccatcctgcagtttaccagcaatgataaactcctcgctgtggttgtgggacctgtggaagtttctgcttacacaatccatggcgggcgtgtagaccaaccgtatgtcagcggcaaccccgagctgg

SEQ ID NO: 721429 - DNA, 199 bp, Homo sapiens
gcgtgatagtgcacacctgtagtcccagccactagggaggctgagatgagaaaatcgcctgagcctaaggaggtcaaggctgcagtgagccatgactgcactccagcctgggtgacagagggagaccctatctcaaaaaaataaaaaataaagaaaaatttaaaataaaataaaaatgaatcagcaagcagaattcaat

SEQ ID NO: 721430 - DNA, 327 bp, Homo sapiens
cggtagtgtcagctacggtgctcacgtactcgacggaacttgtacagagcaggcatagcaccgcagtggtgaatacacgtcgaccaggctaccatctataacgatatataggaggtcagcacggtgctcacgtatcgacggaactatgtccagggaggcatgcaccgcagtggtgaataacacgtacgacctgcaggcatagcctagcatagctcgggtacctaggaggatcctcaagagtacgaccaggctccagcttaacgatatttggagggtcagcacggtgctcacgtatcgacggaactagtaccgggaggctagcaccgg

SEQ ID NO: 721431 - DNA, 168 bp, Homo sapiens
ctagaggatccccgcatcggctcccatcagagaaatgcaaatataaccacaatgagatatcatctcacaccagttagaatggcaatcattaaaaagtcaggaaacgacaggtactggagatgatgtggaaaaataggaacacttttacaatgatgggagaagactgcg

SEQ ID NO: 721432 - DNA, 419 bp, Homo sapiens
taagaggatcccctctctgcccacgttgaacatatctggctccctagggctagcccattttctgttggcacacccgccagcatttcccccgtccgagcttccaggtttgtcttatctatctctgcagctcgattgttcatgcgctgctctttgtcacaaatgaaattatttgggggctgcttttcattcaaagggcaatttcgccaaggactctgttgcccttattatctgcctcaataattactttcaacttcctgtatcagcaggagcagggcagagtcatggaatctgctttgtcacggccacagcctctccctgctgttctgtggctatcaggctctggggtttggcttttgggtccatcgaatcacactctgtgctgagcatctccggagcatcgagagccactatggcttgaa

SEQ ID NO: 721433 - DNA, 376 bp, Homo sapiens
tttttttgtgaataagtggattaaacttcaaagatttgctaaaatggcttgaaaacaataagctggccgggcgtggtgactcatgcctgtaatcccagcaccctgggaggccaaggtgggcggatcacctgagttcagcagttggagaccagcctggccgacacggtgaaaggctgactctactaaaaatacaaaaagtagtcagatgtgctgttgggcacctgtaatcccagctactcaggaggctgaggcaggagaatcacttgaacgggggaggcggaggttgcggtgagctgagatcccaccactacactccagcctgggcaacagagtgggactctgtttcaaaaacaaaacaaaacaaaacacaaaaacg

SEQ ID NO: 721434 - DNA, 349 bp, Homo sapiens
cgcagtggctctcgcctgtaattccagcactttcggagaccgaggcgggtggattacctgaggacaggagttcaagaccagtctggccaacatggtgaaaccctgtctctactaaaaattaaaaaaaaaaaaaaagtagccaggcatggtggcatgtgcttgtagtcccagctacgtgggcggctgaggcagaattgcttgaatctggagatggaggttgcagtgagccgagatcgcaccactgcactccagcctgggtgacagagtgagactctctctcactctgcttaatatgcaacctttggcacagactcagactcagtcactctcagcttcatgtccttctcct

SEQ ID NO: 721435 - DNA, 138 bp, Homo sapiens
ggtgatctagaggatcccttatattcatgtcttgggaaacatgttctgtggtgttggaaaaaaatctcttttaccagcttgcactcggaccaacttggaaaaaaaaaagcttaaattgtggtggcagggtgcttccgg

SEQ ID NO: 721436 - DNA, 497 bp, Homo sapiens
gcgagtgtgtcatggatgctagcgtgatggtctgtgtcatccaacgtcatgcgagagaaccgccttagggctggaggtgagacatgctggcggcaatactgctctttaaggcattgaggtgtttacatatgtgcacatcaaaagcacagcacctttttctttaccttgtttatgatgcagagacattggttcacatgtttggctgctgaccctctctccactattaccctgtggtcctgccacatccccctctccgagatggtagaggtaatgatcaataaatactgagggaactcggagaccagtgctggcacgggtcctccgtatgctgagcgctggtcccctgggcccacttttctttctctgtactttgtctctgtgtctcttggttttctcaagtctcttgttccacctgacgagaaacagccacaggtgtggaggggcaggccaccccttcatctggcgcccaacctggggctaagggatctatgctatct

SEQ ID NO: 721437 - DNA, 313 bp, Homo sapiens
aactgcttgtgactcttgctatatccccagcatctagcacagtaaatgtttactaaataacagtagttgtattaacactggcttgtatgtattgaacacttactcttttttttttttcaagacagggtctcactctgtctgtctaggctggagtgcagtagcacaatcttggctcactgcaacctcctcctcccaagcaattctctctcttttttttttttttcagacagagtctcactcttgcccaggctgcagtgagccaagattgcgccattcccatccagcctgggcaacagagtgagactccatccca

SEQ ID NO: 721438 - DNA, 546 bp, Homo sapiens
gtaaatcatctttccaattccagaggaacaagcttgtctctctggccaggaatccatctaaacgggagttgatgtaagcagacccagctaagagtcctccttccttcctaaagcccttggctctggaggaagtcctccagcttcagttcaactcacagcttctccaagcatcacccggggaagtcccggagggtttcctcataaattgagggcggcacattggccggtccggcttcgaagttatcattaccgttcagtatttaaatgaggtgatcctaagaatgggttggggatcaataggaaagcatatgcagccaaccaagagtgcaatggtttggaatggatatgaccaaaattttaagtatggaaagtcacccaaacacttcggctttcacttaggtgtcgggcccgcattacggtaggaccaggcatgatctggtgacggtgatattttaaatatccacagtactcacttttcccaatggatcctagtaatggcctagaaatatcttcctctaaccggtaatccatcattttttcccagta

SEQ ID NO: 721439 - DNA, 243 bp, Homo sapiens
tcttagttatggctccatggaggtgctttgtaacataaggtggtaagttctccacactcaaatcatatgttcagacaatatttcatgtcataacattttttttcaatgaaaataatttgatcagtcctggaattccattgacatccaggattatacattttaatgcaccgggacacgttgcaaaccaccacagacactcacacatactcttaagtagcgtgtacttcttcccgtggtgtttgg

SEQ ID NO: 721440 - DNA, 808 bp, Homo sapiens
  misc_feature (8)..(8): n is a, c, g, or t
  misc_feature (125)..(125): n is a, c, g, or t
  misc_feature (416)..(416): n is a, c, g, or t
  misc_feature (450)..(450): n is a, c, g, or t
  misc_feature (491)..(491): n is a, c, g, or t
  misc_feature (541)..(541): n is a, c, g, or t
  misc_feature (564)..(564): n is a, c, g, or t
  misc_feature (593)..(593): n is a, c, g, or t
  misc_feature (622)..(622): n is a, c, g, or t
  misc_feature (681)..(681): n is a, c, g, or t
  misc_feature (701)..(701): n is a, c, g, or t
  misc_feature (713)..(713): n is a, c, g, or t
  misc_feature (736)..(736): n is a, c, g, or t
  misc_feature (746)..(746): n is a, c, g, or t
  misc_feature (749)..(749): n is a, c, g, or t
  misc_feature (763)..(763): n is a, c, g, or t
  misc_feature (791)..(792): n is a, c, g, or t
gctgcagncgtccacgggggtctgagcagtactccgacgtacagcataccggcaccaacccccccaaataccccagcaagcaggtaggccagccctttcagctcagcacaccccagcccctaccncacccctaccacggagccatctggaccgaggtgtgggagtgatggagcaggtttactgtgcctgcccggtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactggggcttatgggttgggggtggtaggcaggtgagcgtaagtggggnagggaaatgggtaaagaagtctacttcaaacctnaggtctttattgtcagaccaagaccttaggtgctttctttnaggagggaaacaagggaagaccttggggtccttgtggataacttgagttngggagtttttccaaggggaaggnaactttcccatttgtgccttcttgtgtgnattgtcaattaaccttttccttaacaatnaggtttttgggcttgggcccaaattcccttaaccttacaataaagtttttaatttttgnaaaaaaaaaaaaaaaatttnggggggcccgtnccaatttgcctattgttggtggnttaaattaanttnccctggttttaaanggggtacttggaaaccctgggttcccanntaattgggtttaagga

SEQ ID NO: 721441 - DNA, 148 bp, Homo sapiens
ggcttggctggctgagctgtactaagttggcctggctgggctgagctgtactgagctggctgggctggttgactgggctgagctggactaagctgggctgacctgggctgggatgggatgggctaggatgacttgggctggactgggc

SEQ ID NO: 721442 - DNA, 270 bp, Homo sapiens
cggagcgcagtcccgagatgataatgaagatattcaatgatggaccagccatccaaaggggccgattggcttaggagatagtcttagggatgttgaacttcaaggcaagatcttggtttagttacttccagcagaaacttgatagagtacaaatggcccctgatgaacaggggattctttttcttcaaggccaagtcagttatattttgggtgccttccttaaaggaattcccagtttggcgacgggggtttctacaaggggaccttact

SEQ ID NO: 721443 - DNA, 857 bp, Homo sapiens
acaacggctcacattgcatgcgagtttcgctgagctgagggaaaagatggatcgccgttctggtaaaaagctggaagatggccctacatgtcttgagagtctggtgatgctgccattgtagatatgagtgcctggctagagtccctactgtgtgtcgagagctgtctcagaactatccaccatttggggtcgctatagctgattcgtgagtactgacgacgaggacaggttgcggaggagtgtcactcaaagcagatggcacaagcaaggcatgactggcacgtctggcaaggttccgaccaaggtctgcacctagacaagactcagcaaggctacaagtagaatacttatcgcctaatagcctgctcaccccactcttaatcagtggtggaagaacggtctcagaactgtcagtctcaattcggccaatctaacgctctaggatagcaataagaccggttctaactgactagacaactgcatcgctaaacaccttcatggacacggcaaaggacgaatgtgcccgtcggtacccactctccggtgtcacctggtttcccgcgatgatggcagacctcacacgcttactcagcctgcgtaagcaccttcatgtcactttagccaaagtggcacatagcaacctttggacccataaatactttggtcaccagcgcttcacgaagacccaatacaaccacaaggcccacaactagacgaggacaagccaccacacccacggcgcgcccccacaactggaaaccaacccgacaggacaacggcccgacaacaatgccgcctcccaccgagccaacccgggaccccgacccggcccccaaaacgaacgcccgcaaagcaaa

SEQ ID NO: 721444 - DNA, 991 bp, Homo sapiens
ggtcgaccgtgacgtatagggcgtcgagaacacgggtgttggtgacgcattacgctatcatcgatagtgggaaagtgaaagattcaatagtcagggatgtcgtcattggggacgtaaattgcgggtatgaccagcgagtatatggtgcatctgagtcaatagtaactggggtggtagtctcagctcattagaagccatgtgtatacgagagtttgagcaaggtgatggactgatgaagtatgagagagatggtgtcgtgatagggtatgaacttgtgggtcctaggggttaaataagagagaggggttgatgcagatggaagggtgagtattcaccgatggtgattgatcttaactttgttggagaatcgaggatgcaatgtgggatgtagtgtgagtgctgaattgagtgcaagtgggagtgcgtcgtaggtagggacgaagagacttgtattgtggacataggaatgaggatttttgacaggggggaggactctttcgaggtcttggaacattgggtggcgtgctggcgtgaattgattgggctgggctggtgttggtgggggaacgaagagtttgtagaaaggacattgggggaataggtcccctggagcaattcggggggaaagaaaccggtgtaggagaccactgggccgcccttttcagtgggggagttatattcacccaacggtgaggagtttgtgcaaagcgaaaaggcggtcaactctggtggaccgggttgttgtgacacccattgggcgttcgtaaatttacctaaaccgttggatggttcggagacccccaattatgtagaggactcggtgagggggacgaaattctttggatggcggaaaccacttcggtttgcagcgggacacccgattcgagtgagcatttacccagtttccaggcattccaggtgtgggctttgcgcctttactccggacccacagagataaaccattgtactggagggcagaggttcccttggg

SEQ ID NO: 721445 - DNA, 106 bp, Homo sapiens
cggtcttttctttacttttttctggcttacccgactgacgcggtcctacggacgccgggccgacgcctcgggtccccggcccgtcgctttcccctacggggtcccg

SEQ ID NO: 721446 - DNA, 525 bp, Homo sapiens
cacgacggacacttctcttttcattgtgacggtgccactaaatggatgcagtgtccagctgctcgcgtgtctattttattctgtatgatcactacatactgctctcctcttggggaccattctactatgtgagcattcggtttgatattttttatgaatgctgatcttccttctacacagcattccaacgttctgcaaaaacaggaagctccacttacggtgtgatcaccacactaacttttactcaagcgtcaacagcaacacgcatacatgaagcattaagtgcacattttcactcaacatattggctcattcgcagcactgctatcttccttacagccctatttggcacacatcattatgaggccaggcattaagactcgcttgattcccatcatccctttaacatctcgtatccatagtattttcacaaggttccctttctaaaatcttcaattcacagctatgatgactgcagcataattgcatgtttgacaacggagcttgttggctggcgcgtgacag

SEQ ID NO: 721447 - DNA, 884 bp, Homo sapiens
ggccgctcgaccggggaaaattcctaaggcctttccacaggcgccccgggcccgaagtctggcaggcccctgtcgagcttcccgtgctctaagccgggagacttcccccccaaggaatgaaaataatattggactagggatcgcggaccaccggaggcccatggagaatgtaaggatacaggattggcccaatccattgggggtgtcaaaaattcaaccgcaggcagctggaggatgatccctccaccacccaggactccagtacaagccgtcggcacaccaggtagaatgtcaccgtatttcaaccggagtaaattgctagatttctgccagtcgaaagatattgttctggttgcctatagtgctctgggatctccacgagaccaacgatgggtggacccgaactccccggtgctcttggaggaccccggtcctttgtgccttggccaaaaagcaccagcgaacccccagccctgattgccctgcgctacccagctgcagcgtggggttgtggtcctggcccagagctcaccatgagccagcgcatccagaccagaacgtgccaggtttttgagttcccagttgactgccgaggaccatgaaagccctagatggcctagaccagaaatctcccactattttacccagtgatagttttgctagcccaccctaattatcccatattcaagatgaatattaacctggagagctttgcctgatagtctacccgaagccctgtgtgtggatggtgacccagaggacgtctctatgccggtgactggacatatcacctctacttaaatccgtcctgtttagcgacttcagtcaactaccgctgagtccctaggcccagaaagaccataaatttttatccttttgaaata

SEQ ID NO: 721448 - DNA, 973 bp, Homo sapiens
  misc_feature (1)..(1): n is a, c, g, or t
  misc_feature (10)..(11): n is a, c, g, or t
  misc_feature (14)..(15): n is a, c, g, or t
  misc_feature (21)..(21): n is a, c, g, or t
  misc_feature (448)..(448): n is a, c, g, or t
  misc_feature (571)..(571): n is a, c, g, or t
  misc_feature (591)..(591): n is a, c, g, or t
  misc_feature (616)..(616): n is a, c, g, or t
  misc_feature (961)..(961): n is a, c, g, or t
naaggggggnnaannaaaggngaggaggggaaaagggagagaaaaaagaaattatattagcataaagcctaaattataagaatctgggaaggcagacaataaatgtgaccctgtgaaaaaatatattatgagaataaatataggatgacattaactgacttctgaggaaataacacgttgactgtgatgatctgagatgtacattttgtggatgagcttgcaatagatggataaaagtgataccatacatatagattaagagtagtgatgaggaaaaaagtgaaataataaataaggacccataggtagacgcgttgacagccccgtggtcccgcacacaagtctatagatagtgccagtatccagagaagaatatctactcccagtcaccacccgagtgccacgtctcacgttcttctatagttccccgtccccctgagaacgcccntgctccctccgcccatccaccacagccacactcagatcccctagcctccccgatcccacacatacgccacgtatcacactcccacccactccacctagaccccgcagatcacccaccaccccnccccagactcataatatttncacatacacagcatgccacacgacncgccctccaccacctacctctcctcctcctccgtcgcgtccatgacacagcccgcccgacgtcgctaccaacgagtcccacacatcttcagccaacacgtgcctagtgcacgtccccgaatatcaaccctacaggacccctctcgcatcccggccacttctcaacacgccacattcccaacctgcccgcgatccctcgcagattcccacctatcccattccgacagctctcccgcgcaccgcagcccatcattcccgaccacgcccgaccgaacagaaaccgagtcacgcgcacatgccatcgcccactacgacccgctattcccccacagctcctaccccgtcnccccacaatccg

SEQ ID NO: 721449 - DNA, 119 bp, Homo sapiens
ccggtctcactgtagcgtcgacctactgggcattgatcctcccaccgcagcctcccgagtagttgggactacaggcttacaccatcatgcccaactatttttgtatttttagcagtatt

SEQ ID NO: 721450 - DNA, 578 bp, Homo sapiens
  misc_feature (519)..(519): n is a, c, g, or t
ccttgtgaatgtggagccagtgagaaaagtgatcgtggcaggaggccatgctgggtcttctctttcataaggatttgggtctaagaataattaggtaaccactaatgttagatggtgtaacatttgcattttggaataaagtagaagagttcaggtgatagtgatagcctgaaccgggatcctgggaatgaaggtgaagagaagcagatggattcaagaacaatgcagaaggtaaaattagccccagatggtagcagggaaggagagacggaacatagtgatttagagaggttggtaagacgcaaaggtttttcttcaggtggagaacacttgagttcattcataggcaaagagaaagagcaatggagagagacgactcaaagaaataagagcaagtggggaaaatgtacgtcttggaatcagaaacactgatcctctgagaagaaagggctgatggctatgtaggtacatttataggtgggaatgagggaatttgagatttgaagccttgatccacanaatggggctcagatatgttcttggagtgaggccatggtctcctaagtaatggggtagca

SEQ ID NO: 721451 - DNA, 107 bp, Homo sapiens
gacattacttaaaagttgcaagatgtgggttctgatcttagttcttatggcctgtcagccagggaactcctggccagcagtctcatccttgaacttcttcttttttt

SEQ ID NO: 721452 - DNA, 732 bp, Homo sapiens
  misc_feature (169)..(169): n is a, c, g, or t
gcccaaggcatttccatgcgtgaaagttcactctaaaataggcctttgaaggctcaacaacttgcttaaatgctgccaatgcatacacgttccaactgctatcgcatttgataaattcataattagtaagatacttgttcattgcttatctcttctctaggcatgtcanctcgacgacgggcaaagatctctgatactttggtatgctaatgtctacgccctaggagtgtgcctgtcttttagtagctattaaatgagtgtaatattgcatagaagaactctacgcattgcggtatgagagttgagtctgtacagagatccataacttctgcagtgttctcagccattgatgcacgttgtttcatgttcagattgaatgaagcaattagtattgatgcagttgcagccgtgtgtacacatagtcaaattttctaggcatgtcatgtttctaaggtgccttggaattgcagctgagattaacaggtaatagagagtaaggataaagacagtatcaaagaaagacagagtcagcttcagagtagaatactagtatatagcccagactaatacaatgtgtcatacttacatattcaatatgaataacgtatctttaaacatcaattctgtaagattgaatatcgagaagagagcatgaaaggaataagcactgaagaatgagagctatgaaaaagttaaaaactcaataacgaacgtacagagattcagtatcat

SEQ ID NO: 721453 - DNA, 1417 bp, Homo sapiens
  misc_feature (717)..(717): n is a, c, g, or t
ttcgccgtgtctttccgtgtccgttgtggtcgagtgtagacgttgtccaacacacgttggcgcgtgcgcgttgcccgtatttcttgccaccacgctgccgtgtttttttcagcgttgtcgctgcgctctccccgggcctttgcgccgtgccccgggttccgggagtgttgccctgggcccccgccttttgcgaggaccgcttgtgttgtttcccccggcggcacccgacaacgggggtttctgggacctttccaacccggccccttagtgtgctctgccgcccaagaaggatgcccagcttttagaaaaggggcctgccctctagcacccgctgtcccccacgggaagggccccaaactgctttggaaaagggaacacattgggggtttaagggaagggaattacccctgagacccgtgtcgccccctgtgcgcctccaaagtttgtcttcgcaatctttgggttaaaatagggaagggttgtgaataagttaattacacatggggattctctcctcccgccgacgggatttatcttgggggaggaggcgtcgtaaaggtaagaagagttgaatggtgtgtgttaaaaaaggggcccaaagtatgtctctttatcgcgctcctgaggcgcttgtatattattaagagaaaagttttatatatgggagagcgcccccgggggagcaccttgggtttgggccctttaaatcgccactgntagatatccccccccgcacaccttgttgagagaggggccttgagaggtgttctcctcggtgttagagagatttaagcacaccagcattgtggcccgccccccagctttatataggcgccaccatagcgcctccgctcttggcagcgcttttagaagaggccaatacccaggggacacgctggttttctctttacgctgtattggaaaacatctctctatagggacccagaatttgcaccccacggagaaagccttctcccagatagaatatctctccactttatggaaagacaccctgggcgctttagacaccacgatttggcgacaccacagatgggagaatttatccatgccccactgggaagaaccggaatattggggtttgtaaatatcctcggataataagatagctgttaaaagatttaatagtgtgcccaccaagagaaatatggtgaggattcaccattgccagatataagaaaggatagtatatatggaataaaagttatccagaccccttggctttgctgagagaggactccagatgatagtgaccgaatgtctgcgccagtgaggacacaccattttggccattctttgctgacatctgaccagagtgattcttgatggacatctgtatttaaattgtatgtgttttactctttgaaaataaatctataaaacccaccttttcccccca

SEQ ID NO: 721454 - DNA, 822 bp, Homo sapiens
  misc_feature (21)..(21): n is a, c, g, or t
  misc_feature (43)..(43): n is a, c, g, or t
  misc_feature (85)..(85): n is a, c, g, or t
  misc_feature (486)..(486): n is a, c, g, or t
  misc_feature (537)..(537): n is a, c, g, or t
  misc_feature (579)..(579): n is a, c, g, or t
  misc_feature (596)..(596): n is a, c, g, or t
  misc_feature (815)..(815): n is a, c, g, or t
cagaacattctgctgctcttnaagaccctcatccctcccgtgngagccccctttggacactctatgaccctggacctcggggganctgaacttgatgcgatgggaggctgtgcaggctcgcggcggcgcttttcggattccgagggggaggagaccgtcccggagccccggctccctctgttggaccatcagggcgcgcattggaagaacagcggtgggcttctggctgctgggccctttgcaaccaacttctcttatgtggtgatgctgagtgcccgcccacgacatccttagcccacaagaggacatcgggaaaccagagccatgtggacccaggcccaacgccgatccccccacaacagctcatcacgatttgacctgcaacctcctgtctcctacggctgctgtgctccctggcggacatccctcccccacactcgtcatcaaattgttggcctccctccttggcccttccaccctgcctgnccctacagccccccgggttcctccgtccagtggcgattttgtgcctgctgngaagcttccgtccctggcttgcctttttctcatttctgtggnggaccagcctgctgtgngtgtgggtcttcgctagcatcctcatcaggccttgtgggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccngctattt

SEQ ID NO: 721455 - DNA, 180 bp, Homo sapiens
  misc_feature (9)..(9): n is a, c, g, or t
  misc_feature (68)..(68): n is a, c, g, or t
  misc_feature (98)..(98): n is a, c, g, or t
  misc_feature (102)..(102): n is a, c, g, or t
  misc_feature (108)..(108): n is a, c, g, or t
tcttcccancagacctcttgaaaacacttcggtactcagctgcagctgtcaacactctgctgacaggnttcggtttcttcgtggtgatatataacatnccantgcgtnttcagggcgtcaatggacaaagtcctgtccaagcgggaattgccctgctgccattgctgggctcctcagcac

SEQ ID NO: 721456 - DNA, 143 bp, Homo sapiens
  misc_feature (39)..(39): n is a, c, g, or t
gcgtggttggcatgtgactgtggtcccagccccttgganggctgaagttggaggtttgcttgagcacagcaggtggaggctgcagtgagccgtaaccgcacatctgcactccagcctgggtgaccaagcaaaaccctgtctca

SEQ ID NO: 721457 - DNA, 130 bp, Homo sapiens
  misc_feature (92)..(92): n is a, c, g, or t
  misc_feature (118)..(118): n is a, c, g, or t
gtccggttgtgatcccagcctcacaccacccacaactggcactccaaatttgcaacagttctttccccaggccactcgccaggtccttgctngggacccctcctcctgttggggtccnccatgaaccgct

SEQ ID NO: 721458 - DNA, 549 bp, Homo sapiens
tgctgtcgtagatcagtagatcttataacaggtgccattgttattttttaaaagtgatcttcaacagtttgtttgacaggtcatgctgtcattgtagctccagggcctgcagtggtactcaataaatatttattgaatgaggcagggcgtggtggctcatgcctgtaatccctgcacttttcgaggctgcatgtaatccctgcacgtttgggaggccaaggcatgtggatcacttgagttcaggagtttgagaccagcctgggcaacatgatgaaaccctgtctctaccagaaaaattagctgggcatgtgacttatgcttgtggtcccactacttgggacgtggaggtgggaggattgcttgaacataggtggtggaggttgcagtgagccaagatcgtgccggtcactctaacctgggtgatagaatgagctctgtccccaaaaaaaaaaaagtattggctagcatggtgctcacactgtaagccaacacttggaagctaggtggcggttccttgagtcagagtcagacagctgacacatgagatcc

SEQ ID NO: 721459 - DNA, 406 bp, Homo sapiens
agctactctccttccagtccacaaacgaccaagccttctctgcctcaacatggccaacaagggtccatcctacggcatgagcgagaagtgcagtccaaaattgagaagaagtatgacgaggagctggaggagcgactagtggagtggattgtagtgcagtgtggccctgatgtaggccgcccagatcgtggcgcctgggcttccaggtgtggctgaagaatggtgtgattctgagcaaattggtgaacagcctgtatcctgagggatcgaagccagtgaaggtgcctgagaacccaccctccatggtctttaagcagatggaacaggtggctcaattcttgaaggcagctgaagattatggagtcatcaagactgacatgttccagactgttgacctctatgaagg

SEQ ID NO: 721460 - DNA, 1105 bp, Homo sapiens
  misc_feature (919)..(919): n is a, c, g, or t
tctctgatccatgttcaactcccgttcgttaagttccctgttctttgacgtgatggtctcaaatatatgctgatatggtataataccgctgcccactacaacctctacccctgagaatacctctttgcgataccaccctatccttcgatgctggtcccgttatggtgcgttcatactatacaacgactctcatgcgtcttgcaacggatcataccttaatgactcaggcacttgcctatgcctctctctttcaacgttgcccacgatcgtaccggccgttcgtcgattctgatcaccctgaacgttttcacacaggtgcctcacacttctctgtgctctgcccacggatgtataatatcctctgttactctatctgtgcataacgtttttctcatctatagcaacggacagtcatcaagtccccatacattcctctatctcttcataagatcttgcattactactagatcgcctataagtatgttagttagagtagacctcactgagcaacgtctacgttaatctacgtacttgtcccgccagctatttatgtctatcgcggagaacatctctgtggctagttacacacgtgtctgcctgtatgctaaattcgatgcgacgcgattgcaggaggtccgtcatctgaagtcttagccctatgatgtgctctgaatttttccacacgtctatggggtgacgtcttcgcttctgtaacaaccataaaatcgatcttccagttttgacgtaaatatggccttattgtcctaatcctcattacacgcattgtgtctcgggatacgtacaagccagtattccttgcccggggttgccgcccatcaaaggcattcttagacacgcggtcaattctcgtagcgcagtgcgtcgccgagagacattcacgggtttcttggcggtcgtngcacctggtggtgcacaacgcgattggacgcacgtgaatcttctaggaaattaggcgagtcgccagaacagcggcgagcagaagataatccgatgcgagaggcagcagacacagccaagtagatctctcggccgggaggacacatcaagccggatacaccaaaggaaggcaacgacatatcgcata

SEQ ID NO: 721461 - DNA, 269 bp, Homo sapiens
gcccatggctgagaactcccactagatgctactggctcaaagcaagtcaatcatgatcagcccagagtcgaaagtgtagggcaaatatgactcttgcctcttgatatggaagatgcttcaaaactattttgcgcaaccataccacaggaaagccacggtagttttaacagaccactaacgaataaaaataagatctgagaagctttggcagcaaggaatgaaggttgaggtcttcagtgataccagaaatgtatcataaggtcattgga

SEQ ID NO: 721462 - DNA, 204 bp, Homo sapiens
cggctgtttttcccagttgttaggctcttccacgacgtgagcggctgtgtgcatgagccgggcgtgtccccggtgcgcagcgtgagctagaacttcagtctggcaggagttgcccacgagtgctgtcgttgcgggttgagcgttgcgggctgctgacgactgccgggggacgtaagatatccccatcatccgatttatccaatg

SEQ ID NO: 721463 - DNA, 512 bp, Homo sapiens
  misc_feature (40)..(40): n is a, c, g, or t
  misc_feature (141)..(141): n is a, c, g, or t
gccaccatgacccagaatctagagacattaattctacacngttgtatgctaataaatgagtgatttcatatagggaaacaggatacaaatgaatatatatacatgggtataaatctctgtagctagtgtagtcatactagngaatgtttatggatcccacttgtatatgaaaatatggttagaatattaattggataatgtatatataagaagttaaaatatgtaaaatataacttcaaccaaatttttagaacactgtttaacatttttacaaaaccttcatgtaggaaaagagaactctctacataaagatgaattgaattatattacaaaatttattttaaaagcaatgactgatacacacgaaaaaacacaaaagaactccagattactggtaaatcattctgaatacataaacactttttcaagatatctattttaatgcataaactaattgttaactaatcatagaacagcaaacgcctgtttaataaaaaactttgaacaagaca

SEQ ID NO: 721464 - DNA, 279 bp, Homo sapiens
aggaattgtactgcacttgggtgggcaagctgtaatattatttctttgtaaattctgcagatttaaagtaccacattaccacactctgtaatcagacccattgaattaataaggactggggattcattagtgtgacttactgatgccaaagtactatgttttaagatgtcctacatggaaaacgctattccaggagctttaaatgtccatggatgcatataggatgttggagaccatcatacgtgaagaaaaaatcacttaaatcattgtgttcaacag

SEQ ID NO: 721465 - DNA, 492 bp, Homo sapiens
actagtccacggttggctagtgtttgttcacagcagttaacaataattaatggcatatttcaaaatagttataaaaacaattgtagttaacaataattaattgcttgtttcaaaatagctagaagatttggaatgcccccaacacaaataaatgataaatgtttgagatgatggctatcccaattaccctgatttaatcattacacattgtattcatgtatcaaaacaccacatgtagtcccagcaatttgggaggccaaggtggatggatcacgaggtcaggagttccagacgagcctagctgatatggtgaaaccccgtctctactaaaaaaatgcaaaaattagctgggcgtggtagcacatgcctgtaatcccagctactcaggaggttgaggcaggagaattgctggaacccgggagtcagaagttgcagtgagctgagatagcaccactgcactccagcctgcgtcacagagtgagattccatctc

SEQ ID NO: 721466 - DNA, 160 bp, Homo sapiens
  misc_feature (34)..(34): n is a, c, g, or t
ctgatttttttttaaaaaaaaaaggggctgtttncccttcttcccctgggctgttataaagttggatttgaaagggaatgttgtttttattaatcttttgtcttaaaaaaatttaaagggctttggatttttaaacctttaaccaatcctttaataacca

SEQ ID NO: 721467 - DNA, 168 bp, Homo sapiens
acgtatacacatatgtagccataaaatgcgtccagaaatttgactcatacttgtactgtactcttcgcatggactgggcaagttcttttaaatcattaaatattaagacgaccatctcttctattcacattacatgtacatgtacagagccacatacagggtaccgca

SEQ ID NO: 721468 - DNA, 311 bp, Homo sapiens
ttcggggttggtttttttggtttggttttttttcttttgtaaaggcaatgagctagtcccagaaaggatccttcagttacaaccaatttgtttaatgaaatgtcagggctcggttcaaatttttgtcttgttcttccaattgggaaaaacaactttcaaaccctcttgtatttggaaggctggaagggcccaaactttggaaaagggtcttggtttcccggtttttgttttgatttttttttggttttgattttttttaaactaaagcaaaataaagcttggggattaaccagaataaatttttaaattta

SEQ ID NO: 721469 - DNA, 302 bp, Homo sapiens
gtgccaatctactagagcatgcacattgttcgatttgctcaggctgttgaacgagaataccccttcagtcatacgtgacatggatgagtggttccaggactttcccgccgatgccgcatggaacgtttactccgattactgcgttggcaaccccgataaggcgaacgatagtttttctttcgtcattacgttgaatcatgacaccgacgagaatttcagcgagtacgtttcgagtgtcgctccgaaggatctcaaaaatactcggcaagcctctgagggcctgatttcctacctcaactcgc

SEQ ID NO: 721470 - DNA, 417 bp, Homo sapiens
agctgagaagctggagtggggccctccaggaagtggtgcccttctgaaagattgggcaggcaggtcaactgcaggccacagcagcagcaatcagctggagccccccagcctaggggcagtcccaccatgggttccccccctggtacccatggcccctcacctgttccccaaacaacaaactcctccctaactgatgccaggggcagttgccaggcagcggacacccaggcgtgacgggtaatgctccttggggttggcctttgggcatgccgcctcctcctcttcctcctgctccatccatacatcccaattgggaagtctagctgactccatcagtattaaccctccccgttcatcctaccttgcatggccatcacccaccatttcccgtcggcccggggaactctccccccacct

SEQ ID NO: 721471 - DNA, 582 bp, Homo sapiens
tgaggacccctcaaagttgtgcaatccatagtctgacacacctgattaggcatgcatgtcacgtctctgactctgtacatggaatagtaggaaacgttgtcataaataacaacgtgtgctgtgttgcgatataaagagacgttacagtactttgaaaaatgtcttgactggtgcgattataaccgtctaatattattgacattcttttctactttgtttccatgatttgtctcgcattctctgcaggggatcgtgagacttgaccagatcggtttgtcataacacctcaaagacgctatccgatccatcaggcccagtattcctgtctgggggtacttcccacagtgtgctggaatggttatcacaagaaggctgtgctgtcccctcgtcaactccaggatggtgtgtagccctgtgactctgaggatcgcccctcctgacagaagattttcgcgttctgcgatgtgagtattatcgttggaagaatactctcccttttcgtgtccactttattcttctccagttgttcctatgacaacatgactacaacgcaaaaaagaaaggacgaatctgcttgtttgg

SEQ ID NO: 721472 - DNA, 141 bp, Homo sapiens
aaaagttttgggacctgatgattcaacaaaagatggacaaaaaggcatatttctgggggatgatgaatggagagagactgcatggggagcttctcaccattcaatgtcccagcctattatggtacgcataaaaattctgca

SEQ ID NO: 721473 - DNA, 575 bp, Homo sapiens
  misc_feature (32)..(32): n is a, c, g, or t
  misc_feature (35)..(35): n is a, c, g, or t
  misc_feature (56)..(56): n is a, c, g, or t
  misc_feature (118)..(118): n is a, c, g, or t
  misc_feature (133)..(133): n is a, c, g, or t
  misc_feature (152)..(153): n is a, c, g, or t
  misc_feature (176)..(176): n is a, c, g, or t
  misc_feature (192)..(192): n is a, c, g, or t
  misc_feature (204)..(204): n is a, c, g, or t
  misc_feature (232)..(232): n is a, c, g, or t
  misc_feature (245)..(245): n is a, c, g, or t
  misc_feature (274)..(275): n is a, c, g, or t
  misc_feature (282)..(282): n is a, c, g, or t
  misc_feature (291)..(291): n is a, c, g, or t
  misc_feature (335)..(335): n is a, c, g, or t
  misc_feature (356)..(357): n is a, c, g, or t
  misc_feature (369)..(369): n is a, c, g, or t
  misc_feature (381)..(381): n is a, c, g, or t
  misc_feature (387)..(387): n is a, c, g, or t
  misc_feature (404)..(405): n is a, c, g, or t
  misc_feature (417)..(417): n is a, c, g, or t
  misc_feature (426)..(426): n is a, c, g, or t
  misc_feature (432)..(433): n is a, c, g, or t
  misc_feature (442)..(442): n is a, c, g, or t
  misc_feature (447)..(447): n is a, c, g, or t
  misc_feature (449)..(449): n is a, c, g, or t
  misc_feature (521)..(521): n is a, c, g, or t
ggatggtctggccagttctgggaggaacctgngcnatacctcactggtgctctacnctgacgtgtaggagctgaagaggagtgtgggcaagctccccagcaccgtggaatcactccanattgtgcaagagcangtgcacacgctgttgcacnnggaccaatgccagggctggcgtntgtctgctaagacttnctggacagactntcttctatagacaaactgaaagcctcantgagccaagtggnggcggacttgaaaatgctcaggactgctnnggacagnttgtgtgcntactcggtcaacatagaaaccaacgagaacaatctggaatcagncaagggttactagatgacctnncgaatgatctgnatatgttgcttngtgaantggctaagatcacagannggtctgaattgngtgtgcatngcgccnnattaaagtnccacntnttattaacaatgagtggttttttcccatgtgttccatacccaccaagtttttggccctcttaaagagctgantgtacctcctgaacaacgcattgttttatatgccccggttacctaattacttct

SEQ ID NO: 721474 - DNA, 983 bp, Homo sapiens
  misc_feature (376)..(376): n is a, c, g, or t
ggagaagcgagtactcgcgtctggtgctgctgcgaggggacgaatctggtctcgaatgacagtagagtggacctcctcccaaagatatctggtattgctcgagttccacttgctggagctgcgcgtggggtcccagggaatctggcagggcatgcttggcataggaatcctcgatgctgtgggttcccatgtcgcccacggctcctgcgatggtacttgcatgtggtccatgtcctgtgggtgttggaagggccatccacaacaggtgatgacactcgcacgaaggaagaggtactgtaggcatgccagtgtagcatcctagcatggctaccagagcaagtatttgcacgtggtgcgttccgaaacgcgcaagtantctcatccatgtggccgttggtggtgctccgtacgcgcccgaaccttatggggctcgagggagcacccccgctaccaaggcattgatgtggccgcacctctctggatatgtagagctctctattgggtccccgcaattggcggagtccccgctcgtgtgaacgagcggacttccagattgggtcatgccgcccgtctcgggggatgctggactcgctccacccgtgtgggcattgcggagtggccttcgtttgaagcgcttgtggcacaagagatatgcgaagtagctccgcgagaaggcgtgggctcgaattcctcagggtcgcacgttagcacagacctgtttgtgagcttatgcatgttgttcgtggaggtctcatgggatatgtctggatttccctttacaaggggccccactccccgcgggaatgcgacccagccaaggccctaagactcgtcgtgggcccgtcctcaggttcccttgccatgtttcccagtaaaggcttgtagtatagtccttatatctcctttgtggcctatgaaaactggtgtaaatagtaaaacgtctttaagaagaacatttatccattaatagaacagacagaact

SEQ ID NO: 721475 - DNA, 540 bp, Homo sapiens
  misc_feature (32)..(32): n is a, c, g, or t
  misc_feature (35)..(35): n is a, c, g, or t
  misc_feature (56)..(56): n is a, c, g, or t
  misc_feature (118)..(118): n is a, c, g, or t
  misc_feature (133)..(133): n is a, c, g, or t
  misc_feature (152)..(153): n is a, c, g, or t
  misc_feature (176)..(176): n is a, c, g, or t
  misc_feature (192)..(192): n is a, c, g, or t
  misc_feature (204)..(204): n is a, c, g, or t
  misc_feature (232)..(232): n is a, c, g, or t
  misc_feature (245)..(245): n is a, c, g, or t
  misc_feature (274)..(275): n is a, c, g, or t
  misc_feature (282)..(282): n is a, c, g, or t
  misc_feature (291)..(291): n is a, c, g, or t
  misc_feature (335)..(335): n is a, c, g, or t
  misc_feature (356)..(357): n is a, c, g, or t
  misc_feature (369)..(369): n is a, c, g, or t
  misc_feature (381)..(381): n is a, c, g, or t
  misc_feature (387)..(387): n is a, c, g, or t
  misc_feature (404)..(405): n is a, c, g, or t
  misc_feature (417)..(417): n is a, c, g, or t
  misc_feature (426)..(426): n is a, c, g, or t
  misc_feature (432)..(433): n is a, c, g, or t
  misc_feature (442)..(442): n is a, c, g, or t
  misc_feature (447)..(447): n is a, c, g, or t
  misc_feature (449)..(449): n is a, c, g, or t
ggatggtctggccagttctgggaggaacctgngcnatacctcactggtgctctacnctgacgtgtaggagctgaagaggagtgtgggcaagctccccagcaccgtggaatcactccanattgtgcaagagcangtgcacacgctgttgcacnnggaccaatgccagggctggcgtntgtctgctaagacttnctggacagactntcttctatagacaaactgaaagcctcantgagccaagtggnggcggacttgaaaatgctcaggactgctnnggacagnttgtgtgcntactcggtcaacatagaaaccaacgagaacaatctggaatcagncaagggttactagatgacctnncgaatgatctgnatatgttgcttngtgaantggctaagatcacagannggtctgaattgngtgtgcatngcgccnnattaaagtnccacntnttattacccacttgagcttaatgttaacacgctgcacaacaaggcatttgtgtttttatgccccggttacctaattagaatattctagctc

SEQ ID NO: 721476 - DNA, 356 bp, Homo sapiens
aacttggcacacacatgctagtgtcagcactccaacacccactggcagatgccatggcgatgcgcgacatctacagcgtcttcaactccaacggcgcctataaaaccggggcccacgcccatgatgaattcatgctgatggtgcccgagcacggtctgttgcgttacaaggatgaagaacgtgggcgcaccacctcggtgatcgaccgccagttcgtactggtgccgccgcaatccagccattcctcttcgtcactcaccgccagccagggccacgtggcgttctacgtcgaccccgactacatgcactacgccttgcgggatctttccggtgacgccaaccgcttgctgcgcgtg

SEQ ID NO: 721477 - DNA, 390 bp, Homo sapiens
cgctactatgcctatagagcgtaatactctcgctgtgcattatagctactctcatatgccctcaacacccactctctctctagccaatattgggcctatatgccatactaggccttggcgcgctgccaagcaaccgagggcctagccctactagactcaatctccaacacatatggcctatactacctacataacctcctacttcaatgctctaatcttgccaacgcattatattactaccactgacatgactttccaatcccctactattggttaacccaatcaacaacaacctatttagctgtgccccaacctctttcctatcgacgcccctaacagacctcaccttctaagactcctacactgactctctacacccttacacatctg

SEQ ID NO: 721478 - DNA, 265 bp, Homo sapiens
cgatggcttgaacactgcgagcagccctcagactggtttctgtcactgaccgagccgaacggaggggtgctctgagggtgagttttctgcccaaaatgaagagaggttccagggagtggacagattcaaccggcatacacccccgccccccttctccccaaggcacctgaggtgtatactacttggggatccgtgcacgttaacgattactaggactatgcagaaaccagagagtataagaataccgcatgggctcctttccctt

SEQ ID NO: 721479 - DNA, 630 bp, Homo sapiens
  misc_feature (120)..(120): n is a, c, g, or t
tccgggtgtttaataaccttcagaagtttcccacaaaggctcagactctgggcaaggggtctggggcttccctggactgatggggagggggtggagagagaagagggtgcctggagctgncctggccccccaagtcacagcccaagagtgaggccttcccccatgccagcaggatgacggggagctgagggggcactcctagggcggcaagaggacatgtgaggacctggagtggctctggggagggtgtgaatgatggtatgagggtgacagtgcacatggatatccacccttccaccgtatagctctcctctctctgagtcgggcctgggcaactcagtctccgagattctaccccacagggtgctggttggtttgagcaccatacgaccccatggcttgctgggagtatgttgtaagagccagggggattcctgcgggtgctgttaaggcggttgtgacactttagctttggtttccatgaagtcccttggcaggtcggctcattttcccagttgcctagaatggacagttccctgggaccgccccgaagaactgatcttccagcaggaataatacttacttccaaccacctgctccacataattcattgcctaacccctggggtcg

SEQ ID NO: 721480 - DNA, 1176 bp, Homo sapiens
  misc_feature (266)..(266): n is a, c, g, or t
  misc_feature (711)..(711): n is a, c, g, or t
  misc_feature (714)..(714): n is a, c, g, or t
cgagagaggcggcgtccattagttagcggctccggagcaacgcagccgttgtccttgaggccgacgggcctgacgcgggcgggttgaacgcgctggtgaggcggtcaccctgggctactggctggcctgtgcatgggtggcatgtggctggcctgttgtctatgggccctggagtgtggggcctgcgctgcctcgtggctgctacgaaccctggctgtggcccactgcttgtgcttgcgtgcctggtgtgctgtgtgctgagtgcncatggtgctgatcctgctgtgcatgtctccctgggctgcctgtgatgtgaccacgggatctgctgtgcccatctgactgccatctgtgctgtgctcggctgtgtgctcttgcgtgccgtgctgggaacgacgtcacgtggtgctggtgacctgccctgctttgctgtggtccccctggacggttgcggaacgcctgctgtgcggtgcactgctgcacatgcaccacgtgacccaccaaagacaatgtgactgtgatggactgcactgtgctgatgtgtgacaagactgtgcccacattgtgcgacgccttagacgtgattgcccaatcgagccattagcaagcgaatttcgtcttaactatccaaggcgtccttggacgatgatgtgactatccatgaccagaacatcacaccgtctgagcctactctcttaacaccgtgcgctngtngcttgcgctgcactcgcgtagcactcgtatgacacgcccacattgcacacgggatattacttatcatgcggagcagacacgtccaatccaaacgctacttcggacacttcccttgcgttgtgaacaccccgagttcgcaggggctgaggtatatcagtcgttgatatcgcatcgtacagggtagtccgccgttagttaggacgttgtgtcaccctggacacgcagttgctccatgcgatataactcttggcagggctcatagtagttcctatatgccatggtcgggcatggccatttcccacatgtggtctcgcagcgaactgccgtccctagggctcgcgctcggtgttgacaccatgtaactgggacgtcacgtcgcgtgtgaacatgtcctggctctgccgactgtcgagaccctaaccctgtggtcccaacccagatttccggcttgcttaacgccta

SEQ ID NO: 721481 - DNA, 1368 bp, Homo sapiens
  misc_feature (298)..(298): n is a, c, g, or t
  misc_feature (1324)..(1324): n is a, c, g, or t
gggaagcagcagaactcgttcaggaaaccaggaaaagttgtgtaatgagggcaaagagtagcagatcctcatgagactaggaagggatggagtagacttcggcgtcgaaggacatcttaaacattttagtattaattttgtgatcagtcagagtgaacgaaggataaaagaaaggaaaagtaacataagattttcatttgtaaagagaattggccgacatagagcagagcgagtgacctggcttagtcccgggttatgctgtcatcctgcagagacagactgcttatatttgctgatngttgtgaaaatgagagaaagaatgcatacaatttagaagatccatggaaatcactggtaatgatcagtattgtgatgggcgcaaagagatgacttttgcggctgatagccagatctgtctgcatggaacgactccataaacgttaacctcggagacaaatggggagggaatccaaagagcttgttaggacacagcgcttcggttaaaatctgtcttggcaagctactgcaccgatggatgctttcataatcagtttgagttatgtgtctaggactatttgctgtgtaacatactcccaattagtggcataagcagcaacctttttggttatgccagggcccatgggggtcagaatttcaaaagggcccagcggagtggcttctttctgcccacaatgtatagggtttacagtggaagccccaaaggctggagctggcctcatccacaggctggtgcatgcctatgtctggcacttgggctgaggcatggaaggaacacttttcagcctttacactcagcctgctccctcactctgcaatgctctcagggcctgggtgctacgactcctgagaacaggtagcaggtgtgtcaccttctcaaaaataatgtcaacagtcatgcagtccacactttactcattgcaggagattcacaagcctccctcccagattcagggaaggagatgcagcccccaccccttgactggaggaggaccaaggtcaccttgcagagcaccgtgagatgtggaagatgccagaactgtctgtgggaaatgggatttgacttggcttgtctgcctcttgcaaccagagtcctggttctcagggcctcacctgtgcatctcttgttgagcacagaggaggcactcggcataaatgaagaggatgcttgctgagctggctggcccatcctctcttctttcccttgtttttctattttatctttcaaagcagtgtttcaagtgtttataaactaatctatgtataaaatattatgtggcataagatttgcaaaatattaaagatntaaagaatcaaataaaatatttgtatgataccacaaaaaaaaaa

SEQ ID NO: 721482 - DNA, 1103 bp, Homo sapiens
  misc_feature (19)..(20): n is a, c, g, or t
  misc_feature (25)..(25): n is a, c, g, or t
  misc_feature (33)..(33): n is a, c, g, or t
gtggtcgttgggttttccnnccccngggtgtanggatatagtcgaccgggcctctgcgtgacgcgtggggtgctcctcccagtactcaattggctgtgtgtcctgctcagtgtctcatatccccagtgccaagttacaaggacagcagccctttgtgaggcgctcttggccctgggcctggagggagaactttaagcttttatgctcacagtggacgtggtatgtgtgccctgtggttgcagtgtgcccacattctggctaatgatgagcttatgtctagatcagtccatgtggtccatcagtttgtccatgtgtcctggcatgccaagccccgtcccttggggatccttaccccctggggggtgtagcccttgttacattagtatatactcattaccttcatgctttcctcagaagaagcacttccacttctgaggtgaggctttatgagcccatgcccttcctccacaggttgttagcctttacataaagacctgatagcagaatacattggtgtgatcccttgtagaagcccagcaaccaatttcttgtgtggcgctaggagatattggccccttcaacgccgttagaggtggcggcaagtgagtggctctgcagagacgtgaacccctattccatttcatcagttgggttaaagggtcacattttgggcttgacaaggcccttaaacttggccacagacatcatggcttggcgttttcatagaacgagaattgggccagggaacggattgacaacccgaagatttaccaagagacaatttggagccaaaggggtatagagcaacccccaatccgtccgtatattggaaggagccattaagtaggggggcacaccaacgtagtttgcaagttatggtcaagcctattttaaggggcaacaagttgacccttggtatattgggcgtttttacagagggggtaaacggacgcttggcagaggttgttgaaggaaaggccataggtggttaacattggagtggggaattacaatttgtacgatgtggtaccgtttcaaagagattagcaggacgtcattagaggggggatcacgttgaatggtgatggcaagagtttcgcgtc

SEQ ID NO: 721483 - DNA, 144 bp, Homo sapiens
ccattcctatcatgcagaggctcatctttgcagggcaggcagctggaagatggtcgctactctttctgactacaactatccagaagggagtcgaccactgcagcctggttccgtgcgtctctgagaggtggtatgctagatctt

SEQ ID NO: 721484 - DNA, 420 bp, Homo sapiens
  misc_feature (327)..(327): n is a, c, g, or t
  misc_feature (366)..(366): n is a, c, g, or t
gtcactcaggctggagtgcagtggtgcgaaaacagctcactgcagcctcgacctcctgggctcaagtgattctcccagcttagcctcctgagtagctgggattacagctgcacgccaacagtcctggatgatttttttttttttttaaattttttgtagggatgggtccctactgtgttgcccaggctgatcttgaactccggcgcccaagcaatcctaccaccttggcctctccaagtgctggcattacaggtgtgagccaccatgcccaggcgagagtctgcatcttaatggtgaaatcaatcctcatcacttactgtaatggtnaatatatgtggggtaatttctgctaccatgcaggtcaanaatcaagcgttgctgttaacccagatcccttcttgaaccccttctgtcgtcttc

SEQ ID NO: 721485 - DNA, 290 bp, Homo sapiens
ctgggaacagagcaaaccgcatctcagaacaaaacaaaacagaagcaaagaagttgggggaggaaggagcgtatcaggaagaatagctaatggatgctgggctgaatacctacatgatgggatgattggtgcagcagaccaccagggcacacatttacccttgtaacaaacctgcacatccggtacatgtacccctgaacataaaaatgggaaatcaaagaaaaaaaaaaagggagtccaggagggggggacgcaatcatggggggtaccggagctcggaatccggtagt

SEQ ID NO: 721486 - DNA, 314 bp, Homo sapiens
gcggccgcctactactactactactgctcgaattcaagcttctaacgatgtacggggacatgtaaagtacttacttagcagaatatctggcacatagtaagttctcaatcattattaatctatgttttcatggtgaacccccggctctactaaaaatacaaaaaattagctggatgtggtggcgggtgcctgtaatcccagctactcaggaggctgaggcactagaattgcttgaacctgggaggcagaggttgcagtgagctgggatcgtgccactgcactccagcctgggtgacaaagtgagattctgctca

SEQ ID NO: 721487 - DNA, 318 bp, Homo sapiens
  misc_feature (30)..(30): n is a, c, g, or t
tcattgcctaatggataggcgtggtggaantggcaccgaggaggacatatcacgaccgggcgcggcgcgcccctcgccaagtggtcttccgggatcgtatcggtttaagaagcggacggagctgtcatgcgcaggcatcacacggcatgtgtatgcggagaggccagctcaacatggcatgtgctccctgtggcaccagcctgaggtacaatcgtgtgctgctggaggagaagcctgagaccgtggcagctgccggcatcaggaactatccagttattccccaacctgagaccagaagacccggagggggggcggggg

SEQ ID NO: 721488 - DNA, 712 bp, Homo sapiens
  misc_feature (106)..(106): n is a, c, g, or t
  misc_feature (109)..(109): n is a, c, g, or t
aacgatggtcctcagcttcttttctgaaaagaaagctgactaccaagctgtcgatgatgaaatcgaggccaatcttgaagagttcgacatcagcgaggatgacatngangatggattcaggagactgttggcccagttggcaggagaggatgggagaatctcgtgccttgtgagctggagacccatcctgaggaagggttctagcaaaagggcaaagatatcaagtcagattggttcagcattcgagacatgcaaaattatggttgacatgctagattcggaggggaggtggcaagctgggcgttgaaggagtctacatttctctggaggaaggattcaaaattacgcaaaaaaatttagcgagaaatcgacgttgacaggtctgttaccatgaatttcctatgaaatggggaaggcattcagaagaagcaggtttcaagatgccctgtaattcaacaagtcatcgtgctcggttggaagatgaccagtcatcatcgattttgatacttttgcagggtaggtcagggtgaaaggcgattaaggatatttacgcagtggatcccgagaatactgaacaaaagagatgacttatctctgggtctgtctcagtacttggagtataataatctgctgaggattctctgatggaataagacaggatagttcattaaatacttgtatttgggtaaatttggacattattaaggtgcca

SEQ ID NO: 721489 - DNA, 113 bp, Homo sapiens
gtataggctgaagcgcgaactcagccaggttggggtgatcttgtcgaaggtagggtgatcctgatcatggtgggatgtatctgtcttctagggcagcatctccgcttcggaaa

SEQ ID NO: 721490 - DNA, 144 bp, Homo sapiens
gagtcggaggatcccaggaagccatcctctctagggtctcagttacccatctctgaaaaattaggggtttctcaaggccaaaaagggtacaacctggagggtcaggtgttggagtttttaactgaaggcactcgggattgtcaa

SEQ ID NO: 721491 - DNA, 549 bp, Homo sapiens
tgggaggattgcttgaggccagtgcttcgagaccagcttgggcaacataccaagtctctacctcagctgagtacggtgccttacacctgtaatcccagcatatttgagaggtctgggccgggggattgcttgagcccaggagttcgagaccagcctgggcaatggggcaaaaccctgtctgtacaaaaaagtacaaaaattggctgggcctggtggtgcatgcctgtggtcccagctaccaggaggctgaggtgggaggattgcttgagcccaagaagttgaggctgtagtgagccaaaattgtgcctctgcttttcagtctgggcaacagggtgaggtcctatctcaaacaaacatacaaacaaaaatcgtctctgcaaaacaataaaaacaaattagccaggtgtggttgtacgtccttgtagtcttagttatttgggaggctgaggtgggagagtgcttgagccctggagtttgaggctgcactgagctatgatttttgcccctgtactccagcctgggcaacagagtgagaccctgtctcttaaa

SEQ ID NO: 721492 - DNA, 240 bp, Homo sapiens
tgggactagtacttgttgtagtactactagatccacccaacgactccgatatgagccacgacccctgcataggaataatcatatccggagccaccctgtgttcataaaccatctgccattctgatgtgctccatgtatctctagcagagtcccaagtttcatcagcactgaaaccaaacatgccgtcgtaacggtctccaggtctccctcttctgccattgcgcccgcgaggggtaccga

SEQ ID NO: 721493 - DNA, 150 bp, Homo sapiens
agactcgccgaccacggcaaagagcagggctgccatatagtgagccagcatgggagacgctaagggccataggcgcaaagcaggggcagcagctccaaaacgacagcgccacgtccctggcaggaaggtgatgcccaggcactctagtct

SEQ ID NO: 721494 - DNA, 903 bp, Homo sapiens
gactcgcgccttgccgtgcaccgaaccccgccatggagcggccgtcgctgcgcggcctgtcctcgggccgtgggctgctgctcctgctcctgccccctctcctcttcctcctcttcggacacctgcggccctgcgagcggcctcctgccccgcccctgccccctgtgggttgcctgctggggcgagaccctggactgcgttgcggttgttgcccctatgtgcgccccgtggggagggcgacccggtgccggggggtggcggcccccggaggggcggtaacttgcggcgcgggggcaattggaagttgcgtgaagaacccgcaagagtgcgaagtgcgttaacacgccgtgggcagcaacgcgggcgggccgggtgaaacacgccggacgttattgccgttgtgcaaggagccggtctaacccgtggttgttgctgcaagcaaagggcccaacttaccggagcgggtgtatcacagttggcgcgccgccagcaatgagggcgccgagaaacccggggggaggaggcgcaatcaccccgggtcggacaggggcacaccttgagagcaagtttgccttcccatagaacacgtgtgtgaagaagggacccccgttgatgccaccctttcccatcggagcaccggggatccatcttgctggttaccagcgcggccccttccaagttggtgacgccccccaaagggaaccttttgcgaattgtcctgtcggccccaggtggtatcctgacctgtggaggcacatgcggaaacaccgaagacttgtctgctattgtggaacaggtcaacgggggctccatgtggtcaacaggacaagaccctgctggagcgcggaacggtgcccttcaaccggtgtggcaaaacgatatacgggggggcgcacccaagag

SEQ ID NO: 721495 - DNA, 218 bp, Homo sapiens
  misc_feature (3)..(3): n is a, c, g, or t
  misc_feature (17)..(17): n is a, c, g, or t
  misc_feature (25)..(25): n is a, c, g, or t
  misc_feature (163)..(163): n is a, c, g, or t
atnccttctccatccanttagttancagaaactaatcaaaagaaagtctgacaactgcactcccccttgcatgccattctctcaagcccataatcttggagtatccacaacgtgcgaaggcctaccctttgtgtgtactcatctcacgtttacgtattttgtngttgaggagctcctctacaaatgttgcgtatcttccgaatcactcatttagaaaa

SEQ ID NO: 721496 - DNA, 120 bp, Homo sapiens
gctggtgcctcctctgtagtaaaggaaaggtaacagtcctgccaaggctttgaagctttacagcgtgcttgcccttaagattcttgtgttgtgttctgggtcagcaggaatagctcgcca

SEQ ID NO: 721497 - DNA, 134 bp, Homo sapiens
agacccgcacgacacggcgactcctatcaataccatatgccgacagcaagatatccaaaatgctataatagtagtactttgtaggaagctttcagatagcttatgcagctttctaagatttcatacaatcacta

SEQ ID NO: 721498 - DNA, 228 bp, Homo sapiens
tcgcttaggaaggtgcagaggttggcagcttcgattgaagcacatcgacgcgaagagcagatctgaagtggtgggtagggtgtggtgtgtgtagtctgtggtaggtttgtgtgtgtgtgtgatatgagtggtggaggtgggtgggtggtgtgtaggtgtgtgtgtggtgtgggttgtgttgtgtgatggttggtgttgtgtgttgcgtgtgtgtgggtaggtgttgtg

SEQ ID NO: 721499 - DNA, 119 bp, Homo sapiens
tgcacttgaggtcattattcacccgggccctcatcatatggcatcccaattgcccatgcatccatccatgcaccagcatctgcggcgcgcatcgcatcatccaggcgctttcacacatt

SEQ ID NO: 721500 - DNA, 689 bp, Homo sapiens
  misc_feature (5)..(5): n is a, c, g, or t
  misc_feature (90)..(90): n is a, c, g, or t
  misc_feature (112)..(113): n is a, c, g, or t
  misc_feature (125)..(125): n is a, c, g, or t
  misc_feature (127)..(127): n is a, c, g, or t
  misc_feature (155)..(155): n is a, c, g, or t
  misc_feature (162)..(162): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (177)..(177): n is a, c, g, or t
  misc_feature (179)..(179): n is a, c, g, or t
  misc_feature (191)..(192): n is a, c, g, or t
  misc_feature (198)..(198): n is a, c, g, or t
  misc_feature (202)..(203): n is a, c, g, or t
  misc_feature (210)..(210): n is a, c, g, or t
  misc_feature (212)..(213): n is a, c, g, or t
  misc_feature (215)..(215): n is a, c, g, or t
  misc_feature (223)..(223): n is a, c, g, or t
  misc_feature (226)..(227): n is a, c, g, or t
  misc_feature (230)..(233): n is a, c, g, or t
  misc_feature (238)..(238): n is a, c, g, or t
  misc_feature (241)..(241): n is a, c, g, or t
  misc_feature (251)..(251): n is a, c, g, or t
  misc_feature (264)..(264): n is a, c, g, or t
  misc_feature (266)..(267): n is a, c, g, or t
  misc_feature (271)..(271): n is a, c, g, or t
  misc_feature (274)..(274): n is a, c, g, or t
  misc_feature (281)..(283): n is a, c, g, or t
  misc_feature (290)..(290): n is a, c, g, or t
  misc_feature (313)..(313): n is a, c, g, or t
  misc_feature (315)..(315): n is a, c, g, or t
  misc_feature (329)..(329): n is a, c, g, or t
  misc_feature (340)..(340): n is a, c, g, or t
  misc_feature (349)..(349): n is a, c, g, or t
  misc_feature (352)..(352): n is a, c, g, or t
  misc_feature (377)..(377): n is a, c, g, or t
  misc_feature (399)..(400): n is a, c, g, or t
  misc_feature (412)..(412): n is a, c, g, or t
  misc_feature (416)..(416): n is a, c, g, or t
  misc_feature (430)..(430): n is a, c, g, or t
  misc_feature (493)..(493): n is a, c, g, or t
  misc_feature (554)..(554): n is a, c, g, or t
  misc_feature (598)..(599): n is a, c, g, or t
  misc_feature (603)..(603): n is a, c, g, or t
  misc_feature (665)..(665): n is a, c, g, or t
ataanaaaaaaggaaagaaattgtaaatgaaagaaaaaaatgctacaataaaaattaaatgatagaccacaacttttcaatgtttaaaanagaataagcttccctgtaaaannagaacctttgtnangttttaaatttagtattcctctccttcntcctcancctctccntnaananantcaacaccaacnncctcanaatnnttctcangnncngccatgtnctnncgnnnntttgngangtgcacttcntccatcccctccncnngggnccngggggcnnnggggggnggggggtagatggggggaaggtngnggtccaggggggcncaggcctcagnaatggctgnggngttgctcagcatgcacacagctctntgtaccttgggaaggtttccannagggaaaaaagngggngggtggtagttganggaaaccttgaagccagtgggggaccaatccacaaactggatggtaggcttggtcttgatggnggcaatggcagcattgacatttttgggaaccacgtaaaaaaggtaaaaaaggaagaaaganatgtatttaccatggcgagggtcacatttcaccatctgggtggnnggcncaaagcaagcattggtgatctctgctacagaaagctgttcatggtaggctttctcagcaganatgacaggggcatatgtggccaga

SEQ ID NO: 721501 - DNA, 851 bp, Homo sapiens
  misc_feature (427)..(427): n is a, c, g, or t
ggggggctggcggggcgaagtttggggggtgttttgtggtggctccccggacatactctctggctggtggctcagatgcaggttgtgaagggtgccttgctgagatggcgcaaggaccgagctgttcccagcagggtggaagaaacccttcacaccccaggacccttcaggaactggggctttgccttgcggtccacatggccccatcccagttggggaagccaggtgagctcctgcaaccgcttgttggcctgtggtcctctgccccgtcctccatagccctagccgtcgtctccctcgactgtcgcccctgctgtcttccccactgcgagtcaccacctaccccgaatagtgccactgtggtcactgtgcactgccctgttcatgtgcctctgcggggcagaggcctttcctggttttgtacacntgcttgtaccctaagatgcctacaacccatccctgccacatacagggtgcgtcaataatacacttgtagaagcaatagaacaataaggccaagtatatcatagcatagaaattaaaggaactcatataccagggggcactccgcttaaaagtactatcaccctcgagggggccccgaggctgtgagccgatcaccccgtgagtgtttctttgcgtacacgctgggtccccccttcacagaggagtggctccgttgtttattatgggactggcgtggcgtggacccggttgtctcaacgctccctgtcgtggttacggcggggcgcggaaccggtgtgctttggcccgtgagtcgctttctggggggagggagaccctttctacttggggcggggtcgcaacccctttgggcggcctcctctctg

SEQ ID NO: 721502 - DNA, 609 bp, Homo sapiens
ccagttacacgcggacagctcagctctggatgtaacaagagggcactacatgtgaccacgaccttactctgctatggctgatccccgtaaagtactacaagtcttaatcggtaagtaataattcgactactatgtcgagcttgtcagatgctactgcgtgggggtagctaatgtctctaagtatgaagatgctcaattttctctggtacaagtcaccgatgaactatatgctagtatacaggactggcttgcgctaaggatcagattccccagtgtaaaatatatactccttatagggtggtaagagcggaagcccttcatagcctgtttctttttgctctctcttcagccagcagttggcctggatctttgctggtagacacagggaatgttctccttgacgagtggttcccaccctggcagcctcagatcccaccatgttggcagggatgctgaaatccacctgcctatcagcctttgtaaataacaaaaaatcacaagtggctctagcatttatgtattctatgatattgggctcgtgatataaataatacaaatgctttacatgcatattcaattatactatgttatctttaatactggatataa

SEQ ID NO: 721503 - DNA, 998 bp, Homo sapiens
ggatgttaccctgatgcccattgattgtgaagctgtctagcttggtcctcttggaccacagtgtgacccctgtcagaagaaaaggtacaggtatgcctacttgctccaggccctctcagttccatggggaaccgtgcaacttctctgacaaggtaagtcgaatgactgtgttaccaacagaccatgcagaagtcaagtgcgatgtgaaggctttgtgtgtgcacagacaggaaggtgtgtaaaccgcagacttctttgcaatggggacaatgactgtggtaggaccagtcacgatgacagcacactgtagaacggatttatacccataatgtcacgcatgaaatggtaccaagtactggggaattgtgcatgtctggccagtgggatacagtttgttcacaaacagttttgagggcccagttcttgatcacaggtattatgcaggtggatgctccccgctttacatcctgaacacgaggtttaggaagccctacaatgtggaaagctacatgctactgatccaaggtcactatacgaattcagtattacaaagagtatgacatcatactcaggattcttgaacgcaagtgtcacagcagacacagtggcaagcaagtctgggttccagttatcggttttaaaatacctggaatattgaaccttgggcctccagttagtcaacagtgattcgaggcaaacactatattaggagaaccaaacgatctcctcatactaaaagcgtatttctgaatgcacgctctggcccttgaagttagcacattacaagctggaagccagaaggctaatgcgtccgttacgagtttccttccaagagttaagcggttgcccctgggagtaacgctacggggaatatcggaaatttcttcagggaattggggacgcgtttattccagaagagtgtatgggggatttgaaataccgctgttttgacaacagccatggaaagggatatccttaaagtcgagagatgtccaagt

SEQ ID NO: 721504 - DNA, 280 bp, Homo sapiens
  misc_feature (141)..(141): n is a, c, g, or t
  misc_feature (143)..(145): n is a, c, g, or t
  misc_feature (149)..(149): n is a, c, g, or t
  misc_feature (166)..(166): n is a, c, g, or t
  misc_feature (170)..(170): n is a, c, g, or t
  misc_feature (173)..(173): n is a, c, g, or t
  misc_feature (183)..(183): n is a, c, g, or t
  misc_feature (190)..(190): n is a, c, g, or t
  misc_feature (193)..(193): n is a, c, g, or t
  misc_feature (196)..(196): n is a, c, g, or t
  misc_feature (225)..(225): n is a, c, g, or t
cgagggctatccgtggataaaatggttctgaacttgattgtgtatccttccgtagtgctgtggagcgtattcccggagaggtgcctctgtgaatgtgctatatctcctacgacactcctgagggctgtatggtcccggggncnnntgcngaccgcctggtgcttcngganctnggtgctgggnaagccanatncantgcggcgtccagaggcagaagcacaaccnacaagaaccacgaaggaggcgcctttcctcctataatgcctgttcggtttatact

SEQ ID NO: 721505 - DNA, 166 bp, Homo sapiens
cgttcctgttgtgggcagcactctctcgatcactgccccggtgttatccaccgtgcgattgattacaccgctgtgcggcaagcgtgcgatgctttcctcaaccagctgcgacaaggtttagccgcgttcgccaatcagctccagcaccagcaaccagggcatcatg

SEQ ID NO: 721506 - DNA, 849 bp, Homo sapiens
taatggcggagcgtggcggggacggaggggaaggcgagcggttcaacccgggggagctgaggatggctcaacagcaggccttgaggttccgaggcccagctcccccaccaaatgccgtgatgcgaggcccgccacctctcatgagaccacctcctcctttcggcatgatgagaggccctcctccaccacccaggcccccctttggacggcctccttttgatcctaatatgccaccaatgcctcctccaggaggaatacctccacctatgggcccacctcacctacagagaccacctttcatgcctccacccatgggagctatgcctcctcctccgggtatgatgttcccaccaggaatgcctccggggactgctcctggtgctccagcactgcctcccactgaggagatatgggtagaaaataaaactccagatgggaaggtttattactacaatgctcggactcgtgaatctgcatggaccaagccagatggagttaaggttattcagcaatcagaactgacgcccatgcttgcagcccaagcacaggttcaggcccaggcccaggcccaggcccaagcacaggctcaggccaggccaggcacaagcccaggctcaggcccaggcccaggcccaagctcaggcacaagcccaggctcaggcccagggcccaggcccaggctcaaaggtcaaggccaaagccagcgccagcaaaagcccaggcccaagccaagggcccaggtccaggccaaggacaattccacgcaccaaagcagtagggggtcccaccctaacaacagtagcccacctcgatggtccaggtaatccgaatttaaccttttcacaatac

SEQ ID NO: 721507 - DNA, 110 bp, Homo sapiens
tattgctccactgctccatctggaagctggagcataatgctgcagtttgggcccagtgctatgtgctcttcttggtgccctagtggactgctgtggccagtgtggatcct

SEQ ID NO: 721508 - DNA, 875 bp, Homo sapiens
gtgggccccgatcactattgtggtgggggcaccactgtggttctctctgccagacattgggttgcccgctgtgtgtgaacggtgcttcaacggtcttgcctgtcgccgcccttgtgaagcggcggccaaattcccaggttcttcgtctgccctggcggtgtattgttcgccgcgttcttgcggcccccggaagttttgtggcgctaacgccgccgctgggcccccgagattgggtctgcgaaacatgggcgctgggtttccccgcggacttttttgtgtggtataccacccagggtctctttcactcacattgtctcggaaaaaaacaactgttgggaatcaccacgactgggttggaaaaaaactcttcttatactgtggaccctcgttcctccagtctttagtaaatacttgtatgacgcaccacgcgtgaactagcacccccttgaataaaattctctcccgatccaacatgaacaagttgtgtgtttgataacaattctatactgccacatggggggagactgtcccacgtacaaggctttccccccctggcgcacccaccagagccgacgggctacacacgagggtgcgaccaccatggatgttggcgctccgcgacgcccgtgctcgacccacgagggatttgccccctatgcacgtctcggcttttctcacgatcgatagggggccacgaggaaaagacggacccccacataggtagaacaagacaaaaaaagtaatgatccacaaaagtttgttgaatctagaccctcctttgctaccgactggcgggtgaataattttgtgcaaacttctatactttctttcgagggagacaacaaaaaaaatcccttgttaaacgggaacataac

SEQ ID NO: 721509 - DNA, 254 bp, Homo sapiens
  misc_feature (42)..(42): n is a, c, g, or t
tattgtgacattatatgtaataaaatatattgtgacattatntgtaataaaatatattgtgacattatatgtaataaaatatattgtgacgattatatgtaataaaatatattgtgacattatatgtaataaaatatattgtgacattatatgtaataaaatatattgtgacattatatgtaataaaatatattgtgacattatatgtaataaaatatattatgacatatataataaaatatattatgacatta

SEQ ID NO: 721510 - DNA, 271 bp, Homo sapiens
ggactgtactctagacaggcaacagataatgcaaaaatcatcggaaaggcgatgctacacatgtctcatacaatgaaactaaatatatcagatatgagagggtcgcccatcagttcagtcaagccactttcctagatgggtcatactctgtccgtgatgtcttccacgttcagaaagctcagaaatccacctgaagaggagcccaaagaacatatatctgggctgcatgtggatctgtttcatatcactctgcataactagacactatgac

SEQ ID NO: 721511 - DNA, 195 bp, Homo sapiens
catgagagctgagtgggcaggactgactgaaccatatagtaaaaaccaggtccccggcactctagccgtacacagtgtcctacaccccaaggtaaccagcagtgcagtgcaccaggtaggctgcccgtgggacagagggagctgaagcgcacactcctcagagcctgggagccatttccctggggccaacccagg

SEQ ID NO: 721512 - DNA, 504 bp, Homo sapiens
  misc_feature (38)..(38): n is a, c, g, or t
  misc_feature (94)..(94): n is a, c, g, or t
  misc_feature (106)..(106): n is a, c, g, or t
  misc_feature (476)..(476): n is a, c, g, or t
attcgcgggcgcgtcgacctttgagaacaataagcatntcatcttgtcttggatttagaataaggatgttaaaaagaagagatgcagctctatntacaattttttnttattacttagactcagaatttcagagctgataaaaggtactttataagtcagcatgttgtggtccattactggactcaacataggtaatgaaatatgattacaaggctgggcgctagtggctcacacctctaatcccagcactttgggaggtcagggtgggaggatcacttgaggctaggagttcaagaccagtatgggcaacacagcaagaccacatatttacaaagaatttttttctttacctgtctgggcctgatgttacccgcctgtagtcccagccactctagagactgaggtgcaaggattgcttgagcccaggagtttgaggctgcagtgagttgtgatcataccactgcactccagcctangtgacagagtgagactctgtctcaaaaa

SEQ ID NO: 721513 - DNA, 973 bp, Homo sapiens
  misc_feature (681)..(681): n is a, c, g, or t
ccactagtagtaaacaatagttcttttttttgagacggagtttcactctgtcgcccaggctgaggcagagaattgcttgaacccgggaggcggaggttgcagtgagctaagatcgcaccactttactccagcctgagcgacagagcaagactctgtctcaaaaaaaaaaaaaagagagagagatttggcagatattgggtaaccctaggctttaacacctatagctccagctctttcccgggtctgtgctaaaacatggggatgacattgtgactgccttgatgttccacatattcatctccgttgtgactcggactacaacgggtgccagtgggctcacaccgtgagggtaagccttagctctaaccccgggggtctcctaagggcaaccaaatttgttgcgcatgaacatgctgggaagtgccgctcccattgtaccgtgcggcaaaacagagcccacacgtggacctcctaacattgagacgacacaaggattcccacaagaagaatgatttcacactggattggacccgtgaggtttaaaccccagacaatattgtggggccaataaaagaccgtcacgctgtgaacagtgtacaccagtggggcccccaaaggggtgctattagcccactataaagcgtgcgcatcgtccacgtatatcacagtcatttttttcgnacacaaaacaggtcgctatgaaaagtacggggggtggtccataccacgcgcccctgtggttggtcatattcactccgacacgcacacgttttgtggggggacagggtgcccgacgacaggttgagggacacagaaatacacccgaaggtgtcccggggaacaactcgggagacaaccatagtcccgggggcgctaaaaccagtggtggagaaaagcacgccccacgagtcgtagttagtctaaagaacgaatgctcccaaacacaatttgtcgtgggaggagcatgatggga

SEQ ID NO: 721514 - DNA, 125 bp, Homo sapiens
gcttagcgatcagaactgggcgtcctctcgattctacagtaacgtcgaccgtcaatcctgtatgatgatcgactgccgcttgacattaaagtaaactttaagcattagccgtgagacctcccagc

SEQ ID NO: 721515 - DNA, 382 bp, Homo sapiens
ttagcctcatacgagtcccaccgctctctctgtggggagctgttcttgggggacgggtgtacgcccgggctctgtggacggactctgcccttagcctgtcgcctcctggacacacctcccgtcgtgctggagagtcccacgtggggcacagaggagaggaggtgcccggggctctgcatgccatgagagccaagcccgggctgggacactgactgtccggctctccagccagccatgtagtactactaatgcctcaacctctctgtgcctccagtttccccatctgtaacgcaaacctagtaccagctacaaagagtccacctctctctgagtcttctcagaccctccgggggctcctgccccagccccacagagagcgcgt

SEQ ID NO: 721516 - DNA, 465 bp, Homo sapiens
cccgaaagcacgggcattcctcgagccagcattcatgtagtttccaaccagcagggttatctccagcaggctggagaagctctcactcttgcgcagctcctcgcaggcagcagtgacagacacgatctcgggcttgatattctctacttgctcactgaattgtagtttgaagaggatggcgttgaggcgaggccgcagacggggcacagtgcccatcaccacgccgaactgctctgactcggctaggtcatcgtattcatccttgagttcagaaagcattttcaactgctccggctctggcatctgcttaatgagattctggatcatggactcggtgagaacagcttcattcacctccaggatgacattcttaatctcttgatagggcatgcggaaggaccccagaaagattgagagattctgcgccgtctttgagtccagcacctttaactcttttactttttt

SEQ ID NO: 721517 - DNA, 208 bp, Homo sapiens
gccacggagaagggatttgctctgttttgttgttttgtttgtctttttgctatttctttggaccgctccctcggcacatggaggttcccaggctaggggtcaaatcggagctgtagccgccagcctacaccagagccacagcaacatgggatccgagccgcgtctgcaacctacaccacagctcatggcccttctccggtggcgtggt

SEQ ID NO: 721518 - DNA, 279 bp, Homo sapiens
  misc_feature (82)..(82): n is a, c, g, or t
  misc_feature (106)..(106): n is a, c, g, or t
taaaggggtccccccagggtttttggggggagccgcctttttccacccccgccttcttttgggggccccccctttccataanaaagcccctgggaaaatttccacngaggcccccccctggtttttgggggggccccggggaggcccttttttccttgggggggggttttcccgggtttttttggggccggggccccccccccccccctggccttgggggggtttgcctgtcggttgaattaaaaaatttcttccccccggggccccccattgggggca

SEQ ID NO: 721519 - DNA, 347 bp, Homo sapiens
  misc_feature (18)..(18): n is a, c, g, or t
  misc_feature (47)..(47): n is a, c, g, or t
  misc_feature (55)..(55): n is a, c, g, or t
  misc_feature (112)..(112): n is a, c, g, or t
  misc_feature (312)..(312): n is a, c, g, or t
  misc_feature (325)..(325): n is a, c, g, or t
cttgtttgttatttgccntggtgaaatactgcaggtcagacactganttggacancgatttccttttctctgcgccaaaatgtcaaggaaagtcgcaagtctgtgattttgnctttggttttttgcatgttcgcttctatggaaaaacaaccacaacaacagcagacctccctgcccaaagtgttaaaatgcctccttcataacctgagacttacttttcattttctaggtgctgggagaatctggtaaaagcaccattgtggaagcagatgaggatcctggcatgtttaatggggttttaatgggagagtnaagtgttcaaatntgtggcaggggggggaccaagt

SEQ ID NO: 721520 - DNA, 729 bp, Homo sapiens
gggagtacagataccttttatatactgatttcctttctcttgggtatatacacagtagtgggattgctggattatagttctatttgttgtgtttttaggaagctccatactgttctctgttgtgactgtgccagtttacatttccaccaacagtgtacaagggttcccctttctccacattctcaccagcatctgatattgactgccttttcgataaaagccattttaactggagtgagttgatacctcattatagttttgatttgtatttctctgattattaataatgtggaacatttttttcatatgcctgtttgccatttgtatgtctttttgagaaatgtctcctcagatcttttgcccattttaaaatcagatttttttttcctattgagtcgtttgagattcttatatattctggttattaatcctttgtcagatattagtttgaaatattttctcccattctacatgttatatcttcattttatggtttctcattgctgtgtcagaaagctttttggcttggagagatctcatctggtcggtcattttattttattttcttgctttagattgcctggggtttggaggtcctattcagaaagtctttggcctagaccatggtccggggttttgcctaatggttcctggatttgttcctacaattcaggcttcgcctttcctgactggattggccgttgggttccctgggggccgagggggccc

SEQ ID NO: 721521 - DNA, 588 bp, Homo sapiens
agcgggctccggcgcgtgcgcgcgttatctccggccgacccgagcagccggttccctcctctccaggcccctcataaacggtaggaatggaggagaccggtcgacaccacaccggcggcaagaggggcacggagggccgcctcagggaatcgacggggaggctgttaaccaccttcgactcacggacggacgagccgcgacggaaaggcgagcggaaacgagagtcgaagcaagcaatcagaagacagcgagaacacaaccagaccgggagaacgaaacgcaccggcacaacccgggaagacgacagagaccgcggaacgcgaaggcagaaacacggaagactccgtgatagaccaaacctgcgggcgaacccgcggggcgagcgaaagaaatcagccacgcggcgcgtgcacgacgaatagaggaccgccacacacggtgatagaagtgacgcagagacacacacaaatcacgcaccacgacaacgacgaagcacgagaagcactagatgcgcgaccgagaactggcaaccgaacagacgacaagggtcggcacccaagagggggggacagtccgcacagaaaatta

SEQ ID NO: 721522 - DNA, 365 bp, Homo sapiens
tacgggatgatcatacatgaatcctgtccattccattcctttcccctcgggttgtcagttgtgttctactctatccattctatccattccattctatatccattccattccgttctgttcggctctgtgttgattcaataccgtttcgattcgattccattccattcctttccattccgtgcgattccatttcattcgggttgattcgatttgattcgtatgccattcgtttccattccattccattgcattccattcaattgcattgcattgcattggactcgagtgcattgaattgcattctatgccattccattccattccattctactcgtatggatgccattaatttcatttccattcga

SEQ ID NO: 721523 - DNA, 508 bp, Homo sapiens
tagcttattaagtatgcttttttcccgaaattgcatattaacaaaatcttggatatgtcagagaatgcattctaagttcactcaacctaggagggagaaacataattttaaattaagagctgaagcattcttgtcctaacacaaagcaaggaaaacgaaatatcacaccacaggagggatttcacaaatttgcgtcaacatcaaaaccttaaaataggcaaggagaatgcagattcacaatgaactcctgtacttgttttgttcagagaagagatggttctgagagaatgacagtgaaccaaccccagctggtttagttggtgctttcaactgctgcttctgatcaactcctttagctagaataaattgatgaggattttggcatgtggtattagagatggttattaattttttcctcttatttgcattgttcaatgtagtaaatactagctgctacttcaattcaaattaattacaatgaaatatacttaaatgttgaattttttaa

SEQ ID NO: 721524 - DNA, 204 bp, Homo sapiens
cgatctcatacgggtgctgtcccggcgtatactgtcgcgctcgcgccgtaagtgtgcggaactggtatacgcacgcggacgtccagaatccgtccgaccccttaaaacgcgtgatgaggttctacatcccacccttccggcaccaatgcttgagtacttagtaaacgattcgattccgccaagactataaccctcgcccaatcg

SEQ ID NO: 721525 - DNA, 972 bp, Homo sapiens
accacagctgtcggtccgtcggcctcgtggaggcatgccatgtgcccgaaaagatcactcggcctattcctatgaagaacacctgcgaatgatcgaggagtgtgtgaagatggccaccgagcaggtctatgaccaaggtcacaggccatcgcgactcccgtagaaccgagtacgttgcctgagaggagacaagagctcgggaactctactcgcgattatcctgtacgcggctgggtgtcgtggtctgccgtgcactgccgcatcatactcgaaatatggcctcgctcgtgtgatacagcaggtgtagctggcatgcgccgtggagtctcatccctactgaggggacccacgtagtttgcgtgacttcgagtaagcatacctttgtgaagcagtggtgaatcagcagagtgggcaagcaggcgaatggcgtgtcgcgaaaaggttgcgctctctgacgggccgtactggcatggcgtgcacgctggggaaagagcacatcccgagggacgtaccccgtggagctgcaacctgatatgtaggatcgcgtgtgccacgaaccacccaatccaatggaggcggagcctctgttatccggctgccaaagcgattcgcaggttggtcccagcgcagccgaagttagaggagggtaatcagtaccgggtaacccacgttgggagtcgtgcgtcatgctctgctcaaatgcttcgcggtgatgctatcaatgggcaagccactgagaggagagattcgggcgtgcctgttgtcctgcccgtggttgactgtgcggccctgtctgcgcgccctgtggtcaagggtgcctgcgttggaccgtaggacgatgtgacgccactaaccgcgctttcgggtcgcgtttcccctggctggtgcccctgggggcgtttctccaattgggccttgtagcggtccatctgctttgtggcactggttgtagggcgggcccttggggccccg

SEQ ID NO: 721526 - DNA, 210 bp, Homo sapiens
ctaaaaaaaaaaaaaaaaaagaaggggcagctcttgtctgcttctcacagagttgctagggacaactgctgaggcaggcacctgcccttcgggccccccggggggggcgtgctattggccatgtgggcccttgccttgcccgccttgtccaagtcgggtcccagagctcgaaattcggtaatctgggctcatagcgtgttccctggtgtg

SEQ ID NO: 721527 - DNA, 129 bp, Homo sapiens
  misc_feature (64)..(64): n is a, c, g, or t
gagtgctggtaagttccactcctgcaccataatacactcaacaaaaaatccaaaatgatcttgnataaagtataaatggaatctctagtttaagatccttcaggtgactctcttaccactccttagaat

SEQ ID NO: 721528 - DNA, 106 bp, Homo sapiens
tttttaagggatgcccaaacgggtgattcagggtccaaagatggtggccaggccaccccatcattgtccagcacctccgtctccagcattagctttgttgtcgacg

SEQ ID NO: 721529 - DNA, 139 bp, Homo sapiens
gcggccgcctactactactactgctcgaattcaagcttctaacgatgtacggggacatggaggatggtgtcctgaggcctccaaggacggtccccacccctctacgtttccccaataaagccttttaaaaacccaaaaa

SEQ ID NO: 721530 - DNA, 437 bp, Homo sapiens
  misc_feature (1)..(1): n is a, c, g, or t
  misc_feature (41)..(42): n is a, c, g, or t
  misc_feature (44)..(44): n is a, c, g, or t
  misc_feature (359)..(359): n is a, c, g, or t
  misc_feature (382)..(382): n is a, c, g, or t
  misc_feature (405)..(405): n is a, c, g, or t
naagcgatggcttgagctgtggagctccaggtttcggtgannangatcacaccactgcattccagcctgggcaacaaagaccctgtctcaaaaaacaaaacaaacaaacaaaaaaacccaaaaatgtatatatatatatgtatacatatatgtatgtgtgtatatatatttcaaatacataacataaaagcacctttccaaaaaatattagattgacaatggtgtattaaaataaacaatattctaattttcccagtcctttctgagtatatcagtaaacaagctgtctctaagttaaagtgtaattgcttttaattggatagtcatttgctaaaccttgggcaaagtctttttgggcntactgttaatcacccaacggttncttgcctgcccactggcacaggncaaatcagttaaggaaggagttttaatttaag

SEQ ID NO: 721531 - DNA, 489 bp, Homo sapiens
  misc_feature (22)..(22): n is a, c, g, or t
gagagaactagtctcgagcttnctcccttccttcttactttcctccctcccctacaaaataatttattggaacacacagttacagcactctatgtacaagcacattgacgctcctgactatgctcaactaggggacccttttcttaccccttggcttgcggacctattctattctttgaagcactggatgtcctgggccagggaatccgccctctcttttagagactcgctcttattttccagctcttttgactcaccagtaagagcctgctgctccgccctcttcatttggcggtacctataggctgctgtcttgatctgatacatttttttcaagttcttatccaaatcctgaccgtctatttgagtgagaccatttcgctacataggatcgtagggtttggacgggcacacccacggaaacacctgtggatgggggtttctatttggagagcccttggttgggctgggctgatgcccatccccctt

SEQ ID NO: 721532 - DNA, 518 bp, Homo sapiens
  misc_feature (121)..(121): n is a, c, g, or t
  misc_feature (123)..(123): n is a, c, g, or t
  misc_feature (125)..(125): n is a, c, g, or t
  misc_feature (131)..(131): n is a, c, g, or t
  misc_feature (138)..(138): n is a, c, g, or t
  misc_feature (141)..(141): n is a, c, g, or t
  misc_feature (143)..(143): n is a, c, g, or t
  misc_feature (179)..(179): n is a, c, g, or t
  misc_feature (190)..(190): n is a, c, g, or t
  misc_feature (199)..(199): n is a, c, g, or t
  misc_feature (209)..(209): n is a, c, g, or t
  misc_feature (219)..(219): n is a, c, g, or t
  misc_feature (281)..(281): n is a, c, g, or t
ctactactactacaaaaaaagcggccgctacgacatctcgccgtagttaccgacctgggaaacgatcttgacgacccaatccttcggcagtttcaggtccttgccgtactcgccgtcggcncnancagacnagcaacntcngngttcttggtcgacttggcttcttccaggacgttttncgaagtgatancggcttctncggtgttgancagcgcatancgacccaacgaacgatcttggtccactcttcgtcgccgttacgcaccactgggcccagaggntccttggagatggtttcaggcagaaccacgtagtccttcggcgaggcagcttgctgcgctgggcaacagctgggatttgtcgaggtcagtacgtcgcaacgaccggattccagcgacttgggcgctttcgtcggaggtgtcgaaggtgataggggtgtacttcaggccattggagcggaagtagtcggacacattcagctcggtggtggtaccggcctggatgcagatggtagcgcc

SEQ ID NO: 721533 - DNA, 1429 bp, Homo sapiens
cgtgacgcgtgggtcgaaccacgcgatcgcccacgcgtccgaccacgacgtccggcgccgttggcatcgtagagtgaacacaaaccaaaaacgatacgccatctgtatctgccctggaatgccatcagaccctaccagcaaatggatcatgtcataaaggtcatcgctatagaggaagttcctgaactatcctatcgcgtagtaagaagataaagttgaaaggctacaagaagaacaaggaaagctagtacaagctccttaaagaaacttacagacctggaaatgatatcaaaaaaggtctatagcctactcagccgaactgagagctggcaaaggcaaacactgacgaacaaccgtcgccgaaataacaagagcaggggacccagagccatcatactataactgcagggcatacatggtactccatacaaaggccctatcaggaaaacatccacatgagaaaataaactacatgcacaatacatgataaggcaaagacatgaaacacatacacgaaagactaggcacacccgagagatgcgagcaattagaggagaaccagctaacaaagacaataagagcgcaacacagacaacaaatggacgcaaaacacccgacgaaacgacacaagcgacccgacacaactaaagaaacacggaccacctcaagcagaccggcaccaacgcccgccaaacgaccaagcaaaggaagggtacaaatacacgacgagacatggtacagccaaaggacaacgaagagagatggacgtcacaaggagacagacaactacataacacgacgaagacacaaagacggaacaaagagcacaacaggaagaagagacagaaccgggacgaagccctaacagaggagcagaaacgagggagagaaaagcagacaagacaggagcgacggcacccacgaacacggcaaagacaagccacacagaggaacacacagcgatgggaagaaacacacagtggacagagcaacgagtacgaagcagcaagatgtggcacaagagaacacccaaagagagcacggaaaacaacaaaaaacactagagcaagggagccaacggacaacacacaagagcaacggagagggaacacaggaagccacaccgagcacgcgcggcagagcaccaacgagccacagcacagaagaacaggcgcggaggagatgcggggagccagcgcgaggcggaaggacaaaaggggaaaagaagcacagacgagaaacaaaaaagaagaaagacaccagaacggcaagaggacggacagacacaacacgcgcggaggcaaacgaggcagaacaaacaccgagagaaaagaataatacccaagaggcccaagcagagaaatagacaacggcagcagcgagagagacagaaagaacaacaagaacacaaaacaaacaaaagagcaga

SEQ ID NO: 721534 - DNA, 300 bp, Homo sapiens
  misc_feature (56)..(56): n is a, c, g, or t
  misc_feature (74)..(74): n is a, c, g, or t
  misc_feature (101)..(101): n is a, c, g, or t
  misc_feature (284)..(284): n is a, c, g, or t
tgatatgttgcccattccttatattccgactataatatttaatttgaacactattntttttaatcaggtatttnatattatgtggataatctgaaacatanaagtaggcctttagtggcattttaaccaaagcagagagtcaaacataataaaaaaaatgtgagaatttttaatgccatgtacaaaatcttttttgggggtgtttacctcataaaatgtatccccacaaattacaaaaaaatagtttcaagtgttttaaaaatatatattgcccatttgactcncaaattttatccccac

SEQ ID NO: 721535 - DNA, 241 bp, Homo sapiens
ccgcctgtcactcccaaggtgcagggattacaggcgtgagccaccaaacccagctgatacagtgtgttttcttggtatatccatgcatgtcgcatgtattagtacttcattccttttcattggtcgactattatccttgtatggatcaaccacattttgttatattcatatcatggtcaacatttgttgtaatatccatcttttagctgatatacacatagtgcttgccgtgaatctttat

SEQ ID NO: 721536 - DNA, 306 bp, Homo sapiens
tcctttaatcccattttatatttttttttcccaattttaccctttgaaaatattataacgggatattttttcaaccagatgtcctggatgatggtccataagaataatgaagaagtagttaaaaatgtatggccagtttttccggccaaatttggaggcttatgttttggctaaaaagccaaggggtaaaatgggcctgttgtttagggtttccttcctaaagagcccttttgtattgtaatttattttttattatgctttaacccctatgtaaataaccctttagtaataaagaattatcagtta

SEQ ID NO: 721537 - DNA, 371 bp, Homo sapiens
tgtgtgtgtgtgtgtgtgtgtgtgtgtgttctcattttcgttaacaagcatttggaagctctgttctgaacatgggaaatgcagtcatgggcaagagagagaaggggcctgttctggaggttgtaggcagtaggtaaacaagagtgtcaggtggtggtgatagctatgaagagaataaaaagacagtatgatagtgacttcggggggtgctgcttcggaatggtcatgaagatgagccctcttgggaagcccttgctgccagcagggcagtcaagcttaatctgtgggatggatgaaaatggcattaaacaaagtaagtgatatgctttagccctgagcatcttgagacgttcatccaaagagtagaactg

SEQ ID NO: 721538 - DNA, 350 bp, Homo sapiens
aagtgggggggaggggggagaaaaaaaaaactctggcgttagaggatatagaaaaatataaggcccattgtttccaataacgcaggcttcaaaaacaaaaaaatccccaccccaaccaacccaaattttaatggtcagaattggcagcccaaagaaaacgccctctcctgacttgtattgtggcagtttgaacgcccccagaaaattgggcccaagagtttagaaaaataaatattccattaaagttaacccataccccccaaacagccaacttcagggaactattttgggttgccaacaggataatttaatgttccaaccatttgataaaataaccctttgggaactga

SEQ ID NO: 721539 - DNA, 296 bp, Homo sapiens
gaaaccctaacttagggtttgaacaccctactacggagggcgtggagttgtgtccacttgagggcgattatggatcaagccatcatggaagtcgggatgtctcaaaaagcttttaccaagcaaaaaagaaattcaaagaatgcatttgggaattgattcacgtagtctagtcaccagcgtttattgtctccggtgtaaaagatgatgttgcaggggttcatggagcaggagaggaacctcgcgtgtgatctgtgctccagtacatgcctgtgtgttaccaaatagtgtgtgagatg

SEQ ID NO: 721540 - DNA, 204 bp, Homo sapiens
tgctgacaccacgacgcaacaagtcagcaatcatgaacaaacgatcatcacgagcaggcatcaaagcatcacgcaatgcttcatctgtcatatcatcataggtgatgtcatttaagccagttgtcccccattttcaggcgagcgcaccgcttttaacatggcttcttccctgtttcggaccaatcgccatgactttcgccggag

SEQ ID NO: 721541 - DNA, 135 bp, Homo sapiens
  misc_feature (44)..(44): n is a, c, g, or t
agtgctacctccacaaacagccctggcgacactgaaacacactncttactgacgacaccataacctcaggcctcgtggaggcatctacacccacccacattccactggctatacactgtttgtggaggtagcact

SEQ ID NO: 721542 - DNA, 405 bp, Homo sapiens
tccacaaaaaatacaaaattaagccaggcgaggtggcacacacttgtggtcccagctactagggaggttgaggtgggagaattgcctgtgcctgggaggtcaaggttgcagtgagccgtgattgcaccactgcactgcagcctgggtaacagagaaagaccctgcctcaaaaaaaaaaaaaattattttttaagtgccaagtaatactcaatacagaatatggtacttttaaagatagaatttctattctccgcctgtttccaaattaagcaaattatgagtacatattttaaattacagtctgggagaagaaaggggagaatataagttttaataaaaatcatttgtgcctctctaatctgtttggaatttgtcaaaaatactaataaattcctttactcattt

SEQ ID NO: 721543 - DNA, 816 bp, Homo sapiens
tgggctctagaagggggtacagggggtgctatagggtaaatacgggccctatttcaaagattttaaggggaatataattctaggacgatgggcttgaacctgtggtttggctccacagatttcaagagcattgaccggtagtatacccccggtcgtgtagcggtagaaagtggttgggtttaaacgtccgggaatggcactctgtttttaagcctaatgtgggagacagctcatgagtgcaagacgtctgggtgaagtgtaattattatacaaagtgggggctctcaaatcgggagttacatactcgaatgtgtcaagcgttcaaggaagttcgaaggttcgccgtggtctctaggaaataagtgggggaacgtatgtaggacgtcgaacaatttagttcccgacacgaaacatcacgacgcacacccccgaaaagcgctaacacgacacccacatgagcagcgagccccaactcacgaccaacagacgcagagcaaacacggcacgcgagaacctccgacaacaaccaccagaccacgagcccacccgccaccaccgagacccgccaaaacacgcactggaagacccacaacaccgcagaccccagcgaccaggaaacagcacgacgaccacgcccacacccgccacacaaccccgagccaccacccacataccccaacaccaccccgcccccaccaaaacccggcacccccaccatacagcaccccccacagccgcccccaaacacaaccaagacacaaccagccccccacccccacccaccccaccgacacacaccaaaaaaacgccaacacc

SEQ ID NO: 721544 - DNA, 150 bp, Homo sapiens
actagaaggaaatcagaactaagtcagtgtaagacagactgaatcatacgactgtgatgtgctacgttctgaggctcttgggataactccattagtagaaatcttgcataagccatcagtgttttgtggataacggcacctttaaggctc

SEQ ID NO: 721545 - DNA, 294 bp, Homo sapiens
gccatgggcctctgcgaaggcgccggcgtgcccacggcttaagaaacttcctctttctgctcccgggaacgaaggctgtagcagagaaggccttcaagtttcgagaccagttccagccgcagctgagcacttggtgaccttgaattaagtctaatgttgggattggaggcggttcagcatccgtgccgcctgggaagcgaccagtcaaggttacccacaggacggtctctggtccaggtccatgctctttgtcggtagtttgtattgtaaatggacatggtgtgtggaagtgtt

SEQ ID NO: 721546 - DNA, 385 bp, Homo sapiens
  misc_feature (16)..(16): n is a, c, g, or t
  misc_feature (69)..(69): n is a, c, g, or t
  misc_feature (155)..(155): n is a, c, g, or t
  misc_feature (195)..(195): n is a, c, g, or t
  misc_feature (330)..(330): n is a, c, g, or t
  misc_feature (358)..(358): n is a, c, g, or t
  misc_feature (382)..(382): n is a, c, g, or t
aggcccagaagctggnaagcctctgcgggttccgggaaaaggagctctgctgccactgctcttccgganctgcagcatggggccctgcgcgcaccgtggagctcttctatgacgtgctgtcccctactcctggctgggcttcgagatcctgtgcnggtatcagaatatctggaacatcaacctgcaagttgcggnccaagcctcaataacagggatcatgaaaagacagtggaaacaaagcctccaggtctgcttccccgcaaaggactatacattggaaaatgactttaaagctccttgagacaacaatttccagaattcccaatccantttccccaaggatttcttgggcctggtnatgcttgaaaaaaggaagtttgtntgc

SEQ ID NO: 721547 - DNA, 665 bp, Homo sapiens
agtagactgtacctgtgaggctcgcgggggcatgtggccatggatggccgtgctgaacgagctggtgtctgtggaggacctgctgaattttgaaaagaaatttcatgctctgagaaggcagtcaggctcggttgtccacagagctacgctaacgtttggagctactgcctggtgcctggtcgctgcgagccaagtacaatgactgacatccgtataaggcatcgtgctgctcgaggagctgctgcccagagttgagcaaggaggatcagcgggattacgtcttctagcctggccctgtgcgggacacgtacctgtgctctaatggaataacgcagacaggctcttacacagtagcagtcccgacggtgctttgcctagcaagagcgagcatgcccctcagacacatagccacggcgcaaagggaacctgcgacgcgcgctccatttcgtactagcgcgccattgcatcgcaataggatcgcgtactctgtcgggcatgggccatccgtgggcatgcgcatggcccctctgggatgctgtgcgtggactggggcggcactcctttccggagccctgtgcctgtgttcccaaagttcccaaatccctgagagggaccacgccgggagccccctcgggaaaccgcctcccaggaggggcctgtccatc

SEQ ID NO: 721548 - DNA, 414 bp, Homo sapiens
cactcgagatcccagtagtcggacgagatgcagattcttacgctcccctttgtgacttcagaagctctggcatctctttctgcaaggcactgaatgtgtctgcgtcccttttagcataatgtgaggaggtggaaaacggctcaaccccgtgtcaccggtgaccctggttccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagatacacggtaaga

SEQ ID NO: 721549 - DNA, 271 bp, Homo sapiens
gtgattacagtcgtttgccactatgcctggcccagagtcctatactggaagtaaaatgtacccccgaacttggcgcaagaaattatggatgtctgaatggaggtttccatactagtttgtaaaccagaattagtggaaaacagttcagaattgagttactcacaaagggtagaatgaagatagttaaggatgtgtgtatcccaaatattttcgtagaaaatgaaatgaaagacactgtgtatcttacctgtgcagtcatagaaggagcttt

SEQ ID NO: 721550 - DNA, 459 bp, Homo sapiens
tagctgtgacggcgtggactaggtgatgctgctacctctgtctgctgcactcacaggcacacttgatacacgatgacacctgcttgttaggaaacatctaaacatctagtagatgactagcaggctgttggctaccagtttcctgtctgaggtgtatatgttaacttcgtgatcagttagtatgtttgggactcttgtcctatgtaaagttaagggtgggccgggtgcagtggctcacgcctgtaatcccaaaggtgttctttgtatattctggatattaaccctttatcagatgcgttatttggaaatattttgtctcattctgtaagttaacttttctctctgttgattgtgtcttaggatgcacaaaaattcttaagtttgatatagtcccatttatcttattttgcttttgtttcctttcctttaggcgtcatatccgagaaattcttgccaaat

SEQ ID NO: 721551 - DNA, 267 bp, Homo sapiens
tcttgaaaccgtcctatttctgtggagttttattttaaagaaaaccttatttcccattataaaattatgcatcatttctattaaacaacacagaaaagcataagtagaaaacactgtgaaacaacatcatttatgtactttttttgagacagagtctcactctgtcaccaggctggagtgcagcggcacgatctcggctcactgtaacctccgcctcctgggttcaagtgattctcctgcctcagcctttcaagaagcaggaactgg

SEQ ID NO: 721552 - DNA, 858 bp, Homo sapiens
ggctgcgggagtggtgctgtgccgtggcctggcggatgcgaacaaagtgagcagtgtgctgccgccgcagtggaccctgcacccacctcccggtggcctgctgcagccggctctcgtctactgccaccatgaccgccaactggcacagcctgagtgctggtgcagatccagttctggcctcatcaactgcggcaacaatgtacctgacgtgcctgagtgcgttcgggttcaaggtgaactgcgtccgccagcagcctgaagaagaagcagatctggacgctgtgagcagccccctgactgagtgctgtggcatgctgctgggcctgtgtgccttgctgcagccacctgggccgctaccttggcggtggacaaggactggcaacgtgacctgcgagcgctgatgtgtgccctgtgtcccgactgcctgtttcctcatcgtggcgcacggacgactggtcgctggtctgctgcagtcctgaggcgcacactggctgctacttctggacgtgaccgaggaccgcctgtccttgcttcgcgcaggaggtgtccccgccgagaagttggagcttagcacatcgccatgcacctcaggtacagcgatcttacagtgtcaccctgtaagtcgctaagctgcaacctgaagtgcgcgtgacggacgaagaagatctgccgtgggccgcagaatgtgcccctgttgggctttcgacttcgctcataaaccctcgaccttccaaggaccagtgataacggggtggaaaccggcgacaccgattcctttgccccataatgctcacttttttggtgagcccgatcttgcattggaaacgcttagattcagtccggaagtagactccggag

SEQ ID NO: 721553 - DNA, 223 bp, Homo sapiens
tgtaataaaagcaatttcgatctctcagtactttcgtctatgcagcatcagtaatattgcctatacctccacttgcggatcctgttcttcatcgtcaaagagtaatctctttatccactgtgaaagcttccaagttgacttactctatgtcaaactgttcatcaataggcagcgtctccccattacgccatctgttgagctcatttacaagccactgaatagt

SEQ ID NO: 721554 - DNA, 113 bp, Homo sapiens
tcgtactgttctgcttctgccttcctgcttctgctgcttcctgttctgccccccccacgcccagtcccacatcgaggtttagttctggacttctgtgcaggctcttggtgagg

SEQ ID NO: 721555 - DNA, 463 bp, Homo sapiens
cctgtaagtctgaatctagagtatccacccctgcactggtgttcttagagagaaaagaattaatatgcaaaggaagttttacaaaaagacatgctccctcatgttggtgtcagtgatttgtgtgagaccaacaaaagcctatttcttgggatacatggttcataggttacttctggccagctttgggtagaagagaactatattacagagcatcactatggaaacgagagattggatcttgctgggccgctgcttgccattcttatttacgaggtatgtttagagaatttgcttaaagaagtgcggatctatgcacagaaatttcacttcgatcgaggaaatggatttctaacttgccagttggctcttatcacacggatcctatctgatggcctaaaatactctttagctactgcaaactggggtgatcaaaagaaagctcctcgtgccccagctggagtat

SEQ ID NO: 721556 - DNA, 135 bp, Homo sapiens
ccggtggtttgggttgctccccctaaatctggaaaggtgaacatgaacatccttcacaggaagagcttcgctcagaagaaacggaattgagcaaatgacgaagcagcagatcagcgcagctagccacatatgcga

SEQ ID NO: 721557 - DNA, 769 bp, Homo sapiens
ccggtgactgccttcattcagacccagtcagtctgcacgcagaccgatggctgacacatccctggagcacatgtgccgcctggacattgattcagcacccagtcagagggccggaacactgagcaatacatctgtactcatttgggcccagcttcccgaatcagtggagacgttgaacggagattgattaaagtctggaatgaatgtgcgctcgtctgaacttctctcatggaactcatgagtaccatgcggagaccatcaagaatgtgcgcacaaggcggcggagaagcttgctacatagagccccatcctcgtaccggcccgttgctgtggctctgaggacacattacaggacctgagatcgcgagaggtgggggtcatcaagggccagggaatctgcagcaggtggaggcggaagaatgggaatgccaggtgcctacaaaatcaccgtctggataacgtcctacgatggaagagtgtgacgagaacatcctgtggtggactacaagaacatctgcaaggtggtggaagtgggaggaaggatctacgtggatgatggggctaaattgtcttttccaggtgaaaggggagctggtgtcgaacttacctggatagacggaggtggggagacgccggttccttgggcagcaagagggtgtgaacttcgtggggctgtggggactgcctgtgtgtcgagaaggacattcaggaccggggtagggggcgacaggacgtgaaaggggtgcgattctcccggttctgaggcatg

SEQ ID NO: 721558 - DNA, 684 bp, Homo sapiens
aaacagcctcgcacaaaaagccaccgcccccgaaacccgcgggaaatctgtttcctgtgaaaggcctggacctccgtggcattggcgtgtttccctgatcctctctcccaaattttccgtgcagggtgatttgatcagatggctgacatttatggacttggtgtgtgtggctgatgtggatgtgtgctggttctctgtcccaatgttacatgtgtgatgtgactgttcagtgccaatggctgtagccacagatctgcagcctgcaccatgtagctctgcatggatgtgctgcctgtgtgacttctgacaccaatggctatgtgcaccaattcactaatgccactgcgatggatctttgtgtgaacctgcacatgacaccactactttgtgttttgtcccagagcacagttgagccagtggattgagttccagttgcttgacatctgacaacaacatcgaggcgagtttttgtagaacaacaacacatctatttctggaccagtggatgacggagaccactagttttgggaacctccagacaccaaggggacccccatcaccaagaatgtgggttgacctgcatgtgcagatatacccacacaagaattcaatccctggtggtcattcccatgcgttggagatcccacgtaattcaagtggatggtcctctctccaagatcggcc

SEQ ID NO: 721559 - DNA, 276 bp, Homo sapiens
  misc_feature (7)..(7): n is a, c, g, or t
ttccagnttaatttatattttttttggtaaaggacggcatttcacgatgtgggtcaggcgggtctggaacttctgacctcaagtgatccacccgcctcagcctcctgagtagctgggattacagacactagccaccatactcggctaattttggtatttttatagcgacagggtttcaccatatgggccaggcgggtctcaaactccggacctggtgatccgcccgcctcggcctcccaaagggcggggattacaggcatgaggggtacggagctc

SEQ ID NO: 721560 - DNA, 454 bp, Homo sapiens
gagttgggatgagattagaagggggtctggggccagactgtggaaggcccaaatgccgggctaaggagtttgtacttaattcagtggtcaacggggagtcattggaggctgttgagcaggagagttgctttctttacagctgtgccagactaaattaaacctaaacagtactttatagctggaaagggaaggcccaggaatagctcttgactcagaaacaggcattggggaaggtaatgagaaacagccgtgactgatcaaagcagagaggttaattaaatttgtaattattgtgaaaggccattaaaaaccctagttcactagagataactgctctagtggggcttcaaagacaaatgcttcttttaaccttgaatagggggatgtttgcttctctgtggaggagatatgattaagatacttaataaatggtagataaacatgaaaaaaaaaa

SEQ ID NO: 721561 - DNA, 883 bp, Homo sapiens
gggagtctggttggatgtcatttgaggtccattgtcacttgggtgcttcatgttgtcctccgatttttagatgattatcctgtctagagatgtcctactctgctcactggtctggtggcggtagggtaccctgctggtcctcgacaagccagagggtgcacctacgtacagacgacgactcctggaacagtgcttgtggtagggcctgcaatctgttcgctgctgcacccacacgccgcatctgctgctggtcgatcaactgtggttcgtgaggcagctgccgaaccaccagcctttctggtgctgttctcctagttcacgtctgccgagctggtgagggcggaggcgagacctggtcgagacccagcgcccctcctccctgcatggagcatggtgcagcctcacacttgaagagacggtgttgggtgtcccatctaatcaacttaagggagagccggcgatgttacccttcaaggaccgctgttggatcacctattttcctgatcagctggtaataaactgagggtggcttttagagacccagacttggttggcagcgctgccatggaacaccccagcaagcagctcccagcctgcctttcggagcagcagccacgaggggatgccgcgctccagcagacaccaggtcgtgcctgtgctgaacccctgccctgccgctgcagaaaatcctgaagcatcccttaatgcttctcagtcttcagcccagcacggagggctgttgtttccagaggtgcgctgtttatgtactataggctagatgtggctgcttcttgtggctttatcattaatccccatgttgcgcctgagtttcacgctgactccaaattttgttttttaacaaaaagggggcaaaccccagggg

SEQ ID NO: 721562 - DNA, 432 bp, Homo sapiens
  misc_feature (8)..(8): n is a, c, g, or t
  misc_feature (25)..(25): n is a, c, g, or t
  misc_feature (53)..(53): n is a, c, g, or t
  misc_feature (59)..(59): n is a, c, g, or t
  misc_feature (62)..(62): n is a, c, g, or t
  misc_feature (64)..(65): n is a, c, g, or t
  misc_feature (110)..(110): n is a, c, g, or t
  misc_feature (119)..(119): n is a, c, g, or t
  misc_feature (123)..(124): n is a, c, g, or t
  misc_feature (133)..(133): n is a, c, g, or t
  misc_feature (156)..(156): n is a, c, g, or t
  misc_feature (167)..(167): n is a, c, g, or t
  misc_feature (173)..(173): n is a, c, g, or t
  misc_feature (176)..(176): n is a, c, g, or t
  misc_feature (182)..(182): n is a, c, g, or t
  misc_feature (184)..(187): n is a, c, g, or t
  misc_feature (190)..(190): n is a, c, g, or t
  misc_feature (194)..(194): n is a, c, g, or t
  misc_feature (199)..(199): n is a, c, g, or t
  misc_feature (206)..(208): n is a, c, g, or t
  misc_feature (216)..(216): n is a, c, g, or t
  misc_feature (219)..(220): n is a, c, g, or t
  misc_feature (226)..(226): n is a, c, g, or t
  misc_feature (232)..(232): n is a, c, g, or t
  misc_feature (235)..(235): n is a, c, g, or t
  misc_feature (245)..(245): n is a, c, g, or t
  misc_feature (253)..(253): n is a, c, g, or t
  misc_feature (255)..(255): n is a, c, g, or t
  misc_feature (258)..(258): n is a, c, g, or t
  misc_feature (261)..(261): n is a, c, g, or t
  misc_feature (265)..(265): n is a, c, g, or t
  misc_feature (286)..(286): n is a, c, g, or t
  misc_feature (299)..(299): n is a, c, g, or t
  misc_feature (328)..(328): n is a, c, g, or t
  misc_feature (333)..(333): n is a, c, g, or t
  misc_feature (336)..(336): n is a, c, g, or t
  misc_feature (342)..(342): n is a, c, g, or t
  misc_feature (352)..(353): n is a, c, g, or t
  misc_feature (413)..(413): n is a, c, g, or t
cgaccgcngtctcggagcgaaattngatctccttggacttgaattatgaggangaggcngcngnngcggcggcggcggaggcgctcggctggggaaagctagctgtagangctcagctncggnngcactcgcnctctgctgctagctcattttttngacgctacctnctggtnctnctgatncnnnntgngctnctgangggaggnnnggggggcncanngagctntgtctngcntactgagctntgctgtgntncgngancttngtggcgatctgagctctgttngttggggtgttcnttgtttgctgctttctttcttcatgttgngtttnatntttttntttttttttnnttttttttttttttttttttattttttttttttttttttttgttgcttcttttttatgtncttctttatttttttaaat

SEQ ID NO: 721563 - DNA, 834 bp, Homo sapiens
  misc_feature (1)..(1): n is a, c, g, or t
  misc_feature (3)..(3): n is a, c, g, or t
  misc_feature (11)..(11): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (20)..(20): n is a, c, g, or t
  misc_feature (36)..(36): n is a, c, g, or t
  misc_feature (49)..(49): n is a, c, g, or t
  misc_feature (55)..(55): n is a, c, g, or t
  misc_feature (60)..(60): n is a, c, g, or t
  misc_feature (67)..(67): n is a, c, g, or t
  misc_feature (85)..(85): n is a, c, g, or t
  misc_feature (104)..(104): n is a, c, g, or t
  misc_feature (107)..(107): n is a, c, g, or t
  misc_feature (134)..(134): n is a, c, g, or t
  misc_feature (138)..(139): n is a, c, g, or t
  misc_feature (143)..(143): n is a, c, g, or t
  misc_feature (172)..(172): n is a, c, g, or t
  misc_feature (174)..(174): n is a, c, g, or t
  misc_feature (182)..(182): n is a, c, g, or t
  misc_feature (186)..(186): n is a, c, g, or t
  misc_feature (191)..(191): n is a, c, g, or t
  misc_feature (215)..(215): n is a, c, g, or t
  misc_feature (222)..(223): n is a, c, g, or t
  misc_feature (225)..(225): n is a, c, g, or t
  misc_feature (231)..(231): n is a, c, g, or t
  misc_feature (266)..(266): n is a, c, g, or t
  misc_feature (269)..(269): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (286)..(287): n is a, c, g, or t
  misc_feature (293)..(293): n is a, c, g, or t
  misc_feature (298)..(298): n is a, c, g, or t
  misc_feature (307)..(307): n is a, c, g, or t
  misc_feature (314)..(315): n is a, c, g, or t
  misc_feature (317)..(317): n is a, c, g, or t
  misc_feature (319)..(320): n is a, c, g, or t
  misc_feature (323)..(323): n is a, c, g, or t
  misc_feature (334)..(334): n is a, c, g, or t
  misc_feature (337)..(337): n is a, c, g, or t
  misc_feature (370)..(370): n is a, c, g, or t
  misc_feature (382)..(382): n is a, c, g, or t
  misc_feature (389)..(389): n is a, c, g, or t
  misc_feature (408)..(408): n is a, c, g, or t
  misc_feature (437)..(437): n is a, c, g, or t
  misc_feature (466)..(466): n is a, c, g, or t
  misc_feature (476)..(476): n is a, c, g, or t
  misc_feature (690)..(690): n is a, c, g, or t
  misc_feature (727)..(727): n is a, c, g, or t
  misc_feature (743)..(743): n is a, c, g, or t
  misc_feature (808)..(808): n is a, c, g, or t
ngntcatttanatntnantnaagagcggggcccagntttaacatctcanaagaangaagnaaggganaaagggaagggccacgcncccgggccacgggggtccnggnaagcccccagccactaggggccaatcncccnncaanggaccccttcttccccagagggcagaagngnatgaaganaggnatganagggacacatgcaggagcgaatanacaaaannanaaaagnggattctggcatcaccacatctgggctcaacaggnggngngaanggngggggggnngggggnacagncagcctcgntcaaagnntngnngancacggggctanatnccagagggaccttcccagggccaacggccacanaggacagggggngcttccnccagggccccccaaagggnttcttctgtggcccctggatgggcttggnggaatcggactcatcaatccgcacctggnagtcttcccnggcatgcgcgccccgggactccttccgggcctctgctccggagaggggctgcagcgcacacagcatcagggtctgcagcgccagggtctccaccaggtccgtgttccagaccattccccggtcgaacgtcttcaggtgctttaggtctccatagagcttgctgattttcccacaaccttcttgcaacacgcttcccacacggaacacggcagcntgattttgcattgacttctgcatgctgagtcgcagtnccgatgttcttatgcntccatcagcaaatctcaatttgtcaagattcatgacagattcttcccagcgtttggttaattggngggacttatctcaggcctgcatgact

SEQ ID NO: 721564 - DNA, 142 bp, Homo sapiens
  misc_feature (2)..(2): n is a, c, g, or t
anagtggtagagagcgagggagtgagtgaatgagtgggctaaagagggccgggtgcggtggtcacgccttgtaatcccagcactttgggaggccgaggagggcagatgatctgaggtcagcacgttcgggagcagcctggtc

SEQ ID NO: 721565 - DNA, 850 bp, Homo sapiens
ggccgggcgcgtggctcacgcctgtaatcccagctctcagggaggctaagaggcgggaggatagcttgagcccaggagttcgagacctgcctgggcaatatagcgagaccccgttctccagaaaagggaaacaaaaaaaaaacacaaaggaccaaaaaaaaaaaaaaaaaaaaacaaaaaaaaaaatttggggcgcccgctcgggcccaaaaaaagtttttaaaaaccaattgttgggggggcgggcgccccaagagtggttagatgaacacgtgaggcagaaggcgttgtgcccaacaaagagaaacctcggcggcgccaaaacacaacggcggtgggggggattcctccccaatattaaaaaaagggccgcggggggacaccgcaaggcgtttcttagaacaaaaatcaccaagaatggagacccagaggaggacacaaaaccggggaggacaataaacacacaaggggggggcggccacaagggagagaagccagcccagagtaatacaacaaaataattaaacaccccccccgtgccagggggagggagtaccccaacaaccaacacaaccgacaggcgaagcaaacgagcgcggacgagcgccacggagccagaagacagaggagtaagcaaatagcagagtaggaggagagaagcagagagcacaggcgacagcagatagaacaggcagacggcagcgggagcagggcaagacagagagggcagcgcgagacgacaagagaagaaaaccgccacgagacgaggaagcggaaagacagcgacgggacgcgcagagcacagaggccgagagacaagggagcagcgaagaaaagagaagaaggccca

SEQ ID NO: 721566 - DNA, 729 bp, Homo sapiens
  misc_feature (422)..(422): n is a, c, g, or t
  misc_feature (424)..(424): n is a, c, g, or t
  misc_feature (584)..(584): n is a, c, g, or t
  misc_feature (601)..(601): n is a, c, g, or t
  misc_feature (609)..(610): n is a, c, g, or t
gtaataacatatctttctataccttttttcattattgagccagaaattacgattgaagaattgatttcagtgtttggctgaagcaagttttgcttcatttttgttattggttaatttcaggaaactatatttcatttacattgttgagcctcttgttcagcctactaatgtggttggtgcttaacaaatgttgtatggatggatagatggatgaataactttttaacccgatttctcccactttgtccttcacctgatcctatccttaggaatgaagaaggtggttgattgaaaagcaagcactattagccctgacacaggataatttatttcccacacccatgcccaagtcaaacgatgaatgagcaaaaagtagcatatcagtaaagttgccagatttagcaaacaaaatgcaagatatntngttaaatttgagttgcagatcaataatgaatcatttcttagtacaagtacatgccaaatgacacacttgtatttgaatggcagttttgcataccaactaataccaatggtctagagaactgtgagctccttatagctggtggacttcgtgtcatttattntactttatggcaggttngcctattnnatcagatccttgcaactttctgcatcatatggcagtggttctcagcaatgtggcacttggcataagtacgcatcagcatcgccttggaactgatccgcaaatgtgagttcttgagaccc

SEQ ID NO: 721567 - DNA, 542 bp, Homo sapiens
ggcagcctatgtcacattctaatccctactccccatacctgtttcaactatattgggcaaactatgtatactagctggctgtcagcaatatctgacttctgcaccatagcgatcaggctatattactacaacagaatcttctctatatctatattatatgtgtacgactcgcttggcctctagtgacactacactggctaggcccaacacgctttgcctacccacaccctgcctccttacacgcgcaccacttacactctcaatgatcaaccccatatatcttcaagcctaactttctttaccaccctcttagctacctcttacttcccacgcagctccataatctctccaacaacaccttaatatctaactctacgctttgcaccctaccaggctaacccactggaacgacccacacaacaccggcttccacactacgcacccaacttaacccactacccctctccaaacacgcagctttcacctcgcactcaactcgctaggctattctcactcacttcgatgccccctctaaccctacg

SEQ ID NO: 721568 - DNA, 565 bp, Homo sapiens
  misc_feature (21)..(21): n is a, c, g, or t
  misc_feature (75)..(75): n is a, c, g, or t
  misc_feature (125)..(125): n is a, c, g, or t
  misc_feature (134)..(134): n is a, c, g, or t
  misc_feature (149)..(149): n is a, c, g, or t
  misc_feature (159)..(159): n is a, c, g, or t
  misc_feature (171)..(171): n is a, c, g, or t
  misc_feature (174)..(174): n is a, c, g, or t
  misc_feature (188)..(188): n is a, c, g, or t
  misc_feature (191)..(191): n is a, c, g, or t
  misc_feature (235)..(235): n is a, c, g, or t
  misc_feature (286)..(286): n is a, c, g, or t
  misc_feature (292)..(292): n is a, c, g, or t
ggaaacccccccacaaggggnaacaaaaagctgggagcctcccaccccgggcggccctttttagaactagtggancccccgggcttgcagaattcgcgcccgcgtcgactacggctgcgagaagnccgacagangggatcccaggtgancagaaggagntgttggaggctntgnccttgtagagcccnccnccctggtggttgtgggcattgtgggctacgtggaaccccccggntgccgagaagacgacagaagggaggggagatgcctgtgtgcgtgttctgangggttncccactaatggagagactgactctctccataagtatttgatttttactttatctcctcgttgacttcacagtgtaagtgcagtttgtctctactgggtgatgcatgcagataaatgtttatgtgaacataagaagtctgcatgtgtgggtgaactctccacatcatgtcatttattgtccatcattacgtatctgtggtgtctagcacattcctctaccttattttctgtcattgtacctacttctacctgaacacgtattaaatatcttatt

SEQ ID NO: 721569 - DNA, 867 bp, Homo sapiens
  misc_feature (229)..(229): n is a, c, g, or t
  misc_feature (314)..(314): n is a, c, g, or t
ggcccgaccggctatgttttctgtggccccccctttcctagtcctggaaaccccccccgctcggtttttttgggacacgcgccgccgttttgtcccttggtgcttgggaccgccccccttctgtaggagggcggtcccaacgagtggcgcagtcacagagattgcccgcagacgttcttgctcctcgagcctctacttaagggaacctcctctccttgttgctcactcncgcggccgcgctttgtgtcactctgcccccacgacgattgtggcgcgcgctctcaaggaggaccgacgcgtatcatctctctatntggcgagatgccgtcgccgctctcgtagcaatctcattcgagcgaatactcttcttgtcggaacacccacacatacgctccctcaccataactctcgcgcatttgccaggacttgcgcatgatggtatgtggaaacacaccattcgttctttttgcacccgccgcctatatacaaccatcacacatgtagtgcatttcctgtcccacaacatgtagcatccaccagctccccacgcgcgaacaaattaattttgttgcacgacgctccatatccacaccactcgcccgcgacaccaacttgtggagaacccacctccttcggcgcccactcctctgcttcgccgcccaccattatcctacgcactgaggccacccaaaaattctgtgccacccatgatcaattcaccaccaccttattgtcgatttattgacaaaccactgcgtcattttaatgcatcacaacaattctactttctttacacaacaacaatcgccctgaactaccatatgaccacccacaaattgcaaccagaaaataacaaaatagacaaca

SEQ ID NO: 721570 - DNA, 292 bp, Homo sapiens
tctagaggatcccgtgtgtacgagataagggaggagacttgagcccaggagtttgaggctgcaaggagctatgatcatgccagtgcatcccagctctaggtgagacagtgagatcctggtctccgaaaataaatcaatcaatcaaatcacagaccaaagtcacaaccgcacatcatggatctctgcacaccccttccacattttgccagtctaccagcgacttagcataaaccctatctccctatctcttccaccagtgaattcactcctttcaacaaaggctaagtgtctt

SEQ ID NO: 721571 - DNA, 539 bp, Homo sapiens
gagcccttaggggaagagtcctgctctggctgttgatgctccagctccagaaatcccagtacctgcatctgggactcggcagaggccagtactatggcagggtccctgccccaaacgctgaaaccatgcatcgcggagatggcaccactggacctgcccttccaagaccccgcttccagatccgtcggtgcctggacaacaccagccagtgaccacactcggcgaacccatgagggctgagtggacagcggtgtaccgggaagcgtggccggcatcggatccccacaccgcacggcacccatgtcagatggacaaagcacggcacggcaggcccgacagcctgcacccattatggcaacaccaatgggtaaccgttcgttcaaccgcaaacccacggcccggggaaccaagccacaaggcccttgggcgaagcacaaccgggaacccaaaagttgtccttggaacccatccccgggaccaccttggtaaatcccaagggaaagcgatgacactggcaccgcccacgacaggcaggccca

SEQ ID NO: 721572 - DNA, 244 bp, Homo sapiens
agtcggtaccctgtgaaccctgcgtgcgatatcgatacgccatggaagcccacaccacttacggtgtgatcggtgtgaaggtttggatcttcaagggtgaggtcattggtggccgccaggaagagctcaagcccgtcgccccggctccgcgcaaaaaagctgctgctaagtaaggagtacgcaacatgctgcaacccaagcgtacaaaattccgcaagcagatgaccggacacaaccgtggtct

SEQ ID NO: 721573 - DNA, 710 bp, Homo sapiens
  misc_feature (104)..(105): n is a, c, g, or t
  misc_feature (376)..(376): n is a, c, g, or t
  misc_feature (383)..(383): n is a, c, g, or t
agcgggctgatgcggccagcgcccgggcctgcgggcccgggcggcggctgtgttgcgcagtcttcatgggttcccgacgaggaggtctctgtggctgcggcggnngctgctaactgcgccacctgctgcagcctgtccccgccgctctgaagcggccgcgtcgaagccgaaatgccgccaccccggaccggccgaggccttctctggctgagtctgggtctgagctccgtctgcgtcggcctcggatccgaaacgcaggccaactcgaccacagatgctctgaacgttcttctcatcatcgtggatgaccctgcgccctccatggcttgtatggggataagctggtgaggtcccccagataggaccaacttgcatnccacagncttcttcttcaaaatgcctttgggcagcaagcaatgtgcgccccgagccgcgtttctttcctcactggcaggagaccttgcaccaaccggctgtacgaattcaaactctacttgaaggtgcacgcttggaaacttcttcaacattccccaggactttcaaggagaatgggctatgggacccatgtcgggtgggaaaaagctttcaacctggggatatcttcttaacaataccgatgaattctccggataacttgggcttttccaacctattaatcctttcctttgagaagtttgaaaacacttaagacatgtccaaggcccaaatgg

SEQ ID NO: 721574 - DNA, 215 bp, Homo sapiens
  misc_feature (22)..(22): n is a, c, g, or t
tacatttccagtgttcctgagncaatcttcaggtattccaacatagcattatcttggagcatcccacggtgttccgcatgccacgacctggatccggtcctcgcactggtccctggggaagtttggggtggtccatcactctttgagggatcagccgctcagagctgaggtacccggacttgtgcacttctttgttgtagtccccaaacttgggc

SEQ ID NO: 721575 - DNA, 246 bp, Homo sapiens
tgctccccgacccccagccgggacccctcattcccctccccctacagggatcaagtgccctgggaagaaccgagtttaaccccaggatgtgtttccttagatttcctttcctaggcgatttccagggagagccctgattggccaatcccatcccagatccccctgcagtttccatgttagccctggggatgggtttttaatcaataaaaactgggggttttttttccccgcctctccccttgccca

SEQ ID NO: 721576 - DNA, 541 bp, Homo sapiens
  misc_feature (499)..(499): n is a, c, g, or t
cactgcactccagccagggtgatagagcattatctgtctcaaataaataataataaagaacagggaaaaagaaagattatttaatatctcactaccctgaggaagtcagttaccctttggctatcagatatcggaggaaataaggttgtagaggaaaaagtcgttaaggtattttaaacagacatttgtttcattatttggaactcaataatagagactttaagtacaaattgtgagtctaggagaatttttgatttccacagatgagaaataaaataagaatatagacattgttggactttgaaagcttacccaatgtttaatagtttgctgaacaattgccaaatgaaatgctttcaaagtttctgaaaggcacaattctcttcttcctgagctcagaacattttggtcataatcatgagcttagaaatgttctgaagggagtacaggaccttcattagcaataaaataatatatatttccaatgacactgaaagtntcctatcctagctacatatacaaactaggaaacagagggggc

SEQ ID NO: 721577 - DNA, 630 bp, Homo sapiens
  misc_feature (320)..(320): n is a, c, g, or t
  misc_feature (348)..(348): n is a, c, g, or t
  misc_feature (352)..(352): n is a, c, g, or t
  misc_feature (355)..(355): n is a, c, g, or t
  misc_feature (389)..(389): n is a, c, g, or t
  misc_feature (392)..(392): n is a, c, g, or t
  misc_feature (414)..(414): n is a, c, g, or t
  misc_feature (416)..(416): n is a, c, g, or t
  misc_feature (451)..(451): n is a, c, g, or t
  misc_feature (471)..(472): n is a, c, g, or t
  misc_feature (475)..(475): n is a, c, g, or t
  misc_feature (481)..(481): n is a, c, g, or t
  misc_feature (495)..(495): n is a, c, g, or t
  misc_feature (497)..(498): n is a, c, g, or t
  misc_feature (505)..(506): n is a, c, g, or t
  misc_feature (510)..(510): n is a, c, g, or t
  misc_feature (513)..(513): n is a, c, g, or t
tgggagggtatttttaattggggggtccaaaaaatctgttatatccagtctatgtgtttacaattggtgtggtaagtaaactacagcttggagtgggaaagaagtcacgggtggtaaaaccattgggattttttataaaacaaaagtattaataatcgggaagacagtgttggcccaggtcaggagtgtttcctggggggtcccagcccccatcaattgaactggttccggggctcagtcagacacagacatattcatctgtgtctgaccaaatcaggggacttccccacctgtggtgggaggcacagcttagatgtttngtacacctggtcttttctagaaatcccngctnggngctgcagaagggttgccttctgtaggtcggaggnatngaggcttactaacccaggaagncntctatgcatccacaccaaaatcctcagaatgtaantaagctctgcttataagatnnggntcaccntcatcgcagactgnanngttcagnntttnatnttttgtcagagagcacgcgaaaattatttataatagtctcgagacaaaacacactgtaatatttcagtgtatgagtagaatgtactgtaactgggcccttccccatgtctaggttcc

SEQ ID NO: 721578 - DNA, 120 bp, Homo sapiens
cagtgccatgcaactcgtataaagcatgtggaagcaaggtgggatagagctagtatgctgagtctaccacctttcgtctttctcctgtgctggatacttcttgcccttgcacaggcagcc

SEQ ID NO: 721579 - DNA, 767 bp, Homo sapiens
gacagtgaccgccaccgttgccaagggatgggtccctgagacttggcgaagtgggagccctgtgtgatcgtgcgtcagagtcggggctgagaccagccccggccaggtagttaccgggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagcttgtaccaggctgcagtgcagtagtgccatctcagctcactgcaactctgcctcccgggttcaagagatgtcctgcctcagcctcccgagtagctgggattacaggcacatgccaccacacccagctaatgttgtatttttagtagacacggggtttcatcatgttgcccaggatggtctcaatttcctgacctcgtgatccgcacatctcggctcccaaaatgctggattacaggcatgagccaccagaaaccggacatgctttcccttaaaagctaaatattttaggcttgtgtgcattaggctctgttacaactacttaattctgtttgtaattctatagcacccatgtaatactaacaaatgagcatgaatgtttctcagtgaaaatttgttcacataacaggcgggcaccatgaaggattaggctgtgaccctggttaaacatcatggttccacgaataacgattttttttgacagtgaacattccaggcttcacccttgtgaca

SEQ ID NO: 721580 - DNA, 566 bp, Homo sapiens
aggaagcgggtagtcgaccgtgtctgcgcgcctgggagacgctgcctcggcccgtgactgcgcgggggccccctgtggctggagtgtgtgtgtctgccacatgtgtgacactgtgaaccacggagtgatgtctggagctgcctgcgctgcccaggccatgtgacttgtgagtgtcaacaactgtgttccagcctcagggatgagtgcatcacaaacctactggtgtgtgtggcttcctccaaagctgttctgacaacagcttcctgcagagagctggacgcactgtggccacgatgctgccagtgctggctccccatgtgggatgtggctacgatgagctgcagactgatggcaaccctgcagcatgccactcccgcttgggaagaatagatggcagattctgaaagtcaagaagacatcatccggaactattgccatggcaccatcgcccagtgtctggggacagcatggacctgtagcatccctccgggcctggtgaacgggcctggccctgccagctcagtgaacaccagcctggtcggaggaggaccggaacagggaccttc

SEQ ID NO: 721581 - DNA, 766 bp, Homo sapiens
aagtagcattgctttgagtcacataaggatgaaatattccaggttcaagctgggtcacctcacaatgagacgtagttatagcttccaggtggtactgatcgcagactgaatgtctgggatttaacgtaaaattggagaggaacaatgccctagaagatgtcagacagacgggccagcagagtagtgtttattcacaggtggtcatactgccaagatatctgatttctcctggaatcccaatgaaccttgggtgattcgttctgtatcagaagacaatatcatgcatgtgtggcaaactggcagagaacatttataatgatgaggaccctgaacgaagcgtggatccagaaggacaagggtcctagatatgtcttcacttgtcgtgattgtaggactcccctttgaacttctgcaatccatgagagtgattgaacacttggttctgagacaggactttattcagcgtatccctctgatataataggtaccaccgatcatgctgatgagcccaaacccggggtgtgactaacttattaataggggggcctgatttaatcaacgccacagtacttaacgttgaccattttcttcagcgaatcttctagtaccccaggtctacaagtacctacgccaggcgactatgatgtgtgacattctgctcttatgctttatcgccaggttctcagactccattaagtaacggctagagtgacgtcggactcgagcccctgacgtaggtagcggatcctgacgctaatactggaga

SEQ ID NO: 721582 - DNA, 992 bp, Homo sapiens
ggtccaggtgtttgtgggacgtagcgttgtacctgcaggctccgccacctgcgggacccgcgcattctgtccctcagtcaggcagacgctctgtcccgaccgggcagactctgccagcgcaagcgtgctggagagtgcgataccacctgtggactgtgcacgcccggagtttggatgcctcttccatcaagtggacgctgatgtgggaggatcaggatgaagaacgctgaatatgttgaagttgagcctgaagctaaacaggaagattcttgaaaataaagatgtggttgttcaagatgttgattaggatggacttggaaggactgaagatgatatcgtcatgagtgcaaatatggcagatgtttagaaggccatatagacctagttgaggtatatgcgtgagaagtctacactgatgcccgtgaaacaacttggtccgtctatggaaacctttccacgactagtggatgtgtgatcgacacatgtcaaggtgatgacgcacttaccgagatgggcttagacgcttacccttaggaatgtaacttgagatcgaggagattaacgggcaagttagtaataacgcatgggttgtgaccacgaatgaattggcattctgcgtgacttgggcgaccaagcgttccttaatctttcgtatgcgtctggtgcacgcaaaccatggtgagcttttcagccttgccctatggaaagaaaagaaagccttcggtagtagggtcctgtcactttcttcaacaaccacggtgccgggagcacttcctgaacgaaaattcttctgttagcttgcttttaaagctttctggacagttccctggtatgcccaacctgcgcgcacgagcgacgtatgaatggcctcagtcgctccagttattccattatgaggcccgcccctgtaaggggagacgcaattgcgggaccggtgctctaagcaggggcttcttcgaagaaaggattacgacgatttgccaccgtccact

SEQ ID NO: 721583 - DNA, 158 bp, Homo sapiens
gactgctgcagctgggactgaccgggagctctgattgtttaccaccacaggtaggttgcgtcctgagtctcaggttcacaggttaaggctacagcttcctcatcctccacgggcttggagttgttgctggtgatgaagggtttgggtggctctgcaga

SEQ ID NO: 721584 - DNA, 702 bp, Homo sapiens
  misc_feature (344)..(344): n is a, c, g, or t
  misc_feature (479)..(479): n is a, c, g, or t
gtactccaggctcggagccttagtgaccatcacctgcccacctaagcccacggtgctccctcctggtgaccccactcctgaaaccccctgcccctgcctcccccagccctggtgcgccggggctctcctgccctgctcccgtcggtcccatcctcccgttgcagtgcgcctgtttccctgtgcattctgacgtccaccgctgcgatctattcacctcgtccgtcctcgcgacgaagctttctgtgtggcttgtcaatgtcttgtcagatcttatcatgggccaagtcagcaaccactgatgcgtgcgatgtgcctggcagacgctggccaattagtagaagcanagcatgcgcctgagctgtgtgtgcgatgtggatgtgaccctgtgagctgcccgtggtgtcgcccagccgggcctgccggatgctgtgatcgctgtgcctgtgccagtgccatgtgttccttgttgtgcgcttgantccacacacgtgacgtgaagcataactcgtgtgggtctacccatagaagaagaagaacctttgggatgtgccactccagcgtccacgtgtggacttctccttgtagtggaacagcgctcagacgatgtgcgccccacccgaagagttgagccccagtggcaagggactcccaataagtgccgcaaggaagcaggaatgttcgctcttactagtggaacgagag

SEQ ID NO: 721585 - DNA, 226 bp, Homo sapiens
accaggacttcacattaatttccaaaagtatcatagggactagtgacactacaagacataaatctattataaaatatatcggcctttctcatataacctactctagtattatagtattgtgtgtgcgtgcgtatgtagatgtcaggctagccaacgtaaaacttcaaagaaaaatctatcaaagcagaccatccttattttgcatgctctattctacgtagaatgt

SEQ ID NO: 721586 - DNA, 1562 bp, Homo sapiens
  misc_feature (277)..(277): n is a, c, g, or t
ggcaggttcggccggccggccctcagccacgcatgtgcggcgtctgtgacccgcggaagccacgtcgccagcattggtgaggatcgtgatagtttacgagcctaggtcgtacccagagagcgagtaagccggtgctagcgagcggggcgtgtgcgaaggcggcggatgaatggtgttccgagagcgagcttccacactcacatccggtagaaggcttcactcacagaagctaatcagtctctcaactcggtggaggacctgggtcaagaaggcgatngacgtgacctgctgcgtggatggatggcgccgaggagagcagaggagaggtgcatatcatcgaacgcgagagaccatatccacgaatcaatcgcacttgcggcattcggttagccagaactagagcgagaaaatcagggtgcaggcatatgagatctaagttcgagaccaagaacacttgtgcataatcccatttcgtacgcatcgccgctttggtcgtggtttacctccccgtaggcgaatccaaatttcacgcagaaagaattgcaatagaagccccgaatgggagctcggggattgcaaattccttgaacgagggccaaaggtcgacgaaagcacacaagtggagggccacgcaatactagtggagtgatgatggaggcgatattcaaacaattccaccattaatttatcggtaactggggaggggtactcctgaggtccaaggagcatgtcaaacctactgttggaatgtcccatacctttgtgtcccgtaaactccaagttgaaacggatcagattgtagtagaggaacatttctggggaaggaatagtagggctctttggaaccccttgacattaggttacgcacccctttttgagctgatttcctggggaagaagaaccgtaaggccacgtattgggacattttgcgtagacagattaaagggttatccataaggcccttggtgtccaggagcgaggcgtatggaattgggtagggaactccgtccgagattagagaaaaagagtcttttatttgggcttagacaagaatgggcggttgagagacaaggggatttctttttgagacttatttgagagggttgggcaaccgtggggagaaagcaaaaggttagcgtgtgtgacttcggtgtggacacgagaagcagaggactggagaggagaatacagaggagagtcacgggaatggagagcaatttggcgattgcggcaaggataggttggcgcgcccccgggattggtttgtataccacacacgagagagccactccccatcctggtggagaagaaaaacaagcgtgatggacagagccctggtgcatagaacaagtcggcaaaaggggtaacaaaccgccgagatggcaacacggagaggcagcgatctcagagaggggaccacaaaccagggataattcatacagacattatactatattcggggaaagggaaggacgagtagacagaacacacgacaagagacgacgcaaaaacaagggcgagcagacagtacaggaagaaacagcgaagagaagaccagctat

SEQ ID NO: 721587 - DNA, 173 bp, Homo sapiens
  misc_feature (63)..(63): n is a, c, g, or t
tgcagtcatgaaatactgaacaattgccttaagtctttgcttgactcactgggatatactgangctgtgggtgtgtctgtattagcatttcaatacttctacacatgcttttgatgtactctagagagtgctttaaattttgtattgaaacaacaatactatttgcactgtag

SEQ ID NO: 721588 - DNA, 724 bp, Homo sapiens
  misc_feature (89)..(89): n is a, c, g, or t
  misc_feature (97)..(97): n is a, c, g, or t
  misc_feature (261)..(261): n is a, c, g, or t
tctgaaatcaagcacctgtaccggcagttagatatgattcttgatggcagagaagatatgtctctttccctcacagaggaaatctctanaagaggancaggaatcctgggccacatgggcacgattactccaccagaactggatactgttgtgaaaacttccgcctgagattctgagaccagtaaatgaaatggaaaattccccatgggagtgaaaccgtccagactggtccagtggaatagccagccaaccctggctctngctggaggccgtcttaatgagcaccaaccccagcccttccattgcaccatccaagagccacctgccaccatagtaaaggagggaccatcagataaacattagtgccagccgaaataatagcccatccaaatgaaaagccgaaatgccccagaactacccacccatttcccatcatgtttgtctacggtcccacttccattatatttgttgtggtcgccaaactgtattattccattggttatatccatgtataggtctccagccagaagccaagctcgccccaaaaattctttttgactcacccattttcctgtgtacttcatctatttgtgtaccaaatgatgtcgttttgagggaatttaagtatttaaattgcttcatagtctaaattattaattttcttaattaaataactgtttaaaccttgatttgccgttaagaataaaccttaagccaagactta

SEQ ID NO: 721589 - DNA, 481 bp, Homo sapiens
gaccataatgaggttccaccgccctgggaggagacacactatggaagcccatctcttcctatgcgggacgccacacgcgtgtgcaggcagtgagccggagtctcgaggctcgctgtggagtcaggcaagccaggaaaaggcacatgcaccccaagtcccttatgtgaagttctacaagagacaaatatattcattttacttaaattaatattttaggctgggcacggtggctcacacctgtaatcccaatactttgggaggccaaagaaggaagattccttgagcccaggtgttcaaggtcagcctgcgcaacatggcaagaccccatctctacaaaaagtaaattagctggacgtggtggtacctgtggtcccagctactcaggaggctgaggcaggaggatcactgcagcccaggagttggagaccagcctggctagcaaagcaggaccctgtctctaataatgacaaggtttggcggt

SEQ ID NO: 721590 - DNA, 221 bp, Homo sapiens
cgcactagatctagtaccgcatgggacagatgataaattatcaccaagcatactgtagcaaggactaacccctataccttctgcataatgaatgaactagaaataactttgcacggagagccaatgttagagacccccgaaaccagacgagctacctaagaacagctaatagagcacacacgtctatgtgacaaaaaatgatggatatatagaagacatgt

SEQ ID NO: 721591 - DNA, 145 bp, Homo sapiens
cagtgcagcttgctgctgaggtgattctataggatccccgtttctgctctggctgcttcctgtcttctgcccctcaccaatatccttcctcaccaatgaccctgataccaatgaagacccgtgatgaagctgtcctccgtgatcc

SEQ ID NO: 721592 - DNA, 129 bp, Homo sapiens
aagcttttaccgctgaaaggaaggagagaaccacacaaaaagagagattcattaagtgatgaataccaatctcttgcagcacacaactgtctgttctaagcggcatttcgtcttaaaaaaaaaaagctt

SEQ ID NO: 721593 - DNA, 413 bp, Homo sapiens
  misc_feature (8)..(8): n is a, c, g, or t
  misc_feature (22)..(22): n is a, c, g, or t
  misc_feature (37)..(37): n is a, c, g, or t
  misc_feature (49)..(49): n is a, c, g, or t
  misc_feature (70)..(70): n is a, c, g, or t
  misc_feature (87)..(87): n is a, c, g, or t
  misc_feature (104)..(104): n is a, c, g, or t
  misc_feature (156)..(156): n is a, c, g, or t
  misc_feature (162)..(162): n is a, c, g, or t
  misc_feature (182)..(182): n is a, c, g, or t
  misc_feature (341)..(341): n is a, c, g, or t
  misc_feature (343)..(343): n is a, c, g, or t
acctaccncaaacgttttccanactgtgggcaaaaantgcctccttccnagtggaaaaaatgcccccagnttcctcctgaagaatgnatgtaaagtggccatgnatgttaccctaaggccttaggccttagccttgaaattcctgggccccactgnctgtgntcttaagatgcccaacctgntgctttttttttttttttcccccatttaaaaggatagtacctactccctctaaccacctcaccccattcttgaatgacattttatcttcggaaagaacaaggctgtgatgtagtgactattctctgtgtctcctgtgtgtgtctgttcttgtcacaaangntagttgttctatccttagttatgaaattttctgtaataaagtttcttaatcactcttcccaaaaaaaaaa

SEQ ID NO: 721594 - DNA, 126 bp, Homo sapiens
  misc_feature (108)..(108): n is a, c, g, or t
ctgatgaggacgaaatccttcccgttcttctggatgagcatcctatcttcgtagttggtttggacttcgataggttgatgaaagggaggggttctattaaccaaatanaatctgtttacaaaaatg

SEQ ID NO: 721595 - DNA, 254 bp, Homo sapiens
gtcgacgacaaatcctttttgcctgtatgttacttaagaatgtacatatactggccgggcagggtggctcacgcctgtgatcccagcactttgggaggctgaggcgggcggatcagaaggtcaggagatagagaccagcctggccaacatggtgaaacccgtctctattaaaaatacaaaaattagctgggcatggtggtgcatgcctgtagtcccagctactcgggaggctgaggcaggagaatcgcttgagc

SEQ ID NO: 721596 - DNA, 200 bp, Homo sapiens
  misc_feature (86)..(86): n is a, c, g, or t
acaggtcagttttgttacagaggccaattagcagtgctaaccttcgcctgcggaaaaagccaagtaatgaccgggcaagcctgcgnaggggtgatgaataactcggagagctgtaatttgaaaggggggctttgaagcatttaccttacatgggacgccattgtcctgcagggtgtttgatcttaaaataatttcttaat

SEQ ID NO: 721597 - DNA, 148 bp, Homo sapiens
ctccccgactattacaactatctgtaaaatgaaggtaatcaggccaggagtggtgcactcctgtaatccaaacactttggcaggctgaggtaggaggattgcttgggccaggagttcaaggccatcctgggcaacatagtgtctctac

SEQ ID NO: 721598 - DNA, 198 bp, Homo sapiens
atcgacgtggacatccctggcgccagtgtgtaggtctgcgtaccggatgccctcgcgcacgccttgtgcgctctgtgagccggacgcgtatgagtccgtgtactcgcctgaagagtgcagcgacctgggaccggaccttcctaggcggttgattagacatagggcacggggtggacgtgttcagatgaagctcgtgcc

SEQ ID NO: 721599 - DNA, 307 bp, Homo sapiens
catggttgactcacagtcaatacatatatattcgaaggcacgcaacatttcaactgtagttaccagtggaaaaaatactgaggagatgtttattagcttgatctaatacttacacattatgtacctgcaatgcattacactgtattccataaatgcaatacaatgacttgtcgattacaaatacaagttagaacatatccaaatccaaaacagtgaaaaactgctacacgtattcaagacaggtttacttgatgatctttagggcatgcttccttttcatctactcctttttctttttttttcctgg

SEQ ID NO: 721600 - DNA, 404 bp, Homo sapiens
  misc_feature (9)..(9): n is a, c, g, or t
  misc_feature (94)..(94): n is a, c, g, or t
  misc_feature (116)..(116): n is a, c, g, or t
  misc_feature (122)..(122): n is a, c, g, or t
  misc_feature (128)..(128): n is a, c, g, or t
tacctatanggaaggtgtccttgcatctctatctctcaatctctgtctctatatatcattctctttgtgtatttctcttatttgtccaaattancaataagtaatctgcacatganaaaccntttccntcatcttcatgtcaatatagcttttgtagaaaagtaattgctattttggaggtaggggattaaataactttggcgactgacatgaagacttcggctttcagtaatatgtaacagactgtacaaattcatcgagagacaattattctgatgaaaacagaatgggcaaactgcagtatctcatgtctataaatccaacactttgggaggctgaggcaggtggattcctgaggccaggagttatcgaccaccccggccaacacggcaagatcatgtctc

SEQ ID NO: 721601 - DNA, 1752 bp, Homo sapiens
tacggatatccatcacctcaaccactttattatttgaacttacaaagcaatccaattatgttcttttagcttatttacaaatatataattaagttattatgactataactcaccctcttgtacagctcagactagctagatcttattcattcatattatatattggacccattaactctccccacctcctccccccctcacgcctcccacctaccttctcccagcccatacgtggaatagaaccacctccctgtcgctacacactccatacagcacagaggcagcagctataacggatacccaacacgccaccccgacgacaccaaacacacaaggcagtcaccgcgaccacagactcgcggcctcgacagcacccgcactgcccacacacccgacgcccgcgcctccaccgccatacctgggcacgaacggcacgcaagcgagccagcccaaaccaccggacacagcacaacctcacactaggaccatacactcaccccgcagcacccaaccccccaacctcccactaacgtgcagtccaggacaaccggcagacacccacccgcgcacccatacaccgccaacaacagaccccagacacacgcagcacacgacacaaacccaacgccgacatagaatgcaggaccacaacagcgaccacgagccagcaacaacagaaaaggaccagaccatagactgagcgtcgacgtaaagagcgacccaagcacaagcgacaccgacgcccacaccactccacacacatatcgggaccgccgtgccgcgccacgcccgcacactggaggcaaaccccgacccctcgggaaaaggacatcgcgcggccacacaccacgccgggacagcagctccaggacctagccacagcgcactagaagcagacaaggcgacacacagacacgaaaccgcaaacaggacaccagagcgcctgcacgcacgtagcgagcggcacgacccgcaccacaacgacacaagtctacgtacccaccgcacggcctccccatatacgccacagccccgccaaccgcagcaacaggagcaccgacccagcaaaccgggagccaacaccgcacccgtgacgcgggcgcgtcgcgcggctagacgtcgcccccaccctcaccgcagccagtgaccgcgcaacggtactagacactcccagccagagacacgagagcgcaaccgacagcacgcacctcgcgacgcaaagtcgacgcccgacaagacggacaacgagcgagcgcaccgcacgggcatcgccgcgcacgcaaggctacggtcgagcgcacccagcggcgccgaccgctgggcacgcccaacgcgtcgcctgatcagcacgccggacggcgcgagagacgaagacagcacggagacaagcaaggacgaacgaccgccgcaacagcgtgccgtggcatcggtcgaggagacacgtgcgcgcacgctgcccccggaggccagccgccgcccacgaccgccctaggcgagcagcaggcaccacacacgagcggccgagggacgcggcgcccagcgcggcggcgacgcgcacagccgcaggcgcggcggccagcacacacaggcgcggcgagcgaacgggtgcacccacgcacaagagcgagacggcgataccaccaactgcacgagaaccggacgcgcaacaagccacaacacatcacacacgagacgagaagcccgacgaacggcaggacggccgcgacagcgagtgggacgcacagacgcgga

SEQ ID NO: 721602 - DNA, 542 bp, Homo sapiens
ttaactctatatgaaaaacagctgactcttaggcaattgctgagttcgtgaggtaggagcatcttggagtccattttggaaaggcctttgagctagacgtggtgaagtgcagtgagagtttgcactaggcagggaaggagtagcatagcacgggtggtccctgggtgagccaagcaggtctgcactgactgcctgggctgtgggagtgtggtctggaccagagccaggccaggccatccagagctatgcagagggttgggctcattcattgagtaccagggaaccactaagggcactaagtggtggggtgacaccatccacttggctccgtagaaggtcattctgggcagctctgcagacatggcgagtctgtcaggacatccctgacaggctgctctagggctgcagcagcaccttctttcctcggggctcacttgattcttcacaccctgggcacatggtctcagggtgccatactggggggactcagacagccgtggcctgagatcaagctgctggcagggttggttccttcgagagct

SEQ ID NO: 721603 - DNA, 1126 bp, Homo sapiens
  misc_feature (2)..(2): n is a, c, g, or t
tncaatttccctccaaccataatagcgggcttttaaacttgctctctccctgtcctctgttgcttcaaacccatttttaggtccggtctcatagtctttatcctgccttgtgttctccctctggtttggtccctgtgttgccgttactgcctacctgtgttttaacgggcactttttctccctccgcgagtcctacgttttcaccttcgctgctgcccctagcttaatgcttgtctggaggctgccctcttggtcttctcttcccgcatccgcgtcatgcaaccacattgttggtattggcagcttgcccccccgcttggaattaacttcgcacgcttctgtctttcacgatggcgctcgggggatcctgaggcacacccccttaggtacctgttgcgaggctgtggaggtgcaggccagagcacgtttgtgcgtagcccccgcacccaggttcttctgtcagaccctgtgacctgcgatgctgctactactgtataggagggaaattggatgaatcctggctcgtttctaaatcgcgttttctgacgaatcctttgccccttcacctttaccccgcccgctagcccctatggccctctcgagccttcctagtcatcccagcgtgtctacccagacccttgtgcggcccatgccccggggcggcgtcctgtccctgagctgggaggcggctatggatggtccgggcgtcaagagacaggggttggcccggggaggggtccttgcggtgagctatgtttacatgacacagtgtgccaaagtgacttactgcggttgcgttagtttctagtcatcaggactatctcaccctcccactcctgtttttaaaagctcagaattctttcctaagagcccttcgagcaaagcgtgccgaaggtcagttcgtcttctctgtggtggtcctttcttatgtcctcataaaagctcagatgatggtatctgtgagtatgtgtgttgcaaattccaaatattagtttggtaattttttctttccagttgatttttccaaagactgctgtacagagcttgaactcttgtcccttttatagatggaaccatctaacgcatgttactaattatgagccctggtcgcctggtctgagttgtg

SEQ ID NO: 721604 - DNA, 474 bp, Homo sapiens
aaccaggcggttttttgttttacaaaagagattttttaggaaatatttgttgaggatccacctttaattcaacctgtttggataaagccatgtagaatccactttagttttttccgcgaggtgaaaaatccaaaaaccctttttgaaatcaaaagtttcttagcaagtgaagtgctcaagtttttcctttttaaaaagaagcccacccccaaacccatttggcagaaaatttttaattttggaaaaaaaaaaaaagcccgagtggtttttttttttttttcggaactcccttagggggaggcccagttgttttattatttataagaataagtttttttttaaaatccacctaccccccgggtttttttagcccctgttcaaaaaaattttttttttttttaatcaaatcaatgaaaaacaggggaaaatttttttttttttccttttttcaattaattctacccttgagtgtta

SEQ ID NO: 721605 - DNA, 729 bp, Homo sapiens
tacgggctaggtacgaggctgggtgttaatcggccgagggtggggcagaggttgggatagatggcgtggcgaggtctgggcgctgcagaggctggggctgcggccagcgcgtggtggtgcgtcggtgggcggccgctgctgcgaggagctcactgcggttcctacccccgcccgctacgtctcctcggcatcgctggttgaacgtgtctttattcaaccacaataatagctggtattacaggacagatagcgacccacgcgataggttagaactctcgaatggatcagcacccagggcacaagtggtgaagcatacaagagaagtgctctgattcctcctgtggaagacacagtcttttatccttctccctagtccctataaggaggtctacctgaaaaaccattctagttgtgtgatactgattgaggtttacaggcctgttgcagtcttgcgaatcacgctgcctatttggcaactatgaattcatctgaaactccaggggatccaggagttatttgtcgataggatatcaaagatgctgcattggttggcatagcataacgacgctactaatagaagaaggacacttcagaacggagattaacaatgtggtggaataacctaagtgatggccagcggactgtgacaggtattgatagctgcaaatgtccttgtattctgtgtatggacagtaccttctctgcaacggacaatgatcagatatttcc

SEQ ID NO: 721606 - DNA, 120 bp, Homo sapiens
  misc_feature (14)..(14): n is a, c, g, or t
agtggagagagaantcatcgtatcctttcatcaatcccaaagcctgtgctaccggcttttttctcatatcagatgtagccacggatggaaagtcgttgtgcaatctcattctctcccact

SEQ ID NO: 721607 - DNA, 459 bp, Homo sapiens
tgtggggtctacagtgctcccccatctccacgtcccggctgggccccagagcccagcttcctgccctccaccgggagtctgcatggttgggagtcctgggtggaggggcctttgtgaggctggaccggctcagggcaggtggaggagctgggcctcccacagggtgcccgggcagtgccatcctggtgggggagggcagcttcaaacgtgtggggtctacagtcctcaggtctaggcagggctagccggttctccacctgcccagccggcccaggacccctgcctgatgctgcttgacgccctctgcttggggcatctggttgtctctgtcattgcctgcggttgttgccttgcacctcttttcttcccgcgcgcccctgcacattcggggtctacagccccaggctgtgagctccttgggggcaggccctacaataaatgtgaactgctgctagccgc

SEQ ID NO: 721608 - DNA, 119 bp, Homo sapiens
atgggggtagtgtgtaacctgcagaacgtcgagctgggtgccacagtgtcatcagcctcttccatggcaacagggcacttgtactgagctgtgttgaaaaggcagatgtctgcatactg

SEQ ID NO: 721609 - DNA, 828 bp, Homo sapiens
accttatattgcgggataaaccaaatggctcctggggtgggaacacggtgtctgctggaatatatagtgcccagttcggtgttccccctggtaagtggtgtgttccctgcccgccccggtacccagcgtgtgttcgatgtgaaccgggctgagttgcgccaaagtgggtgcaaactcagcggcttgttaacagcaaagatcatgatccaccgggtgctgctgcagacaattgtctagggcgaagcagtgctctaggttgtgcatactgaggacagctggacgctgctctctgctactttgggggaaaatagcagcgtcaactcgtgggcgccgtcagtagaatgttaaagcacgagagaacttgcttttttgcttgcggcacttctgtcagttctgtctcagagatctcccccggctcaccaggtggtaagaaggtgccgcacgcagcgccgcaagacacattagttcctccgagttactgggtcccccacccagggtgatcatccccggctctctcccaaaaatacaaggtctaatcaaagtagcttcaaatgaattaggggaaattcccctaccctctcctagaacgaaccttctctttagtcattgacacctagttgtaagtttctcgaaaatgtttccatcatctggtggatccaaattcaaacaaatgatccttgtcatgagttctgtaaataccccgtttactctgttctgtctctcaccatgtagtccccttgccaatgagattccccctggggttaaatctttcgctattcaaaacaaggagatttgaacccaaattattgaattttcggccacaagaca

SEQ ID NO: 721610 - DNA, 785 bp, Homo sapiens
gagagagttagagagagagagagagagagagagagagagagagagagactcagacagagtgcgtgtccctctctctcgctctctctctttctatttctctatcctcactgctccttccacttctactcccctctccctctttcttccttccctgtcctctctctcctcccttcctcctcttcctctctcctctcctttttcctcctctccttttcatctttccttactctctctcttcttctctctccctcttccttcttctcctcttctccctcttctatccttttttctccctctctcgcccttctcctcttcactctctccttattttttctctcctttcttctctcctctcttctttcttctctcttccctctcttctcccttctccctcctttctcttctcttgtctccctccctactctttccctctccttttccttccgttcatctttctcctttccttatccctctcttcttccccccccctcctttcttttctctctctccttctcccctcttctcctctcccttctcttccctacttcttctcttcccccttcttcttctccttcttcctccttctttttctctttcttctttctctcttcttctcctctctttccgccttcttccctctctttcttctctattcttcttcccttctctttcttttctcccctttctcctctcttttccctctcttctctcccttttccttgccttttctcttctctaccgcttcttccctttccctctctctctcccccctatcttcctcctcc

SEQ ID NO: 721611 - DNA, 406 bp, Homo sapiens
caaagcacttcagcttcctgtttctgagaatttgttcacaggcagaattatgtcacggtccatgtactaggaccggttcccctctgccacagtgatttgatgtgaaagtgtgccgtcttttagggaaaactgtcagtacttacaccgtggctctgcatagctcatcctgaaactggttatagaaatctatttagcacgctcagctgctatttcccttctttgacatagactctattaggggccacaatttccctcaagggtgagtactctttaaatatattttcagtttctgatttagagacattgttcaccactggactaagactaaccttggatgccggtcagtgacgactttgtcacactaaataagatggctgttctaggcctaagacactgtcttgagggg

SEQ ID NO: 721612 - DNA, 187 bp, Homo sapiens
  misc_feature (54)..(54): n is a, c, g, or t
  misc_feature (59)..(59): n is a, c, g, or t
  misc_feature (92)..(92): n is a, c, g, or t
  misc_feature (167)..(167): n is a, c, g, or t
aagacataaatttgctgtgtgttcccgcacaaccaactttaataataatgtctntgcangccatctattctctcatgggcaataacacaganacaaacggtcctgagtgcacagcgctgctgggttttggggtctgctttaggggaaacaccaccaaaacctgccanccggtgcgattggtgcttct

SEQ ID NO: 721613 - DNA, 466 bp, Homo sapiens
  misc_feature (6)..(6): n is a, c, g, or t
  misc_feature (79)..(79): n is a, c, g, or t
aaattngccaacccggccaaacctacgggaccttttccccttaggggaaggggaatatagacgcttgttaggatcaaanggaacacatataaatgttggacaatgttttttcctaatttcccaaatgtttttctgagtagcctaagtgactgttcacccagagttttagacatttcccttctcctattgacagcattaattagagccaacacactaaaattctaaaaagtcatggaaacctctgaagggccatttatcttcccacatctctcccacattgccccatctcgcaaaggcatgcaattactaaagagaagaactgggtgaaagagttggatggattgttcaaatccatcactatgactgaaaaacaactcaaactagccaatggattgtttctcctccctaaaggaaggtatcatgctcactcaactctcccatcctggattcctggttcttccattat

SEQ ID NO: 721614 - DNA, 90 bp, Homo sapiens
ccaagacagagacagaggcgccctgggtggtggaaggcagccgccgtcccgaagttggcccccacgtgggaaggtggagttcggaattat

SEQ ID NO: 721615 - DNA, 402 bp, Homo sapiens
  misc_feature (398)..(398): n is a, c, g, or t
aaaaaattaaaactaggactattgtggcttcactggggatggttctcaggcctcggactactcaatttactcatgggtttgtggcatctgcagctccagaggacacaagtctcacacttaggccaaaacccgttttcagatggaaaaacatggacccaggagggatgtggggtttacgggctggaaccctggactctggccactctagcagggttctctcttggcatgggctttttgctccaatgataggtttgagataaagaagggtcctggtggctctcctgggagtgacctgttggagaagtgccacccacttaattccatctatatgcctttaggccatttctggttggcctccaattttatttatttatttattgtggacacggattctcccntgtt

SEQ ID NO: 721616 - DNA, 377 bp, Homo sapiens
tgatgtaatacttgtaaaatttccttaacattactgtacaacaatgacaattatgctattgcgacaatagtggcatttcaggttactcttcataactatggtcagcgttatagttagatataataataaccatagacacattcttcccactaatttagttagcgcacatggtcagttctagtcgcagcagtcaaaagaccaaatagttctaatcccttctaattggtactatgtttctccgacttaaagataagagatataaagtactactaatagcagcaaatcatagaacagctttcgagaaacgcttaatttctatatacaggcatcagctcaatattagaggacttttctttcccattctaaatgagtccttt

SEQ ID NO: 721617 - DNA, 163 bp, Homo sapiens
atcgctcgagcacggttgcatcctcgaatgagaccatgatggtttcaagctttagatctaagcagccacttgggctcagtattgctgaggagaatcaaagccgaagataaacttacctgtataaactgtcctgcataccttgtgcagatagggtaccgagctc

SEQ ID NO: 721618 - DNA, 1295 bp, Homo sapiens
gaatcaggctggccatcgaactcccgacgtcaggtgatccggccgtctcggcctcccaaatcggtgcgattacagtgcgtgagccaacgcgccacggccaggagagcaagtcttgacggagtcctccactgcagggagcgggcgcgttcatgaggagctgagagctgagagtccggagcatatgggcgtgacgcgtggagaccaaagaggctgtgtagagaacttccgcagtctgtcttgggcttgtgtgactgagcaatctgcgggcccaggtctcgacggggaaacatacggtctgatggtaccgcaaaggccccacatggagcccattgggcttgcccgggagaagccgagggtgagagtctccagataagtcgtctgaaggatgcacgctcgaacgttctcacctgacgcctggaatcatgaggcatggagatgacactccctcgccgacgggatgttccacaggagtctgttcatgagagcactgcttcttccagagggctcggagcggtagtacagtaaatatcccttggcaggggagaactgtgcatgggtcagacaatgtaccagggaaggtctagtaaccaatccgcttacctgttcaccggactggtgatcggcatagcagtgatgcctcgtatatctgatcaagacatttctggggcatggcgaggaacttcatgatagccttgggtcacataccctatagggaagaaagtgaagccgtgataggagactggctagacatctaagggtggaggtacccaactggaagaacagcggttgcagcaatcaccaaaagagggaatccaaggctaaagcactcgccagggcaagtcattcaccagagggccaagacagtcagagagaaataaaaccttcacacactaaaggggaagaggtagatcacgaccgtggtttcatagagctaagccacaccaacccagaagacagcacagtcgagccctaaggagtccgagtggtatccacataggggcttggacttgaaggggcattattggaataggccgtgaaaggaccacgacactaaatgtcctattggaaggcattccaggtttgggaagacgttccaaattcggaaaccatgatacggaaaagaacgattccccacgtgatgttacacgggtcatgaaactgtgtacagcaggttcacccttaccgtttcctgggagcacattcggagtctcagaagattcgtaggaacgcataagcgcagggagaccggctcaacgggatatcccttggtgcccccgaggtattatccccttgga

SEQ ID NO: 721619 - DNA, 248 bp, Homo sapiens
cgagaagacagaaggccccggcttgggcttatgcatgtcctacccttgaccccagcatcaaggggcccctcaaaggccctctctggggcctatggggctcagcacagctttcatcatggatctaagcccctgtctttcccacctgactgtgagtggatcttctgggggatggcccctgtggggaggagcttccatgccgcccgcctgctcacggcagaaggttgctattaaaatgacataggtctgca

SEQ ID NO: 721620 - DNA, 253 bp, Homo sapiens
gctgacttagaggatcccatgatattctggtcacatgctttatgcccatggaagcctcgttgtctgggggcccttgtacaggagctcgcagtggtacttctgggcctgtcacaggggatgtggcaggtggatggtgatcatctgcaacaacgcgtctccgccacccacccagctgccccatcaccgccttcaccaggcgcttgcctctctttgtccttgtcttcgcctgtcccagttggatgtccagtttctc

SEQ ID NO: 721621 - DNA, 107 bp, Homo sapiens
ggatccccctcgtccagtcatcatgaatctaaagtgcggggtggacatcggcaggtcaactggtatagctgcaggtcgttggtgtcacacagataaacttgtgtctt

SEQ ID NO: 721622 - DNA, 317 bp, Homo sapiens
  misc_feature (9)..(9): n is a, c, g, or t
tcttgtatnttatcttcccagacttccaatttatgtatagaaaaatgtgactattatagagtcttgtgaaccataatccaagtgtcaactcccaatcagtataacatttcagaaatttctttccattctcactaagcccagagaactaatctggcagacctattaggtcctggtactttattttttttagggaaaaagtctcactctgtccaccccagcttgaatttgcagtggttttatcttcggtcaatggaacctcttaatcctgggctcaaggaatccttccaacttcaggctccccaagttaccttgactac

SEQ ID NO: 721623 - DNA, 123 bp, Homo sapiens
tctgggcaacctacaaactaatatcgtttatgtcttggggtcggtgttggagatgccccaaggtttatacatagtaggggcggtagtttgactcgtcctacaccaggtcatggacaaatactg

SEQ ID NO: 721624 - DNA, 888 bp, Homo sapiens
ggagagagagaactagtctcgagttttgtttatttttttttcaggtaaacgggtcctttattagcaggggtccaccggttgggcataacgggttcccagtaaataggcttggagttgcttgggggtgacagagccaggcgcaggtgcaggcgcaggccagcatctctcacttcttccactcgttcttttcgtagtcccacttggaggcctaagcccgggatggggttcaccttaatgtccagcatcctctgggtctgctgtggccacccactcttggtcaaagcttggcggggatgggggccagtacacatagtggcttctggccacttggatacccagagcggcggtagaaaccggatggaaagaacatgggcacctgcccaagaaccggttcttccacctcgtcagagccccgtgttcatctcacgcaaagctactccttgaaactgtaagtgcgaatacaactgcgaatttttctcatccagtggagaaggctgctccagagaggccttgctccttactccttagagggccttacgggctggcaaacaggtcgcttgacaatggggccacctccggcaaggggtgggtccacgcggatccatataagctggggagcgaaaagtctacgctacttacacaacactttcatgagcttggtacccattctaatcgcaagggcattcctaaatggcttaccgaacgaaaaattctaggctatatacaagtagcaaaggcccaatgttgtaggcccctaggggctagtaaaacccttgagttgaggccataaaagtcttcaccagagagcccttaaaaccggcaaatttacaatacagcctttagatcacgggccagacttagacttaacatagtcttctaatatgaacc

SEQ ID NO: 721625 - DNA, 810 bp, Homo sapiens
ggagaattcggccagccagatctcacagcgttgagcagcagctgagcgccaaaaacagcacactcaaacaactggaagaaaaactcaaaggccaggctgactatgaagaggtgaagaaagagctgaacattctgaagtccatggagtttgcaccatccgagggcgctgggacacaggatgcggccaagcccctggaggtgctgttgctggagaagaaccgctcgctgcagtccgagaacgccgcgctgcgcatctccaaacaagacgaaccctgaagccgcaacgcgtgcggagctgcaagtccgtatcactgaggctgggcacagcacgagcagagagagcgatcgcccgcggagcaggactgagcatcatcagtccatccagcggccgagccgagggtgccgctgagcaccgctggcagaagatccagagcccatcaaagaggcactgcctatctacggacctgagcaccagccagggtgccctcccagagggcagggatcacgcttccatcatctccagcagagggacgtccgtgccgaaccagactgaggcgagaacgctgccagacacctcaggcctgaaggagctgacagctgcgcgcgacagtcagctcttgaagataagtcctgcgagtacctgcgggcagggcaggatgacagagtgggtactgtccatagagaggcctgactttctcttacaaggagggaaagaatactagtgagtctggaagcactagatggggttgtttctcaaagaggggacatggttttaaagttcttgctgttctgggttaaatgttagaactga

SEQ ID NO: 721626 - DNA, 507 bp, Homo sapiens
  misc_feature (20)..(20): n is a, c, g, or t
cgccaatctgttccaggagnagaaagtggacctgtctaagccactggtggccacgtgtggctctggcgtcacagcctggccacgtggcactagggccctacctctgcgacaagccagacgtgcccatctacgatggctcctgggtggagtggtacatgcgcgcccggcccgaggatgtcatctcagagggccggggaaagacccactgaagctgggcaggacacaggcgagctcaggtgatgccggccaccagcaatgcctggcctggtacgtccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccaactggtgctgagctgggccccgcctcctttctgtattattttaaaggaaataaaataaccaagtgata

SEQ ID NO: 721627 - DNA, 1133 bp, Homo sapiens
  misc_feature (1133)..(1133): n is a, c, g, or t
gcagttcctgcgtgtggggatgctgcagtgaggcgctggtgtccgggagcagccctggcccctgcggacttccgagtgcctgtgaaaacccctgcgctgcgtgccttcccagtgccccctgaggcctgttctgcctgttaccctgaagccctgactgcggggaacgacgtccgagcgaccaaatgctggactgttctcaggattcctgttattctgttctgggaggccaccggagagactgcctcctgtggtgttctaggaacgctcccccgtgcgtgctgcccaggtccctggcgttcagttctgtgggcgtcgcctccgatatagccccagctccgtggttgcaccggcgtctgtctggcggaggcctgcgaaccgcggtccttgtgcgctgcatcccgatagactccggttgtgccgggaacttcaccgaagttgccctggccgccgagacagcttcaaatgggcacctttaactctttgacaggctctaccggctcccccgtgtgaccgtgacatgttcacgtgccggcacattactgggtggacaccccagggatacgaaagtcgaatcgcagaccggacacgcgtcgcacgcactgcccccttggggggcccttccggtgctggaactgatggctctctctgtacgagacatgcgggctggcccacccaagcgggcctggactcctatttaccaagttaccacacccgcggctatggtcgctactgccgcatcggtcgttcagcattttatctggtgacggaaatagtagagtgcgtgcccctatgggcacagacaaatgcgccccccatctacgtgagaaacgtgcccgaaacgcccatacacccccgctttattcgagcgacgtccgcccatatatggtgacataagcgcagcacaaacaccgttttggcgcacatttggtttccggccagttcactttgagtggaggccgacgggcagcttggtatacaatggagaagcgtaatcagaaccaccgatttacggctacctacaacgtactgtggggcattgtgacacaccttcggtgaggtcaccccacattaggctgaagacacgccatccctattggaaacagtaacaccatactttatgaaagcacgccgan

SEQ ID NO: 721628 - DNA, 252 bp, Homo sapiens
tagaggatacataatcaacataaaattgtcgtgacaatggttaggcgtcaaaaatactaaacatatttgctggcataaataccgcttttgccatattcaggaaatcttcctggttgggtgattgccagatattgcttcgcaaataattacaaaagtggatagatactaccagtgacgcgaattaggaagtctaacaaattgtgcagtagatggcggaagcccaaccaattaagggcttttaaagcccaataa

SEQ ID NO: 721629 - DNA, 421 bp, Homo sapiens
  misc_feature (66)..(66): n is a, c, g, or t
aacgatggtctcaggctcacttgatctgcaagtgagctgagagaacaaagtagaaaccataacctntggccgggcatggtggctcacgcctgtagtcccagcacttttggaggctgaggcagttggatcacctgaagtcaggagttcaagaccagcctggccaacatggtaaaaccccatctctactaaaaaatacaaaaaaaaaattagccgggtgtggtggtgggcacctgtaatcctagctgctcgggaggctgaggcaggggaatcacttgaaccagggaggcggaggttgcagtgagccgagatcgcgccactgcactccagcttgggcaacaagagtgaaactctgtctcaacaacaacaacaaaaaaacgtgtaaccttttttatgacccagcctcagaagctgaggaccatcg

SEQ ID NO: 721630 - DNA, 1101 bp, Homo sapiens
catgatgagtatctcttcaagactcacttgggcaactaccaattcttaggaattgggaagaatttcacacacacagcacacacaacacacagcacacacacacacacacaacactcactcctcattttcactacgtggaacgttaataaagaaatctgatcaagtaaccagtccagaagatgacaatacgtacctgttgcctctggagcaagcagatctctgaaaaactgaaaaatgcaaaagccagtttttcccaaagtgacaactgtgtcacatatctatgatgtgtgtgtgtattccagtaaaactactaggtagttggaagagtaggtaggatggattttactcacagaacatggtttgccaacccctgctctacaccacaagccccactctagatttaagaaatgatctctagatcttactggtggccaatgactagctttgtgtgacaggtagaaaaagtacctgaacgttgctattatatataacgtgctctcagtgaaaattagagtatataaactagtcgattatgagaactctagtttccatagatgtctaaaagtttcgctttccctaaatggctggtttaaaaaattatcgggttattctagtagttgtcagggataatcgtcaaaaacagtggatctaggcctaatggtagaggcacatgtacaattatctacccagttctacggtctgctgtctaggagccaggacttggagtcagacaccttagaatgtacctgatcgcctcaacgagaacgacgaagggacgaccgggcgtggacacccattggggagaaagacgaaccccataagctgagacccaaaggagccacgccaaaggcataaagagacaagcgatggcacagacataggaaaaaactccgacacacaaggaaaaatccccatgtaggccaccaaatatgggtggcacccccccgtttacagacacacgaaggaggggtagcgcaccacattaagaaccagtgatccatggagaaaatgaatctaagacaacatcaaccgacaaacgacgcaacacacaagcacagacgagagggccacacccagccacacatcaacatgaagcgaaga

SEQ ID NO: 721631 - DNA, 81 bp, Homo sapiens
  misc_feature (15)..(15): n is a, c, g, or t
gtgacccggggccanagcgggacctatggctgcagagttgaggattacgacgtcgcagatgacgtgcagctctccaagacg

SEQ ID NO: 721632 - DNA, 150 bp, Homo sapiens
ctgtatcggggagctgtatcccggggaggaaaccaagttgacaagaactcaaagtgccttttctccggtctccttcagccccctgttcacaggtgaaactgtgtcgcttgtggatgtggacatttctcagcggggcctgacctctccaca

SEQ ID NO: 721633 - DNA, 171 bp, Homo sapiens
agctttgttactgcttcggatgcccaggaaggaggtctgcctgggggggctgcggtccaacggccggttgaggctgcagaaccagccagcggaagaggcgctcgtagtgtggccttgtgccagtgcctccagctgcgaagtcagccatgttccttacgtctgggctttctg

SEQ ID NO: 721634 - DNA, 1283 bp, Homo sapiens
agtcttggttgaggcgtgtgtgtgtgctgcgtgagcggcgtcgttcttgttctctctcctctttctcttcatctgagtttctgtgctagctggacgcgagctagcgctgtccctgacctagtgctgtgtagttctagactcgcctgtgtgtgtcggcgggcttcgcttctctctgccgctctctgctcatacctgtcttcgtttctctcctgtcttgctctctgcttcgtctccttctagcttgctttcgtcttgtctgctgttcgtcggttggctgtgtcttgtgtcctctgctacgcctctggcttctgccgagcgcttcgtacagctctcgacgctactcgtcttctgctccgcttttgtcgctgcgacgcatccactcgtcggcgtgtacaaggagctgtgtggctgtctctgtcctttgtttcttccttgtttgtggttcttctcgttgtctcttcttcgtcttctggtttcggtgtctgtgtaggtgtagtgctggtgtggtgctccgctcttctttggtcggctatctcgcgtctcggctcttcgcgctctactctgcttcctctttactctgcttcactcagctctcgcgctgctacacgtcttgtcgcttctcacgtcttctacactgcttcactgtcgctctctctgttcagctatgtgtgtcgcgtatctatatcttctgctctgcttcgcgtctgctgctgctctctgcttctctctactctacttctcgcgtctgcgcaacgctactacgtgacgctactgctccgcactctctctccactacacgcctgctctctcctttccttcccttctgaattgtttgtgtgtggtcgtattttctgtttttgttttttttgatggtcgtgtgtggttctctgtctctggtctctctctctctctctctctccgcgacactctctctctctctctctcgctcctctccttcacgctggagtcgagagcctctttctctgcctgcgctcggtgtgttcgttgttgttgtgtgttgttgtttgtggtgtgtgtgttttttttctgtcctcctcttcttctgccttgcctccctcctccccctgctgacgtctctcctctcctcctcctcgctcctcttcttctctccttctttggggtggctgccttattttataaaataaaaatataaataaataataaaataaatatataataataataaaataatataaatatatataataatataatatatataatagaaataataataataaataataataaataaaaaaatt

SEQ ID NO: 721635 - DNA, 175 bp, Homo sapiens
  misc_feature (74)..(74): n is a, c, g, or t
ctcagataaacatgctgaagctataaacatgtccacggccaaataactgacaagaagaaggccaaggcatctanaaaccatggcttgggggtcacagttgatcatatttttctatcacctttgataaggcataaaatattattttgatgagtaaataaaaagactttggacacct

SEQ ID NO: 721636 - DNA, 811 bp, Homo sapiens
  misc_feature (100)..(100): n is a, c, g, or t
  misc_feature (143)..(144): n is a, c, g, or t
  misc_feature (152)..(152): n is a, c, g, or t
  misc_feature (160)..(160): n is a, c, g, or t
  misc_feature (174)..(174): n is a, c, g, or t
  misc_feature (192)..(195): n is a, c, g, or t
  misc_feature (210)..(210): n is a, c, g, or t
  misc_feature (217)..(217): n is a, c, g, or t
  misc_feature (224)..(224): n is a, c, g, or t
  misc_feature (227)..(227): n is a, c, g, or t
  misc_feature (229)..(229): n is a, c, g, or t
  misc_feature (252)..(252): n is a, c, g, or t
  misc_feature (259)..(259): n is a, c, g, or t
  misc_feature (275)..(275): n is a, c, g, or t
  misc_feature (280)..(280): n is a, c, g, or t
  misc_feature (289)..(291): n is a, c, g, or t
  misc_feature (295)..(296): n is a, c, g, or t
  misc_feature (300)..(300): n is a, c, g, or t
  misc_feature (308)..(308): n is a, c, g, or t
  misc_feature (334)..(334): n is a, c, g, or t
  misc_feature (340)..(340): n is a, c, g, or t
  misc_feature (344)..(344): n is a, c, g, or t
  misc_feature (357)..(357): n is a, c, g, or t
  misc_feature (361)..(361): n is a, c, g, or t
  misc_feature (366)..(366): n is a, c, g, or t
  misc_feature (368)..(368): n is a, c, g, or t
  misc_feature (376)..(376): n is a, c, g, or t
  misc_feature (379)..(380): n is a, c, g, or t
  misc_feature (384)..(387): n is a, c, g, or t
  misc_feature (399)..(400): n is a, c, g, or t
  misc_feature (404)..(404): n is a, c, g, or t
  misc_feature (444)..(444): n is a, c, g, or t
  misc_feature (499)..(499): n is a, c, g, or t
  misc_feature (549)..(549): n is a, c, g, or t
  misc_feature (555)..(555): n is a, c, g, or t
  misc_feature (582)..(582): n is a, c, g, or t
  misc_feature (585)..(585): n is a, c, g, or t
  misc_feature (593)..(593): n is a, c, g, or t
  misc_feature (595)..(595): n is a, c, g, or t
  misc_feature (600)..(600): n is a, c, g, or t
  misc_feature (602)..(603): n is a, c, g, or t
  misc_feature (605)..(605): n is a, c, g, or t
  misc_feature (607)..(607): n is a, c, g, or t
  misc_feature (618)..(618): n is a, c, g, or t
  misc_feature (625)..(625): n is a, c, g, or t
  misc_feature (629)..(629): n is a, c, g, or t
  misc_feature (662)..(662): n is a, c, g, or t
  misc_feature (665)..(665): n is a, c, g, or t
  misc_feature (707)..(707): n is a, c, g, or t
  misc_feature (762)..(762): n is a, c, g, or t
gatatatatatatatttacatatatatacagtcttgctgttttcatgtgcactatatttagcagcacattatttaatcaggcggcattttaatggggttnttttgacacttggcattattaagatacaactatagccccgccnnaatttcancgtttganttccacttctccgncttttaatagtagctaannnnggggggggggggggntggggtnccaaggntgngnattaggttaaacacaagaatttnaaagggncaaggtagcaaagggnagggnaaataattnnnattnnaggntatctganaaacaacccagagaaacagttagttnccttcntttngggctatgggctntgtnccctngntgctcacntcnncctnnnntgtccttttccnntccngttcttgtgttgttcctgtggttctgccctctccgttcantccctccacccgataaatttgctaccaccaaaatctagagctatagagccttgtngcaaattgggtagctaaatagttgttccttggtctaccttcccacaagtnttttgngggcccaatgttgggtagggaagtganaanactgttcncngcaantnnangnttttttttttntggcttngttncacaaagtgaattgcatcgagttactgtcaaanganaagctgcgggttgtttcatctgtcgtctaaccggccctgcgntttaacccggccctctgagggcaaattgctgctgaaaacattatcatcatctttnttttcttcaccatttttctccacaggaacccattctccataaacactat

SEQ ID NO: 721637 - DNA, 1701 bp, Homo sapiens
  misc_feature (1114)..(1114): n is a, c, g, or t
  misc_feature (1119)..(1119): n is a, c, g, or t
  misc_feature (1468)..(1468): n is a, c, g, or t
  misc_feature (1482)..(1482): n is a, c, g, or t
ctgtccattacagataacagttcatcctcagacattgtggagagctcaacttcttatattaaaatctcaaactcttcacactcagagtattcctccttttctcatgctcagactgagagaagtaacatctcatcctatgacggggaatatgctcagccttctactgagtcgccagttctgcatacatccaaccttccgtcctacacacccaccattaatatgccgaacacttcggttgttctggacactgatgctgagtttgttagtgactcctcctcctcctcttcctcctcctcctcttcttgttcttcagggcctcctttgcctctgccctctgtgtcacaatcccaccatttattttcatcaattttaccatcaaccagggcctctgtgcatctactaaagtctacctctgatgcatccacaccatggtcttcctcaccatcacctttaccagtatccttaacgacatctacatctgccccactttctgtctcacaaacaaccttgccacagtcatcttctacccctgtcctgcccagggcaagggagactcctgtgacttcatttcagacatcaacaatgacatcattcatgacaatgctccatagtagtcaaactgcagaccttaagagccagagcaccccacaccaagagaaagtcattacagaatcaaagtcaccaagcctggtgtctctgcccacagagtccaccaaagctgtaacaacaaactctcctttgcctccatccttaacagagtcctccacagagcaaacccttccagccacaagcaccaacttagcacaaatgtctccaactttcacaactaccattctgaagacctctcagcctcttatgaccactcctggcaccctgtcaagcacagcatctctggtcactggccctatagccgtacagactacagctggaaaacagctctcgctgacccatcctgaaatactagttcctcaaatctcaacagaaggtggcatcagcacagaaaggaaccgagtgattgtggatgctaccactggattgatccctttgaccagtgtacccacatcagcaaaagaaatgaccacaaagcttggcgttacagcagagtacagcccgnttcangttccctcggaacatctccttctccccaaaccacagttgtttccacggctgaagacttggctcccaaatctgccacctttgctgttcagagcagcacacagtcaccaacaacagtgtcctcttcagcctcagtcaacagctgtgctgtgaacccttgtcttcacaatggcgaatgcgtcgcagacaacaccagccgtggctaccactgcaggtgcccgccttcctggcaaggggatgattgcagtgtggatgtgaatgagtgcctgtcgaacccctgcccatccacagccacgtgcaacaatactcagggatcctttatctgcaaatgcccggttgggtaccagttggnaaaagggatatgcnatttgggtaagagacttagtctatttcggactttattccgtaccacaatatattttacaaggtaacatttgttatttttcttcctaaccaaaatcagtatttgtccaaggtataaacttaaggaatatagaaaaaagtggaagctattgtccattattctgatacttggagatagaacaccctactttgcattatgtttttgatgtgcacctcgtgccg

SEQ ID NO: 721638 - DNA, 265 bp, Homo sapiens
ccaattagcaacaacttgtcagattctttccaataagccacatgaatttgttttccatttaaaaggagggatgaactaagaaacaatatattcaaaataaggttagaatacctttaaatgtcataaaattataagtataattcataaaagattgcatatggtatgatttaagaactacatacttaataagtgatttcttttcatattcctgtcacataaaaaacgcaaggaattatatgacagcaaaaatatactccaacatatt

SEQ ID NO: 721639 - DNA, 437 bp, Homo sapiens
cctgagtatgagtaattacaccagagcatagaaaccagcaggagcagcggccgccacgcacacacagcaccgacaacaccacgcaataaaggagaggcccgcagggacagcagcggaaacacacaagagagcaccacagaaactcggaacacacaggcgcaagagagacaaagagagcgtataaaacaccaaaactacaagccacaagaacaacaacgcacacacaacaccacaacagccccgaggaagaaggcgaagatacacgaaccagacacaagacaaaggcacacaaagccaacaccctacggaggcgggagacacaagagccaagcgacacacaaagactgcccccggcaaacaacaggcaaaagacggacgaacaaagaacgatgacaacgaaagaaccgaaaccaaaaggcacagacaaaaacaagcca

SEQ ID NO: 721640 - DNA, 633 bp, Homo sapiens
gatccctgtggtaccaggcaggaatggcctgctaggggacccagcgagctcccaggcctttctgctgcttcgtgtaccactgtatttctcttggctctctaaacttgactcagctttaggtaaaatcagaaacttctcccacgaacagaccttcagcctctccagtgggagtgtgtttgggagaggaggctctccctttcccacttccgtagttggggcactcacagtacttgaggtgtctcctgggtcctccgggagcagtccgcttccttcagagggtctgtgggtcctctcgggattgctgatttgttcttgcagtcaatctggagctaaaatttacaatgaaaagttttcattagaatgaagtgaattaaactgcaacatatcagtatgagttatttgcttattcaaagccaataatttcctcctttgtgaattgattgattgatttaaattaaattctctttttaaagattcccttgcaattattttacttcctattggaaggcagaaaaggaaaacataggttgtcttggtggtctctccttattgaactatgaaccttatcagtgggcaagcctccatagaagcaataacctatttcactccttaaagaaattcaacataatacaa

SEQ ID NO: 721641 - DNA, 297 bp, Homo sapiens
aaaacttcttgaccgaatgctaatttttccttgtgttgccgaggaacaagcattctatttctgaataaacattttacatataacaataagcaaaacccactgtcctggctggtgccactatgttgcctgcctccagctgaggtcactccttttgctctctgccagacttgcaatcacaaggtggagaagctgtagctgctggaagtcattttgctgccttggagagagacacttttggagaatggggcccagccagagaagctagtccctgctggcatttgagcctctgcctcagca

SEQ ID NO: 721642 - DNA, 578 bp, Homo sapiens
gatccctgtggtaccaggcaggaatggcctgctaggggacccagcgagctcccaggcctttctgctgcttcgtgtaccactgtatttctcttggctctctaaacttgactcagctttaggtaaaatcagaaacttctcccacgaacagaccttcagcctctccagtgggagtgtgtttgggagaggaggctctccctttcccacttccgtagttggggcactcacagtacttgaggtgtctcctgggtcctccgggagcagtccgcttccttcagagggtctgtgggtcctctcgggattgctgatttgttcttgcagtcaatctggagctaaaatttacaatgttgcttattcaaagccaataatttcctcctttgtgaattgattgattgatttaaattaaattctctttttaaagattcccttgcaattattttacttcctattggaaggcagaaaaggaaaacataggttgtcttggtggtctctccttattgaactatgaaccttatcagtgggcaagcctccatagaagcaataacctatttcactccttaaagaaattcaacataatacaa

SEQ ID NO: 721643 - DNA, 334 bp, Homo sapiens
atattctccccatattacctcaggtgccaacccaacaattggctggagttttttcttaccaaaaaaaaagtctaccagaggaattagcatccagcagcagcactcagacctgccagccactgtcaccgagcgggtgcaagcactcggggtccctggagggcaagccctgcccacagaaagccaggagcagccctggcctccatcagccctgatagacgcaccgcctgaaggcacagttaaccacttcgcacacacccatgtaaccactgcactttccaatgccacagacaactcacattgttcaactcccttctcggggtgggacagacgagac

SEQ ID NO: 721644 - DNA, 898 bp, Homo sapiens
gagggcggggattgcgagtctcacaccctgagactccggatgctccttatcctaagtccacatggctgccggcatctgtgggaaaagtgtgtgctgggtcttcgaggagccgcaccaatggcttccgtgctgtcctacgaatagcctggtccacgccgtggccggagtccgtgggaagcgtgacagcaatgacaggtgttttattcccctggatacagcctagacttcgaccttcaggttgatgacgaacaagaaaatccgaataactacacacgatggtgctccatggagatcattaagagaagaaggactccttggcacgcataatacgagggttggtttgccatgtgatttccagtcgtcatgctagctcgccattgtgggtctaatttcgtacaagcatctttaatcagcctacaaatgcactctagggtctagaaggtcaacattcctacccacttgatacaagatctaggtagttgcggtatccgtaaggtacggcagggtgggttctaatgtggtgactgggacgttaaaacaaagcgtcccaacatccttgagggttgggtgaatgacagaccaagtaaccgtgcaaggccatatcctacaggggccaaggctccatatacctgttatacagaggcaataacgttggtcaccccggaacccaaattgtgggattaagggcccacaatgtcgaaaagaagccgttaaagccagtgaacaagcgggggtttaagtttcccaaccttctggaggaattggcccgttagtgtgtgtgacaaattcccggagctgaacgttcccacattatccggacccggcgaacttgggtgcacaggggggaaaacattcccttcggagggcctattctgtgactggtggtgaccattggtcg

SEQ ID NO: 721645 - DNA, 447 bp, Homo sapiens
cacgaggtgaagcattctttttgcaacatacttactttcctgttttcttggagtggaaattatgaagaaaaaacccaaagagatacctaaagagcttaccagtcagggaacaatatattgctgtatttgtgactagtcagtgtaaaataccttgattcattttgatgtaaggaaggagaggttgttggcttctggtgtagcccttttgcagtggattttaagaagcatttgtctgtggttgtaactttttttttttttttttggagacggagtcttgctctgtcgcccaggctggagtgcagtggcacgatctcggctcactgcagcctccacctcgcgggttcaagccattcccctgcctcagcctcccaagtagctgagattacaagcccccgccaccacgcccagctaatttttgtatttttagtacaaacggggtttcaccaa

SEQ ID NO: 721646 - DNA, 145 bp, Homo sapiens
cgagctggtaccctcgatagggcaattgggtgtaggagtcagttatatgtttgggatttattagagtacgtgggtgttgagcttgaacgctttcttaagttggtggctgcttttaggcctactatgggtgtctggccttatcgag

SEQ ID NO: 721647 - DNA, 969 bp, Homo sapiens
  misc_feature (706)..(706): n is a, c, g, or t
agcggataggtcagggttccgggggtcgcgatgggctgctagcgggaggcccgcggtggctgcgctcctgacggcggcccccgcgatgtaagagatctaggggaacccgagagagtccagtaggttaatcgacacgagcgtcggtgagacgagtgggccatgcacatgctgctcgaggctctcgcgcaaatattcgagtttctatgacaggcagacttcgtgctgttatgacccggctgctgggctacgtggaccccctggatcccagtgcttagtggctggcgtcatcaccagtcatcttcaatccgctctactggaatgtggttgcacgactgggaacagaagacccgcgaagctgagtcgagggccttcggatccccgctacctggcctgtctactctctaagcatcaccatcctgctccatgaagcgttccgtagtcgcatcgacatctgctatcactgctagtgcctatgctgagccagtcgccaggcatggagagccgtggacactcccacgtctgggcctacatgagctgggtcctcgtcgctcctaggacgtgggcgtcgtgctcgtgctctccagtgttctttgcactggggttcgctggaactttcctaggtgattacttcgggattcctcaaggaggcgagagtgaccgtgtccccttcaacatcctggacaacccatgtactggggaagcacangcaatacctgggctggccatcatgcacgccagcccacgggcctgctcctgacggtgctggtggcctcaactacattatggctctctataagaaagagcccttaacggtgagaatctaccggcagaaagctccgggtcccacaagaggagctgattgagctgcaacagtttggtgaagcctggacaagctcctggctggccaagtggaggcctggccagggagattggggcctgcggtccaaggtcgcccggggtgggtgccag

SEQ ID NO: 721648 - DNA, 208 bp, Homo sapiens
ttttttccccccccctaaggccttttttgaatttaaaaggggaaaatctttttgggtccaaattttccccctttatatgggcctagttttaaatgggttttctataaattttttagccctttttttctggcccccgtagtttaactagatttttttacctttgttttttttttaaataaaccccaaaatttgttaaatccaagggtta

SEQ ID NO: 721649 - DNA, 998 bp, Homo sapiens
gcttgaaccggcttcgtatgctgccgtgtcgtctccgagaaagtactccgcccccggagatgagatctttcgctgtcctgcttggctctcccatagatgctctcgtgcatggtggatgccgctaccctaggggattaggcgatctccaatccgggtagaactctccatctttcctgcggattccacacggcttggctctcccaatgcacatcagtagtgcgcgcatcgtcgcatcgggcccagctcatccaccgggtggtccgggaacgcgtccggttgtgtcggcctgatggacctatggtagtccgaccccacgctcatggggggtcgttcgttcggatgggtgacgcgcctgtgctataaggtcgtcgggggtccatcgcgggcgggtatcgccgcagttgttgttttgattgagccccaacgactccaagtgaatagcacatgggaacctaacgcgacggtggggtactacaccacttgggggattaccatacgttagcgtaaggaacgtgcctctctatgcacgctattcgtaaacacccccggggactttccttgtggtaatcatggcggcatgttatgacggcatttccagtcagctctggaacgtaacgtgtctggcatggttgtccgcggtaattgtccaaactcatgaaggctttgtgcttccccttctgcaggcctaagaagtcgccaatcttgattcgtggtatccacggtctggcgccgggtgttggtctaggaagttgggccttgggcgtgcaagaagcttgacgctccagggtcctcgttaccggggggcttggaccggcttctattggcccattggttcaggggtctggggcacgtttccagggttccacgtttgggctccctgagttttccttaaggcaacgagccggtggtgtttcatgtggtaccccccttcttgtgggtctggcacctgtggagcccccttttcgccaccattttttttgttgccaattggcgccctt

SEQ ID NO: 721650 - DNA, 312 bp, Homo sapiens
caacttaagttttttcagtttttcaaggccgggccttgttcctgattcctcaaaaaattttgactctaaggcctattttattgtctgtctttgaatccctataaagcttcaagtctgtatgacatttttaacgcccaattatatattgttttgtactgttcctagctgggacatgtatattagtcttgtttccctcatgagaatgtaagctccttaagggcaggggccatgttttaatttttgtatcccccccagtgcctagcccagggcttggcccatgggggctgaataaaaacctttgttttttgatca

SEQ ID NO: 721651 - DNA, 235 bp, Homo sapiens
catgagctcatgaggggtcaacattttagagaaaccgccccgcgcaatcgatcaacttcattgcgccaggcgtgagaagatgagcgcccttattggagacctgccccggatgtacgaactcaaaccctgcgaccccactgcctatcgccaacagacccgccgtagcacgttgatcgtcgcggcgctgttcctggccttggccatgctgctgtcgagcctggcggtgatgctgttc

SEQ ID NO: 721652 - DNA, 134 bp, Homo sapiens
ggtttcagtagcacaccaaaaagaaataatatcttatgatgtaaaagatgctatgacacttctaaaactaggtatagaaacttctaaaacgggaagcaacgatgggtgatgctatggaaacttctaaaactagg

SEQ ID NO: 721653 - DNA, 655 bp, Homo sapiens
  misc_feature (632)..(632): n is a, c, g, or t
  misc_feature (642)..(642): n is a, c, g, or t
agcggggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagtttcagtacaaaacggttcgattcatcaaaaagatgctgtaaatgatgatgattttgagccatacttaagtagccagacaaatcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatntctctacatnggggacaagtgga

SEQ ID NO: 721654 - DNA, 583 bp, Homo sapiens
  misc_feature (560)..(560): n is a, c, g, or t
  misc_feature (570)..(570): n is a, c, g, or t
acaccacctgagtcgagggctggctcttcaaacaaaaataatactcattatacccccactctcatccctgaaagaaagccatataggttagtttgtaagaaatattttaagatgtgactactcatcagcaaatttttctgttgataaaactggatttgaaattttaattttgtttatctagaataggtacatcttttattttcatttacttaaaacttcttgattttaatctttcagatttcttttttgctcttttaagaggacatttcgctactgattgtgatattttgttttgcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatntctctacatnggggacaagtgga

SEQ ID NO: 721655 - DNA, 572 bp, Homo sapiens
  misc_feature (549)..(549): n is a, c, g, or t
  misc_feature (559)..(559): n is a, c, g, or t
agcggggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcagagacctaaagggcaaggaaataaagcagagtaacagctatccaccaatgtcagatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatntctctacatnggggacaagtgga

SEQ ID NO: 721656 - DNA, 773 bp, Homo sapiens
gggaagcagggtagcggagccatgggcggacgctcccagccctgaagagaagctgcaccgtatcacccggaacctgcaggaggttctgggggaagagaagctgaatggagatactgaaggagcgggagacttagaaatttacgtgggtgaactggcaaccacgggcaataccacatgtggcttactttgtgcccagtgtcgagagattgcagacttcttaaaggcagggtgtgaggtacactaattctgtttgcgtgacctccacgcatatcctggataacgatgaaatgcccctatgggaacttctagaactccgagtcagcttactatgagcaatgtgatcaatggcagatgctggtagagcgacgggtgtgcccttggagaagctcagagttcagtctaaaggcagctgattaccagctcagcagaagagtacacactagatgtgtacagactctcctccgtggtcacacagcgcggattccaagaatggctggagctgaggtggtagagcaggtggagcaccctttgctgagtggctcgttataccccggaggtgctggcttgggactgaaggagtctctcacacgtcgatgcccattttggaggcgtgatcagcagaaggactttcacctctgcgaggagtactcctgtcttgggtattccaacggtcctctggtgaaccatggttccggttaccgcggaagggccttgaggggtcccgtggcctggccgcggggctgtcccgaggttggcccctgggaggggggccc

SEQ ID NO: 721657 - DNA, 144 bp, Homo sapiens
  misc_feature (50)..(50): n is a, c, g, or t
cggtctagttggtggagcgatttgtctgattaattcttaccacgacgacnaatccggccggacacggaggtgattgtcgccagtaagagcgaggagcaccaaggccattcaaactcctccccacgacactctgaagcaaccacg

SEQ ID NO: 721658 - DNA, 616 bp, Homo sapiens
gcacgagccaagacctcatgaacaagagctgcgctgaggcggtcatgaatgcagcaatggctcataagcagacatgcattatctgatcgctgtagtacctgctcgtactgctcagctatgcgtatcgcctgcaggtactgatatgtgcctgtctatgcatgcactagctactggatacgtgttgactgtagagtcatcgtgtgaggataaggtagacagactaacttagaatatctagttgtgagacatcggcctccctatgtccgaatgtacgaacatcactctagatcttgcttgctgaagagacgaagggcatgaaagatgactacttgaccgatatgtttgaagacgctgcttaaggagtgagactatgacaggacgcagcgagggtcctctgactgcatgtacatgcgacaatgtaccttcccatgacacgagctagacatgtcacgaccgatgctagatattctacgtcagagtctgtatcagttctgagaggtgatgagaccttctacggcgtacgcgtagctgtatcagagttgcactagatgacagcagctggctacgatgaccgacgtctgatatcacctgatgacgtacgaccatcgactgactg

SEQ ID NO: 721659 - DNA, 151 bp, Homo sapiens
  misc_feature (18)..(18): n is a, c, g, or t
gtacggctgagcttgttncttataagaccgctttacttacgtcctttgtgccctataattacccgattccaaagtagaaaaagtagtttcccagcttttgtggtctttgtacacatgctgtcacaatgcagttcttcctttgtctctttat

SEQ ID NO: 721660 - DNA, 934 bp, Homo sapiens
gttagaatgcaggagggaggaacttacctctttctcccacctctagtctctctcctgcgctgtctggtgtatctagtccacatattatgtagtgcatatactatatgactgtacataatatatatgagatacagattccaatgtgcgtatacccaatcatacacatatgggtaattatcgagaaatcataagaagtggtaggtactaggagcattaacactcagtgtgtagtggttaacgtcccaagattcttggtgtctcacatcgaggatgatattatctatgagacggactagtttgccgagttgctcagtctaatctaccagagtaatcagaggcatgctgttggctacgaccgttcactagtgatgggcgccacactctcttgctcggtcgtttaccaaactgtgtaatattcatatgatccataatatgatcattatctcttgtgaagccaagaactcacttatttagaacatcgataggacgctgcgataaagcccgccttctaatccttatatacaagaaatctctatcatacatggttatggatgttatgcgagaccaatccttgataatccaggataattactactatcaggaagcactcaatcgaggctagtattgacgatatagcgacattgtgagcgatggtcgacgtcagaggttgtccaccctaccggatgtagccctccggcggcagtccgggtgtgcaggcattcaactccatgatgcctgtgccgtcgctctcgttcatcgtccgtgatcgtcgctcgttggataatgtcattggtcaactgttttcccatgtgggtctttaagtaccatacggggggttccggtgtataatatctccctggccggggcgcgggcggtttagctaccctcccggtttttttcccccagtttggcctttggttcgtttttcccggac

SEQ ID NO: 721661 - DNA, 814 bp, Homo sapiens
  misc_feature (752)..(752): n is a, c, g, or t
ctctatataaaggaaacgatttgagatcccagaaatgagacaatctatctgcaatggactaagattatatgtggtcagtcactctcgtgaaatcactcttgatatgatagtacttatcgatagcttagagaaaatggatggtttttagtatatatgacggtcttgcacactgatgtgctgtcatatagtactgtggggtgggtggtggagtgcccgattggttgatacaatggatatgcctatagaggggtagcgaaggtcaatggtgctatgaactgaatgtaaagtaaacattctgtgggacataatagtatttgtgcactgtaagtcatatgtaacagtataaacgccctttcacttctgttctaggcgttgaggcctatacaatgtatggtccgctatccttgttcctttgggttgcagcaaagaccatggtgtgatcgggcaactagctagaacagcttcgggcaaagggggacccctgccatgttggccatgtgaagacaaatgaggtcctcgagttcataatggcaaggtagagaaacaaattctggtcataactgaatagaaagcatgagttgttgcagcagcattcactggatttcttaggatgacgggggttccttgcaacgacttacttccctggtaaacgccaaggtcgtaccgaagaatgatgagggaacatggccctaaggggaaggaactctacttcccttggtgagactaggcatacactcgggctggaagttagncgccaaataggtgggacacgctaagactcaagccttcctagggtttcccaagtgttggtgag

SEQ ID NO: 721662 - DNA, 780 bp, Homo sapiens
  misc_feature (255)..(255): n is a, c, g, or t
  misc_feature (310)..(310): n is a, c, g, or t
  misc_feature (313)..(313): n is a, c, g, or t
  misc_feature (315)..(315): n is a, c, g, or t
  misc_feature (382)..(382): n is a, c, g, or t
  misc_feature (406)..(407): n is a, c, g, or t
  misc_feature (593)..(593): n is a, c, g, or t
  misc_feature (607)..(607): n is a, c, g, or t
  misc_feature (641)..(642): n is a, c, g, or t
  misc_feature (670)..(670): n is a, c, g, or t
  misc_feature (686)..(686): n is a, c, g, or t
  misc_feature (702)..(702): n is a, c, g, or t
  misc_feature (731)..(731): n is a, c, g, or t
  misc_feature (744)..(744): n is a, c, g, or t
ctgcagtcaggactctgggaccgcagggggctcccggagccctgactctgcgagccgaaccgtgcacggtttcgatggcgacccatggctatgcagaagctgagcgagtcattgttctactttcttctctcaccttcttagagatcacttactagaagatgataggactctgtggctgcgagcgggtgcagtctatacgctcgggtgctgtattgtgcggtcggtaattggcgtttatggcaggagctgtggctnctgtccgggtcggtagccccaatccccctccattagtcgtagtgtggaacgtttngangncgggccctcgaacttcctatggaaaaatcctaccaggagggttttaccatttcataagatttcttancaacgaggaaacttggaccttaannatcctaagaaagttaaaaaacctccgtgtgttggcccccccccaccaactataaggctctccgtggtctctcttggggtcggtctcgggggcttggctttttgacttggggggtggtcaaattctcctccccaaatgaggggtgctctttcccttattggccacaaaacgggatatccccaaggcnctggtcctcctganttggcacccacggcgggagaacacctgtcccctnnttgtctcacaccactcctgttggccgcncccttgtgtgctgagnaaaaaaccctttatanaccgggcttaacctctccaactgttagcnaccccaaattttntatgtgaaaagagcccatataatatccattaacctc

SEQ ID NO: 721663 - DNA, 525 bp, Homo sapiens
caccacggaacgtctgtctcatatcacgaacagcgaagcgacccaaaggtggatagtctgagaagctctcagacctcactaagcatccatgaaaaagtgatgtcagaggccaaacgtggtgacccacacctgtaattccagcattttgggaggttgaggctggtggttagcttgaacccaggctggtctggaactcctgggctcaagtgatcccaccactcaggctccagaagggctgagattacaggcatgagctactgctcccaaactagctgcctaattttttagtttttttgagacagagtctagtcctgtcgcccaggctggagtgaaatggcgtgatctgggttcactgcaacttctgcctccaagattcaagtgattctcatgccttagcctcccgaatggtgagaattacaggcgcccacaaccacgcccggctaatttcggtatttttagtagagatgagtcttggccatgttgtccaggctggcctcgaattcctgacctcaagttatccacccg

SEQ ID NO: 721664 - DNA, 134 bp, Homo sapiens
gctttaccacataccagtggataacaaggtcatattcccgaagaaggagccaattgaggatgatgtatttcagaaaatttgtccttgagcaagttcatagtgaccgatttagtcataatgatggtccgagcgga

SEQ ID NO: 721665 - DNA, 280 bp, Homo sapiens
ccaagggggagagatttaggtattttatttcccaaattctctggtccccgggttttgccccggggaaattttgagaaattcccaattttttcccagataaaacatgaaaagtttgccgttggttcccccccccccccccccctttttttagttttaatttatgggttaaactgagggcaccaacccatggggggggtcaaagagggtacaaatgtatgggggtatattgaatgctaaacatattactgaaagacccattttaataaagatttttgtcata

SEQ ID NO: 721666 - DNA, 180 bp, Homo sapiens
cgggggggggggggggggggcccccttttttttcccaaattcccggggggggaaaattttttttccccccttttgggggggccccccccaggggggggggggaggggtttttttttacccctttgggggccccacccccaaaaaaaagggacccctaaaaaaaagtttttttttttttta

SEQ ID NO: 721667 - DNA, 126 bp, Homo sapiens
ccgattccagagacaatggccccgatgggattggagcccgaaggcgttcattcgagaggtaacttggaattagatttttttacaagctttattgacatgaacctctcggagtcccttcttccgtgg

SEQ ID NO: 721668 - DNA, 392 bp, Homo sapiens
  misc_feature (2)..(2): n is a, c, g, or t
  misc_feature (313)..(313): n is a, c, g, or t
cngcctgctgagtaactgggactacatacgcccgcccgccaccaagcttatctaatttttgtattttttggcagagatggggtttcaccatgttgtgcaggctggtcttgaactgttgacctgaagtgatccacctgcctcagcctcccagagtgctgcgattacagacatgagccactgtgcccaaccttggtagttctgagatctttaaaaaatctccaaactgcttcccacaatggctaaccttatctacattcccaccatcagtgaacacgaattcccttttctctgtagccttgccagcaactgtttnttttattttaataggcattctgaggagcatgagagggtatctcattgtagtttcgatttgcatttctctgatgattagt

SEQ ID NO: 721669 - DNA, 542 bp, Homo sapiens
attgaccaggccggcctgcagagggagaaagatttcaggcccaagaaagttgcggcattgggatcccgtggcagtgcagccacttaagtggagaaggagacccagaggaagatgaccatcctccagacatacttccggcagaacagggatgaagtcttggccaccctcttggcttttgtttgtgacattcggccagaaatccatgaaaactcccgcataaatggatagaagagagaagcccctgtgctgtggagtggcattttagatgccctcccgaatatgaagcttagcccagctctagttacattcttatgatagggcctttaatttttttccaaatattaaataataggcccttcccctttttggagaggagcaaatctagcttttttggacagacttagaaattatctaaagatttcatctttttccctcaaattttttaggaatttaagggttaaatgttgtctttttttcctatgtcttttggcccaagcaacatgtaaatcagggttgactttttcttttttagatctagttta

SEQ ID NO: 721670 - DNA, 321 bp, Homo sapiens
tgtgtgtagtagcaagcatagggatcattttgcatgtggtaagccatttaccaagattgttgtaggtaagaagggcagattattagagaaattgtgaaaatatgttgcagtgggcagctcagcagagaaggggctacctgcaaagaggcaaggtgctggaggaaagttttatagggtcctggtgaagggtgctacgtgtgaaatgaggtcattgtgcccgcaggttgtttgtgattagctgtctctaacaattgttcatacaataattgttcattattgttctcaacttggggctctccccaacctggggacccttcctta

SEQ ID NO: 721671 - DNA, 272 bp, Homo sapiens
gagggtcgtgtgtgccgtctgtgtgtctgtgctgcgggcttgagtcttcttcttcgacgcatggccccaggctgtctactgcaggttcctgtgacaagtctgacgccacgcgccgccatcctacacatgatttgctctaaggcagtgcagcagtgtggtggtggctgtccatgtcccggccctcccgagctcttgtcttcttccctgctgctcttcacctacgctcctccacatgctcgtgggatctctagagtgactgagcatagctgact

SEQ ID NO: 721672 - DNA, 280 bp, Homo sapiens
gatcgagccggtacccctagtttagaagtttcaatagcatcatgccacgcactctagccggggcaacagagtcagacccatctcaaaaaaaaaaaaaatttatttgggagtcaagagaagacccaattatacccaagacaatcctaagcaaaaagaccaaggcggggggcttcaggctaccggatttcaaactatcctacagggctacagcagccaaaatagcaggctatggaaactcccaaaacaaggggggaccctcaaaagtcgaccggcgggcagg

SEQ ID NO: 721673 - DNA, 306 bp, Homo sapiens
atcagatatcctttctattattgattctaggtctttacataattacttaactctttcaaccaattgccaatcagaaaatctctgaatccacttatgaccttgaagcctgcactttgagttgttccaactcttcagaccgaagcaacgcgcatcttacatgtattgattgatgtctgattgaagcttctgtccccctaaaatgtataaaatcaagctgtaaccaaccaccttgagtacgtgttcacagaccctcctggggaatgtgtcttgggccttggtcacttatatctggattcagataggagg

SEQ ID NO: 721674 - DNA, 520 bp, Homo sapiens
atgtacaggactgatcaggagaaggacatatgacgggacagattgggtgactacggcaagctgatggttgcccgtgggaaatggtgtaaagagcagaggatggttctgtcatcgataatgaacggattgaccaagatgctcggaatctcaatgaggctggattgaagaggaaatggaactgatgtccccaatgttggaatcaccattatgaccgagcggagcgctgccaatattcgagaaagtatctgagaggtacaagagttacagcccttatgacatgtgggaaagcatcaggaaagaggtcaaaggagacctggaaaattgctacctgaagcggagtcagtgcactcagaacacgcgcctgtatcgggcggatcggttgtatagactccatgaagggcaaggggacgcgagatagggtccttgatcagaatcatggtctcccgcagtgaaggtgacgtgtagaaacttaggtctgacttcaagagaacgtacggcaagtccctgtactattatatcc

SEQ ID NO: 721675 - DNA, 596 bp, Homo sapiens
  misc_feature (470)..(470): n is a, c, g, or t
ggccggcctacccagccatttcatgacattaagatggagcaagttatttcgcctcagctaggcctgtgagatagaccgcctgaggcctgagctctgttgtactgccagatcaattcatatttggcagtgatacgtgcgcacgctgttttacagatgactatattttcttacctgacatacagcatatacttatgtcgcacacaatgttgtgtagacaacctgctagcgccaggtagtcaaattgcccctgactatctaatgtttattacatgtgcagacactgttgttgcttactcagctactgatcaatacaccctgcacattgtgctaccatgcaattggctactagacgacactccaaagcatctatggacactgttcccgaatttttacacaagtcactagtatgacctagttaatggtcacatcaggtctcggctataatggtgcgtctctcctagacccagaangtgtgtttattttgcatcccggccatagatccctaatacctcgtgccaatagctagtaggtagcaccaacgctgcctcatggtgtagatttagtataaccgagtatgcaattgactatttgctctc

SEQ ID NO: 721676 - DNA, 223 bp, Homo sapiens
  misc_feature (154)..(154): n is a, c, g, or t
aacactcagaccggacgggacgagggattcccctgccttcgcttccctccctcgcttgctttgtagttttcccgcaccagcccgctgccctgcgccatcctagggcctcgaagcccggggaatctgtcccatcctgtaacgggccgcccccttngatttttctgcccgtgccaccggaggttgctgcgacgcgcaccgactcagatcattactactgaactcg

SEQ ID NO: 721677 - DNA, 925 bp, Homo sapiens
  misc_feature (526)..(526): n is a, c, g, or t
attctagaggccgaggcgggcggatcacctgaggtcgggagttcgagaccagcctggccggcatggagaaaccccgtctctactaaaaatacaaaacaaaattggccgggcgtggtggcgggcgcctgtagtcccagctactcgggaggctgaggcaggagaatggcatgaacccgggaggcggagcttgcagcaagccgagatcgcaccactgcactccagccagggtgacagcgagactccgtgctcaaaaaacaacaagcaagagaaaaaaagccaaaaagaaaaaaacccttaagtttttatgcgcctaaaagccctaaaaagacaaaagcaacaaccaaattggcccagggcgtgtgtggcggcattgcccgtgtgtgtccccccagcatattgggacagcgcgtgaggcaggagaattcatgttgaaccctggggggcgcgacaggtacgtgacgtgtgaggcaaagcagcaatgtgccaattggcaattccgggaccgggggacagacgggaaggacgnacacatgtcatttgctcgagaagaaccatacagacacgaactgaaaaggcccctagaaaaggacacgaggggggggcacaaaggcgggcagggggtttccgccacgtcgtggcgtggtctccccccatcccaggggggtttgggggcgcgaacaaggggcgacacattagcaacacagaatgaagaaaaggggtaaccacaacgggggcgaacgtgtgtgcaaggcaaacagatgtgtgctcagggaggggctggtgaacaccgtatcaaatgagaatggctctgaacagcgggatcatcacgcgaacatatattggccaaacgagacacggggacaaatggggtcgggagtggtgataacaccacgagggcgggtttacgggcgcaacccccgtgggg

SEQ ID NO: 721678 - DNA, 1041 bp, Homo sapiens
ccgtcactttgtgccgttgtcatcctgacgactgatcttcgatctggctggtacttggtgacatgatgccggtgatttaccagatgtcatctgctgcgcggagtatgagtgagcctgagtggtaggccgcattggactgccggtgtattttccatgctcgcgtccagcatcggagcgcgacagtcagacatggttctccccgggcttggtgaacagctgcggttgggagcaaagaatcttgtgagacgtcgaaggtcacagtgcgcgcggattgcgatgcagcactgtcgaaagcgcgggtcgctgtgcccgcgttgcgttcgagctcaatcactgtttgttgcgccttgtcacggagcagatacgatgttggcgccgctgtgtgagtagactcgtgcacagagatcgtgagagcacggaatgcacaactacggttggtcaatggggggatgcaataatcgaacattgtggcgccgacgacaggttcgagagtagcggtgagtgacaggctcagacacgtagacattcaatactggtgagcaagacactggtagagatgtagaaacatattggtgtgagtgggaggggtggcgacggtctcatacaatgggtagagcagaggcgtagacagccttatagaatagacaggagcgaataggagaataatccaacagatgtgagcgattaagagaggagacgatgagaatgcacgcagcgagagtacagaattgtggccacccacccgtggtgaggggggacgtggaagaagaagaagagagatgaatttttttgagcgatggaaaagggaagaagatatggggtggagagagtacaaggatagcagtaagtaccacaagtcaacaagattgataactagtatgagatgtgaagaaataatagtagcaacgtaaaaaaggaatcatagacaataaatagccatgggatataagtgaaatggcggcaagtaaacagacaaatatagtagaaatgcgaatcagtcatcagtgaatgaaaatcaaaaagcaccccaacattatacac

SEQ ID NO: 721679 - DNA, 309 bp, Homo sapiens
aacaaaacaaaacaaaacaaaaacagtatggagtttcctaaaaaaattaaaaatagagctaccacatgacccagcaatgctacttctgggtacatatccaaacaaattgaaatcaggatcttgaggagatacctacactcccatgctcattgcagcattattcacaagagctcagatgtggaaacaatctatatgtccattgacagataaattgctaacaaaaaatgaggtatctgggtgcagtggctcacgctgcagtgagctatgattgtactactgcactccagaatgggcaacagagcaagactc

SEQ ID NO: 721680 - DNA, 448 bp, Homo sapiens
  misc_feature (165)..(165): n is a, c, g, or t
  misc_feature (223)..(223): n is a, c, g, or t
  misc_feature (261)..(261): n is a, c, g, or t
ccttaagtgggagctggggtaaaatagggttgaaaacctactgggctgcattccccagatagttaaggcattctaagtccacaggatgaagataggaggtcagcacaagatacaggtcgtaaagaccctgcctgatgaaacaggttgccaggaaagaagcccagnccaaaacccactgaaaccaaaatagtcacaaccagtgacctctggtcatcctccctgnctacattccccaccagtgctgtgacagtttaccaatgnccgtgacatcaggaagttaccctatatggtctaaaagggggaagcatgaataatccatcctttgtttagcatataaacaggatataaccgtaaaaataggcaacaagtcagcctcacggctactctatctatagagaagccattcttttattcctttattttaccaaataaacttgctttcacttta

SEQ ID NO: 721681 - DNA, 364 bp, Homo sapiens
gggtgctacaagagagtatcagaaaaattcttctagacatgccttaggcaagagtatatcatgactaagaccccaaaagcaaatatacaaaaacaaaataaatgggacctaaatatactaaaaagctcctgcacagcaaaagacataatcagcagagtaaacagacaacccacagagtcgaataaaatattgacgaattatgcatctgataaaggactagtaatctacaaggaattcaaagaaattagcaaaaaaaaatcctatcaaaaagtggacaaaggagatgaatagacaattctcaaaacaagacatacaaacagccaacaaacatatgaaaaaatgctcaacatcactaataatcgga

SEQ ID NO: 721682 - DNA, 317 bp, Homo sapiens
ctccagagttgagttagcttactggtaaaagagggggagagagagagagagagagagagagagagagagagagagagagagagagtgtttttttgtaggatgattggtgcttcatgagagtgagagattgctacatacagttgtgtgcgatgtgtgccgctttgtttgagaagcattgctcagggagcgtgcgctgagagactgcttggagtgagtatgtggggtctagagtagcgatctctgagctctccagtcagtgtgtgtgtggttttggctctacacagagtgtgccctggggagatatttactatattttc

SEQ ID NO: 721683 - DNA, 339 bp, Homo sapiens
gaagatcctggtgtcgccatgggccgccgcccgcccgttgttaccggtattgtaagaacaagccgtacccaagtctcgcttctgccgaggtgtcctcatgcaagattcgcatttttgacctcgggcggaaaaaggcaaaagtggatgagtttccgctttgtcgccacatggtgtcagatgaatatgagcagctgtctctgagccctgaggctgcccgaatttgtgccaataagtacatggtaaaagttgtggcaagatggcttcatatccggtcgctcacccttcacgtatcgcatcacagatgtgtctgtctggctgaaggtcaacaggatcaggtgc

SEQ ID NO: 721684 - DNA, 114 bp, Homo sapiens
aggcaaggtattgagccccagaagcagagcccacgggccttgggatgggcctgtagtatgtcagctcaccccatctgtgccaacctgggagccaccagcagccatctccatgat

SEQ ID NO: 721685 - DNA, 100 bp, Homo sapiens
tttaaggctcagaaaactgtaatcaacaaggcaattaattctcataataaaaataacccttacaaatagccaaggtgtcagtcagatccatagtgagtgt

SEQ ID NO: 721686 - DNA, 297 bp, Homo sapiens
  misc_feature (39)..(40): n is a, c, g, or t
  misc_feature (108)..(108): n is a, c, g, or t
  misc_feature (150)..(150): n is a, c, g, or t
  misc_feature (173)..(173): n is a, c, g, or t
  misc_feature (179)..(179): n is a, c, g, or t
  misc_feature (240)..(240): n is a, c, g, or t
gacttattctattgagttaatctccagtctcatatcctnnctttcgcgtgattgatttggctattgatacttgtgtatgcttcgcagagttctcatgctgtgtttttnagctccatcaggtcatttatgttcctgtctaaactgattatnctagttagcaattcctctaaccntttgtnaaggttcttagcttccttgcattgagttagagcatgctcctttagctcagaggagtttgtnattacccaccttttgaagcctacttctgtcaattcgtcaatctcaattctccgtcca

SEQ ID NO: 721687 - DNA, 732 bp, Homo sapiens
atcaggctgttctggcccggaagttttgggcatgcagcgtggtgagccttgacactgcttggctgcccaagccgtcacggactgtgtggtgcccgcgccctggcgctctggagggacgggcgtctgcgccccctccgggagtgccgggggtgagctggccaacctcatgccaggcggagctggtggacctagtacaatggaccgacttaatcacttttcgactacctgacggccaacttcgaccggcttcgtaagcaacctctttcagccatgcagtgggacccgcgcgtcacgcagctgtgccaccagcaacctgcaccgcgtgtccgggcgtgggcgctggtctttcttggacaatgagagcggtgcttgagtgcactgtgctaccgggtagcaggcatgtgggacaagtataacgatgccgctgttgcagtcatgtgtgcgtgttcctgctgagcggacctgcgcggcgcggtcctagagctgcaccgcggacaggacgccgtcggccggcttgctgcgcctctaccggcgccacgagcctcgacttccccgagctggaccagccctttgcagaccaccaacgcatcagcctgactacaggcagcccgcactcgacatacctcgcccaatgcagcattattagcaacgttgtaagggccaaagttaccggccagtccgagtcatgggacctttaggtgtcacgcgggagggaagaagaggagagaatct

SEQ ID NO: 721688 - DNA, 169 bp, Homo sapiens
tattctgctgcttaaagagtttggaattggagagcagtctatttgggattggagaccccttcgtggggttttgggagggcctggtcggcttgttggcagaggagatagctcatgagggagactgttgggaggtattctcctagctgagagttagaagtgcgcctgggtg

SEQ ID NO: 721689 - DNA, 1751 bp, Homo sapiens
  misc_feature (76)..(76): n is a, c, g, or t
  misc_feature (1057)..(1057): n is a, c, g, or t
gaagaggtgtgatgtggctaccagtgatcaatggtggtctgagatgacgactggtgtgacctgcgctcactcttgngtttttacagcggaacgcgttgggtctgtttggtggcctcacgcagttaaaggcggtgctgtttcacgctaatctagtctacgagataacgcccctctggtgtgtttaatgggggggggccatcctgtgatgtatatattctcttctgaggcggattgtcgttgttgaggggattctgttgccgttgttgatgatttgctctgaggaggatcacacattgttggtttgtgtggctcgagaatcgagtatgtgatagcggacctcaccatcaggggggatgtgactctcctctgctatgaatgattgagttgtgtcttcgcgccacgtgacaattgacgatccgtttagagagtttgttgtgtcaacacccgctcttgccacgatgtgggggaggctgccgcttcaataaagagaggtgtgttgaaaggtgagaagatgtgcctccccaatggttattagccgccttgtgtgacgatgatgctagcggcggccactacagtgttgtgattcaatagaagaatagatgtacgaccgtgttgtgtatatatggattctagattgtgccacataaggggcggggcagtcgtcgtgcgttgttttgtgtcgctcctgctatacatccactgtgcccactgggggtgtctactcccccagtgtgttgtgctgtcctactgcgaggaggggattcgatcgttcgcgctattgtctgtggttttttcgtctggttgtggtgttgtgtgctctctctaccgccccgtgggtagatgattttatgattgggtggtttacatctgctgttttacgatctcgttatgttgtgttgtcgcgccttcgctggctgttaggttgtctgtttctttgcttggtgtgtctcttcgtggtagtgtcgcccccctctgtggatatcgttaggttttagtaaagagggggcgccgcacgttgatgttatgtggtttgcctctacgaagagatataatgttncgcgcccatcatataggggcgtgttttgatggtctgagaagatgggccaccagaatgtgctgttgtggcggcagcagagagagggcgtcacaacttgggtggcgcggcgtcggtcaactagattgtttgtgtctgtttggagagtgggcacaatatttgtgagacacttgctgcgtaaagagagtttttgtttgtgataagagtggcggcaaatcgtggggtgtgtggaatataagagatagagtttttgggcagctgtgtgtgtagagagagagtgttgtaaaaatgtgtgtaatggaaggtggaggagatatgaattgtacaaaagtatgtggtgatgtgtgtcaccctctctgtgtagagagagagaaaatttaaaagagaggtgttgtctgcctagtgtgtccctctgtggttcttctgaagtgagatgtgttgagctctgtgtgagctcgtgtcctctcggcgagattcgatgtaatgctcgtgcataagtggatctggataagccttaagggccaaaaaaagaaaaaaaaagatgtgttcttgttttctgaacttcgtggccatattttgtgtcctgatgggatcaacttaatgtttaagactttagatgtcttgtatttaaaattaccccatgaaagtagaaactttttatacgttacccttttaactctatagaagaaataaaaaa

SEQ ID NO: 721690 - DNA, 1167 bp, Homo sapiens
tgttgctggcccaggtgagctggtgctcgctgagttccaggtgatgcgtggcgctgtccccgcgacggacgctgcctgcccgatgcggttcacgtaaagacagcgagatccttgagggccagcctgggaaggagggcgtggaatatggagctgtgctgctgccaagtccgggtgcccgcagccgggtgaccataggcgcagatcctggagtgactctggtgagggacgcgcccctggggaccaggcaggattcgtgtgactccgtagacagcaccggctgctagtaggcgcattgggccctctggctactacgggctccacgcgctaaaccctttccatagataccttcccttcaataggcctgctatggttgtacagagtcgcacaaggaagcagggcccaaggaacaaccggagctggggaggaaaccatccccttgtaagaaccattcacgggaaatgggccgtctcaattaacgaattaaggccagcggttagcctttgaaacaggccaggctccttatgagacccctccagtgagaacgggcagacagggacgggggtctcttgccgacgataatacaacttggcacgttgagatggattcgtaaaggcccgattgcccgcagggttacgtggttaattaaaagcctgtccccccaaaccgaaatgtggcaagagtgttgggcgatcttcccgaagatgagataggggcagtgtacactcgttaaaccatgggggtattccctattcaccgtagaacaaaagtggtatgacaacgccaaacatacggaccaggtgttccttgtgatgcaccctggtgtgggcgacaacgccaaagaattgacctgtgccatgaaagacagttccaaggtactgggccgtcttccagagaagttcttgccgaggaagtgtacccagacacagcgccgttgtgtagctacagctacgtacacggtttccagggccattgtgaaagaccgatccagagtggagacccttggtaggggaccgcggcgtggacacgatgcagggctcggcaagagcgcagtagtctggaagccggcccacaacggcgccgccattgccgggtgctcataatgcatgacgcccaccgtagcctcttagggagaagaggacgcacacgatagtgcccgcaagcaacgag

SEQ ID NO: 721691 - DNA, 580 bp, Homo sapiens
atattaattatttcatttatttatttccttaactcatcactttcctttacataatattatatataatcatcccccccccacaaacaacacttctaacaccacaagatccaaagaaacacatcccccaaaaacaactcaaataaaacttttaatataaactacccacctacatagagacataaaatcaccattacagcaaaaagaaacctgtatcaaaaaaaaaaaatattatcccgagaaaacgttccacacccacctttacaccaacaaaacaacaacactaaaaaataatgctatccacctacactcaaaaaatcaacctcaaatataccccccacctaaccatcaaacaattataaaatacactccaacacaaaaatacaataaacatattttctcacactaacctctaaatcaaacacataccaacactccaatactattctcttctcaataaataaataaaaaacacccaccatccttattaataactaaataatcaaaaatatttacttatcctaccacatactcaatctcacctataaacaacaaaacaacatttcacatttataacgacact

SEQ ID NO: 721692 - DNA, 429 bp, Homo sapiens
cgtgcggtgcagcaagtggagcggatcatcttgagccatgcagcgggtgggacgcagcctcttgtcagcaaaacagtctgtgcctgtgacgctgcggtttcctgggccttactgagatgcaggacgggaaggtatgcgcagagcccaggaatctagcaagatgtaaaagagccctgccttttcagtaattaaaccctgggcatttaacagtgcttaactcgtacttagaaaaagtagtgcagagatgcttgtagagaagccagatcgcctccggcctaaagcagaaaacagctcccacctcctgacttccccactcccagtttgcctctagaggaaggagcccctccatgcactctttggggttctccctggttctaggtaaagagctcatgaaattgctttgatcgttgccaatctaatgggaggtga

SEQ ID NO: 721693 - DNA, 1275 bp, Homo sapiens
cattgtcaggaatgggcaagtctacttcctgccattctctgaaggccccgcggggaccagcttctagagctgagctgcctagataggctagaagcgttcaggactctgcaggtcaagggatatgtgatagagcacgtgactagaggtagttatgctcgttcagcattgcctagaggtatgcacagatgactttagtcacgaatctgatagggctataccaagcctgggatcactctttccatcccaagcctgagcgagtcagatgcactctggacatcttcattagtcggctatactgtacagtccgaagacagatcggctcccgggctggccccttcaacaagagagcgtctctgccgatccagcgctggataagtcctccccgaatgccattggaccaggggcatcatcggtcattgagtgcgcagacttaatttactacgcctaagttcgcgatgccgtcaactgtgcgaactgtaagccatcgctgcacaggatcccctattaaaccctaaatcgttcagtgcgtggtaaacccacctaccttgtccaaagtcactccgtgcctgcgcctggcgggcacaaggcaggcgcatggagtggttgtattccctaagggcgccttggcttgccgtggcaacacttcaacctggcgcatttagaagggtctccatcccatgacatgcctgcccaagcaacaacgggaacggcggaagggaccaccccgcgggaaacgcccagggcgacacgggtcggcccttaacagtctcgccacgccacagtgcggcacacggccacgcaacacggaacccgggggcaatagagggagaccccgtggcaccatccggcgggcgaaccttcccataaggtggaccacgaatcaaattgtaccttaaaaactatgctcccgcgtataaagttcgctcgtaacgtaggcacatacccccaagtgcgtcatccccaaatgtgggccacaaccagggggggccttccccaagggatacgccgttctttcttctaaaagttgggcccccactattcgttataacaacacttcccttgggaactttgtagcactcgtgaaccaggccgggccgatgttccaaaccactaccgcttaacactgtgatgctagacccctgtgaggagatgagtccagattggcacaccataagtgcgtctaaaagcaactggatgcgatattataactccatggggctctcaactagagtgacccgacgtaaggtgttacatacccatgtggtcgctcctaac

SEQ ID NO: 721694 - DNA, 138 bp, Homo sapiens
agattctggcatgtggaaataggagagaatgccaacacagcccaacatccagctgagtcctccgtggcggagcccactgtcacaaacatcctcaagacgatggacgcagaccactctaatgtcaccggagtggactgc

SEQ ID NO: 721695 - DNA, 364 bp, Homo sapiens
tggagcccccggccttaaatgttttgggtttaacaaaacggggacagggtccaaccccagtccccgaggagggatgtcagccctgggcccctgtgagcgctgcaaatttgtcccaggaaagggtgaccggggttgctgctccgggattaccagctaaatacctgtattaggatcctcaggccgccctgggagacgcaggtcaaggccggtcccctttttggccccttataaatatttgggggaaaaaggggaaccttttcccctacggttggggaaaaaaatatgtaaataaagcctttaaaaaggggttccggcccccttttccccttgcaaaaacattggctataaatggtgataattccca

SEQ ID NO: 721696 - DNA, 842 bp, Homo sapiens
gagcccagctagtgccgggcggagggtgtgcccatgccgtggacgagtactccttaaagccagtggctgtagaagtcaaatctctgctgggggaggatgtcatgggctatgacatggactgtgaataggtccagaaagtggaggaagcactgttgcacgaaccactagctgctagggttcatgtcaatcctgcatgggacgaacggctcgcgctattcatgtggaggggcaagaagggcaagggacaaagatggcttcttggtgaacaatcggattcagacgcctgagccagccgaagagagtagcaaagcttatccgcagctctcagctttccaacgtctatgggatgtcctacttgtcgaatgcatgcgttctcgggcaagctgctttccatcatcatggcgccagcagcttgccaattggctaaggtgaagtccaactcctgtcccatccatcaatggctggatggggggttcttggaatgaaagtaaaggaagtcgtcgcagactcatctctgtagcaaaagggcccttttgtgacgcacaccccgaagtagtcgtacactctttccttggtgcctaatcacatggagggggaggtttaataggttgtctacgcacgagtagaatctcaagtcttcattcagaatacattatgggcttggatcgagaaaagtccaactagatgagtgatctagtgtgggttgagttgggagagtgtggctttttacccattttcctttaaagggttgtcgtcaaaactaactatgggatgattggtcaacttctctggtgttgattgaaagaaggggagtccaggatttgtgtaatgtacctaatgtg

SEQ ID NO: 721697 - DNA, 152 bp, Homo sapiens
tatgcgtgcaggcaggcgggagaggctcatgccccgacgatagcgcaccgtgttgccggcgcaccccgatcatgaccagcggccctgggtggcagcattcggtggcagcggccggcattcgggcagcgggcgcgctgcgccggtgcatggcg

SEQ ID NO: 721698 - DNA, 1048 bp, Homo sapiens
gctgaccactatcatggctggttggcaagaacaagcgccttacgaataggcgaggataagaagtggagccaagaacgataagtggttgatccattttctatatgaaagagttggtattgatgtgaaatgcaccatgcttatgtgcaattattaagaaattacttggagatacgactgcttcgttgcaccagggaccccagagggaaaccaataattgtgcactcgtgacgtggctctacaaggcgatcgttgctgtttctcgagaggtgagatctgtgcgtgcattgtgctagacatgcactcgcaattgtgcatcttacgcaacaagtatcatacgcttgattcacctgcagagcactgtctcagggctaacaatcacatgccgtgacttaaaacttccattggtcatggatgcttaactccgttgcacaacactgtcgttcccatgggtctaacaaacatgggccagaccgacactgatttcgaagactcaacgtcgcatagtccaagaccttacccgactggattactctagcttcagtactagcttctagtgctaagagttgtaacatacacgaagacacgcaaccaaatcagcattacgcgacagacacttctctatgcctccaggcaaccaaacaaggtcactgccaacaatcctggacagaacgatcgcaccgggaccactccattggacccccgaagaagggtagcccacgaacaacactgaccttggcccaacgcaacgctggaccaactcaaacccagaatctcccaacacccagcacaactggcacacacaaccatagcacacacgagctagccccacacccaaccatacataccctaccttccaatcaactggtctattcaccgttcacgaaaacacgttcacacacactgccttgcaccctaccagcccccacagcttcgcccatcggaggaaacagctcaataggctaactatcaatgtgcgcactcggcacactaagtcacgggcacacaacccacatcgcacaaccacgaacagcgtggccacacgcacacc

SEQ ID NO: 721699 - DNA, 146 bp, Homo sapiens
atgcttatatgtggacgtcactattgtccacctggtatggcagcaagcataccctaccctcctgggtgagatctgagaatgagaaacaccatgctatcacaacggatgctctcctatggcattctaccccagtgccctcaaactga

SEQ ID NO: 721700 - DNA, 192 bp, Homo sapiens
cggcacgaggtgtaagataaaatacatgtgtaaacttgcatgtatgaaaacccagccaggcacagtggttcacgcctgttatcccaacattttgggaggccaccacagagggaagatcacttaagcccaggagttggagaccagcttgggcaacatagcacagtgggacctgatctctataaaaaaaaaaaa

SEQ ID NO: 721701 - DNA, 179 bp, Homo sapiens
gcgagcagtgtcactgtgtaatacaccaaggaatacgtatgcaatccatgaaaagaatgaaatcatatcttttgaaacaacatggatacagctagaggccataatcctaagcaaataaacacagaaacagaaaataaagtaccacatattctcatttgtaagtgggagctaaacattgg

SEQ ID NO: 721702 - DNA, 402 bp, Homo sapiens
  misc_feature (402)..(402): n is a, c, g, or t
gcgcctttctgtgctctcgcgtgcaggacctgtgcagcatcgtgcgccgcgccgaccgcgcacacgcgcccatatggaacctctaaggacgagctgctgtgttcccagatgtgagagcgtctgtgtctcaagctctgagaggtccgctgaagacccggggcacgcatcttcttctttgacggcaaggacagttctgaggcgaccccacactggccccagaagaacgtgtggcatggctcggacacccaacgggcgcaagctgaccgcagagcgtactgggagacagtggcggaccgaagcttccttgggcacgggccaagccttcttgctgttggggggcaagctctctggggcagagagccgcgagctggcattacgcctatttgtgctctgtgttgtgcn

SEQ ID NO: 721703 - DNA, 419 bp, Homo sapiens
tgtgtgagtgtctgcgcgcgtgcacccgtgtgtatccgtgtgtgtgtcagggtgggtttgcttgtggtagtggtggggtgtgtctgggtgtccgtcagcccctctttcccgggatgaggctgccggggctctagtgctggcgcggggcaaagcagagccttcctgccccgttggccacggcgggtccttgtcggaacaagcgacgattgtgtaggcgttgtaagaaaaactgcccgcggggctgggccggctgttcaccccggtcagcctggcggctctgggtgtgtggggcaacagggggccttgcaggaggggcagcaaggaatccaaaatattttttccgcggcaaagcggaggaccggaggggacccaaggacagtggccctgggccctgacgcctcggagcacaccccttcctg

SEQ ID NO: 721704 - DNA, 236 bp, Homo sapiens
ggtccgtatacaagacggttcgttgctcactaggcgaggtcagacgtgtgcgaaaatgctacaagataggcacaagacgaggttatcaaggctggttttggttgtgtgtttgacttgaaggttgattcaacatttctcgtcctttgatgggcaacatctacacgaggattgacccctcaaccatgattttggacatgggttaggcgaacaaggttatacgtattatcctctctgcg

SEQ ID NO: 721705 - DNA, 206 bp, Homo sapiens
ccctttgaaattttttttttgtttgtttgtttaaatcaagcctgaggctggtgaacagtagctacacaccccaaattgtgtgttctgtgaaagctagcttttttgaatttggaaattggttattttttaaaaagggtaaaccaagttttatattttgcaatgcgaacagggacctatctgtttttaaaaaaaactgtttacattca

SEQ ID NO: 721706 - DNA, 1125 bp, Homo sapiens
gtcaaagacatgcgactttatgaggagcgcgggcgccgtgtcagatatagctgcgccgatgtagtgagatagcatttaggtctcagagtcactgtcttagcagccggttcatgtctcctatgtaggccaatcgaaggttggcattggctgagactgagtacagtccgtggtagcaatacaacgacttagggcaagagccagggaggtatgagacgcactgaatacgcggatatcgggtctgatgggcagacgatcgcctgcgtttccttggatagtgcaggcagttatggtctcctgtgtacgcctgagatggctggcgactgccgcagacggataagtaccattcgagagcgaactggcagggatagagagcttgaactcgaggcaatacatcggtttagctctaatgcagttcggccggaactctcagtttagacttgacgtgctcccactgcagctaaatacgcggatacattagtaattcaagcggtagatcgagcggcgtagaaagtactccgagggccacctcggtagtatcgcattgagaagttgtggctcctttatgcttaagcggttgcacacacgtctgaaaccgttaaggcacagttgcccaatgccggaaatgctgtggacgaatggcgggttgactaccaatcggaatgttggttcgaaccgttctcagtgttttcaaagtcactagttgcggccaccgatatatgtgcaaccttaggctgcggcactatcagagcgagagggccacacaaaatatttgtgaccgccagatgtgggaaatacctccggccctcggttgagaactaaccgcgtccgtttagacgataacggcaagcctaattccgggtttgcgacagtgtgggccagcaaagtatgtagcgtctacaaggttattagagacgacaccgcggtatgcccttctgcgaggaggttagacgccttataggggagccaccgacgaatagagagctcgttagtgtgtgtgaatatcccaactccgcgatagttccacacctgaaacgcggtgccggccatatatgttcaacacaaattcacgcccaatatgtggccgcatttccggagaatataggcgcttgaagattattacggtcg

SEQ ID NO: 721707 - DNA, 184 bp, Homo sapiens
  misc_feature (95)..(95): n is a, c, g, or t
  misc_feature (126)..(126): n is a, c, g, or t
cattgagtcggaaagtactaatgtgttgataattagttagttgtggcttcatggaaactcccgtaaataaagcttcaggttatgtctatgttcanttctctatagaagaaatgcagaaacctaaanctcactgtattttaatattgtgttattctctcatgaatgaaatttatgtagaagcaaa

SEQ ID NO: 721708 - DNA, 429 bp, Homo sapiens
atggcggcggcccacatcggcataaccttgaggctgaggcagtggctccttgcacagcagctgcacgggccgtggttccggatctcttcgtctttgcaccgtaccccgagtcggtcaccgccgaaaaaccttatcagccatgtccaagccccatatagaagccgggactgccttaattcagacccaccatttgcacccacccatggttggcactggtaggttgggacaccagggaagtcaacgcctcactgaaacatggctgtgtttgcagcctgctctaatgggacaccccaaagcctgtctgcccatcatgtggccccacccaatcaagggaagaaggaggaatgctggactgaaggcccccgcaccctgccaagagggagacagcttcctttcctgcgtgtactcgtgccagctcctttagccagc

SEQ ID NO: 721709 - DNA, 306 bp, Homo sapiens
ggaaacgcacagcatcaatggagaagtgagaaaaatctctctgtggggccaagcgcggtggctcacgctgtacttgctcatgcctgtagtcccagcactttgggaggcgagacgggctgatcacgaggtcaagagatcgagacatcctggctaacacagtgaaccccgtctctactaaaacacaaagattagccgggcgtggtggcgtcgctgtggtccagctgctcgggagtctgaggcaagaaatggcgtaaccgggggcggctttcagtagccggtcacgcattcactcagcttggcgaaaac

SEQ ID NO: 721710 - DNA, 122 bp, Homo sapiens
ataatataatattagtaataatatgatctcacaatataaataagtataagatactttgagactgtcatttcatttattcaaatgtgcatatcattgtcctttttttttggagaccgagtttg

SEQ ID NO: 721711 - DNA, 104 bp, Homo sapiens
actacagttatccaaaatgtcaataaagcgcaaggtgaagattcgagcgaagaaagataatgtagcaggtgttactttgccagtatttgaacattaccatgaag

SEQ ID NO: 721712 - DNA, 82 bp, Homo sapiens
aattcaagcttctaacgatgtacggggacatgaaagcagcatataaaatttgcaagcatttctttatgagaagatagaaaaa

SEQ ID NO: 721713 - DNA, 246 bp, Homo sapiens
ctcaggattatccccgtacgcccaacaaccaaaaagtatcaattctgcagtggacactagctgggtgttctgtaattcaattccaatactatctacctggagataacatcagaatccacaggttgaaggctcagtccccaagactgccccccttcttcagacaccagtcacaagccccagactctggaacttctgactcacctgcttgaagatgagtttcccatactccctccttgggcgtacggg

SEQ ID NO: 721714 - DNA, 709 bp, Homo sapiens
gctgggatggtgccgcggcatgttcctcctcagatgctcaacattccgcagacctctctgcaagcaaagccctgtggcctccacaggatgcccagcgccagagtggcagcccgcgggtccatgggtccatacccgtgacagcctctctgagccagcacctctcactttggacacgagcgggaagaatctgacggagcagtaacagctacagcatactagttctctcagcgatggggaagtcacacagccgtctgtatgagcggtcctcgcccatcaacccggcccagagcggcagccccaaccacgtggattccgcctacttccctggctcttctacatcgtcatcttccgacgacgacggagggcagcggagggtgcgacaaagcatatcaggcgggaacaagattggctggggatgatagactggtgaatgccactcagagacctcaggcacgaggagacccaggagaccaatgcaaaggcagaaggctctgtccactgcctcttcagagaacgccaactagccgagggctatgggaagccagatgggcactgtccagccaatcccgtgcctcctgtcgatgcccaccatggaaccacatggacatcagcatgagctccccgtgtccccccgatcgcacctgaggtgctgagaggtggtccgagcacaggcacaagaaggggctgatgtacccctacatcttccatg

SEQ ID NO: 721715 - DNA, 128 bp, Homo sapiens
gcatcatcatccgaaaatgctggtgattacaggcatgagcaatatacccggcctattttttgcaaagattgggtttcaccatgttgcccaggctggtctcgaactcctgagctcaagcgatccaccca

SEQ ID NO: 721716 - DNA, 209 bp, Homo sapiens
caagacatatctctaagtgtctaaaccatgtcacttcttatcttagacaccccagaatagcccctgttgtatgtagtaactattttagtaaaaaaaaaaaaaaaaaaaatcaggtaacataatacaaaagcaagcagcttagggcctgaaaggaacttgacggttggtagtctgggaatcccataatgaaaaacagagattactggcaa

SEQ ID NO: 721717 - DNA, 275 bp, Homo sapiens
gagagattgttccagattggagtggcagagatgtgctttggtttgggtggcaaggatcacaaagaagaggatgcccagcccttatttattcattttattttatttaaataaaataatgtggagaatttgattgaattttttaacaactgttcacttggagatgattggatttgtagagcaggaggatcactcgaacctagattcgagctcagcctggcaacatagcagacccatctctacaaaaattttaaaaattagccagcatggtgctgtgt

SEQ ID NO: 721718 - DNA, 1656 bp, Homo sapiens
cggggagcgtcataataatgagctttctgtctcacgttgactgtgccctgatatatgctgatcgatgcgtatgtgctcctaagcgctagacgcgtcttacatgttgtaaagcgctccgtgaggcgatatgtgcgctggcatcagtcatatataaacccgctctttcgtgatgttatgctacatgatactcactgtatatcgtagtccggatacgcgctttaatattcgaaggtttccgactcccgggtgttattccccctgcgattccatgctatattggtgccccgcgggggaaaattcttcctggtcatcaaaattttaatctcgatgcccctccggtgcgaaatctttggaatcctgctgagtcctctgaggattcgcacacgaattggcccccgttgagtcgaagttgacttgaaggttgtttacatatccctcctcgagagtcctcctcttattggtaaacctcccgtgtttatcatcattaggggcgggcctccctccttcgcttctgtaagctcccgtctgttccgtcgtgtgagaacgtatgaaccgctttcctcttggggccggcttgtaagatcactaaatccggtcggtgcagttcttttccaaactgtcttctccaagccttcctccaactttatatctgtcgttcgctcctgcaagatgagtcattagggggccactttacctttatgtaggtctcctatatgccagcatatgcgtaaagccctctaagtgtaattttagccctcattgaattttggaatcttggggctctctgctctggaactttggtttaaaatcatctctgtaacggatcagtattgtctaagcaagctaacgctccacatggggtcgcattctcatcaatcatcctcaatccgcttggttgctccatatagtataggtgtcctcttttcggtattagccggtgcgaattaaagtgcgcttagtgttttacgtgtagcctcctgcaaggagtaggttgtgtatctgtgtgtcttttgtcgtcagggggagtgtgtgtttgcttgaggcccgtgtgtgtaacgcaagctttcgcaggtcctagggcgccctcgtaagccgctcgcgccaagtgtatgggtaccggtggcatctgggcctcctcgcatatcatgggtcagtgcagctcgctcggtcgtataatttgcgccgcttaggagagtccgccagctgcgcgtataagcacagtgctcgtagttagtcttcgcagtgcatgcgatgtagtcagattgcagctctgaggcgtcagcgcagtatgttgctagagtatgaataagtcaagcgcggaagagccaaagagtaagtgtcaaggcatctgcgttagttagcaagttgttagctgggtctgcgtattgttagcccgtcgcgtagcaaggcgctgcagaggtagcgtgtgcgaggtctcgcgcgtgtgcacgcagtgttcgcgagcgggagtgctacggcgtcaagcagtgtgttttgtagccacaggcttccacggacttgcagcgtcagttattggctcaactttccgtcactatctgcttcagtccgcgcaagcgtaatatgtgtcagcgtttagcagtccaaagcatcactttggctgtcggaagccgccgaactgactagcgggcattttgg

SEQ ID NO: 721719 - DNA, 186 bp, Homo sapiens
gtagagaccaggtgaggtaatgatgttaatcaagatgctactgtatcatttgccataaatggataataattttatgcatatcatacccaaatgttcctaaaaagtaatctttcaaaaaagttattaaagaagaaactggaaagtatctgtgatgaagcttctttctttaaaaaagaaaacaccaag

SEQ ID NO: 721720 - DNA, 265 bp, Homo sapiens
tataggcgctaggtgacaggcagacttcatcttaaaaaactaagccctatattagggtcccccttctcttccttctttctatgaatgatctgtattcctggcattcctggctttctaagtttccatgtatggttctgggggcgtgagaataatccaacatcatgctcctgagccatatatatttttaatggctggctttaaaactaagttctctgcactttacaggtggacgaatattggaaccttatatacaaattcttcacac

SEQ ID NO: 721721 - DNA, 283 bp, Homo sapiens
caggaaaaacttgcggggtcaacacccagcaccatcacttactagctatgtgaccttgcgcaaggtaacttaatatctctatacccatttcctcacttgtcaaaatggggatcaataatagaacctaactcaacagagttgatgtgcagtttaaataagttaatcatgtaaaaaaatatttcaaaacaatgtcttgttaccttggtaaatactattataaatgttaaactggctaattcaacatgttcaaagcttggccctttcctattctgggggagtcatg

SEQ ID NO: 721722 - DNA, 86 bp, Homo sapiens
  misc_feature (15)..(15): n is a, c, g, or t
ggagcgcggcgagcnagaggatcccggcaccatgtgcggcgggacacttgggtcactttggaagcatgttaataaatgtcacgatt

SEQ ID NO: 721723 - DNA, 1610 bp, Homo sapiens
  misc_feature (193)..(193): n is a, c, g, or t
tgcttggcgccacgtggtaacatgccttggtccaagggatggaagagtcaccctcgttaaggactggtcaatgccagtgggagaccatcggcatgactctgagaagcaatcgtggacgtgcattcactatgcaccagagattcgatcacaaaaatgaacgatgactcgcgtagcgtcacttgctctacatccnatgagtggtcgtactaagatttggtggattacttggtacatgttcctgctaggacacagaggtgggggatctgtgctagtgtacttcagaacctcggtaagtggatggttgcacgcatgtatggcttcgcacgcttcacatcggtttaagctaaacggggaaaagttatagatattcctgatcctgcaacaatttgagacacgaatggaagagccttgtagcaggtgggaaatggctacctttccgtgggtggggtaccaacattaggtagggcggagtgttacacatggctatcaaaagcgaaactaggttggggcactaggtacgaaatgggagaattggataaaatcggtacacggatggggactcggacactggtatggaccttgaggaggtagagatcgctagattatcacaaacattggaagcttccaacgctatacatgggcgcaataaagacgccaggacagttggcggacatgttactaacgatgggggttgccacaagaggtgacagttataagtgcgcaatggcaataaacactaaatttcgcccaatgtgggcagcacaaacacagtttcaaaatggacctggccccgggggcgactaaatgtggccaccccctatgggattaaatttgggggaacaattgggacagcctagggacaatcggtggtgtttacacaacgcagattgtgccacaggttgtggaccacaacggtactcatcacggtgccgtatggaaacagaccagtcgggcgacaacgtgggcacatacaccaggcacacttggggacagtgtccgggcccgagggagtggtaagccatcggcgtctgcacaccaacatacacgggtccaggggaggaacaaggacaaatggagggtaccacgccgttatgacagagtatcatctcatactgcgaaaccaggatgccgctggcgcactgcaacgtaggaccatggcgcacacgatctgtgagagtggcaggacacacacgcggcgggcaacaaacgccctggggggacaccactgtcgacacccacagtgggcggtggagctggcgctacgacgacaggaacacagggaccttgcgaatcccgaccagaacagatgaacattgccccaccgacacactgatagcggggaggttaccgccacagccaacctggccgcataggagaagcacacagagacgcgacatacaagctgtcgacgggcacacccacagttaacacacacgaggcatttgtacgcgataggcaagaggcgcgaatggatactcaacgaggcagagatgcgcagtgcacaacgatacaagcggacaggacacacagaacaccaacagggggcttggtgaccatctgtggtaacaagcaccatatggcagcaccacagaggcgatcgccaacacaaa

SEQ ID NO: 721724 - DNA, 1178 bp, Homo sapiens
ggaacaggaagccctgaagggtcaaagaaatacaaaagcataggctattttctttttttttatcctttctatcacttccttccttcctctgttctttctttcttcctttcatttgtttttcctttttgaatagcgagcggctctgctgttggcggtttggggtgggcgccgcctaggtgaggtcgctctcgcctccctgcgcgccggtatattggtctgctttcattcaatggatggaggggatgatggtaaccttattatcgaaaaatgaggtttgtgctcctgaggctagaactatgatgacacggtgcaaaaggaggcaagaagaatgggagaaagtccgaaaacctgaagatccaaagaaatgtccagaggaggtaatagaccctcgatctctatatgaaaggcttacaggaacacgacggccaggaagcgagcaggagctacagaggaacacgtccaaagtccaaaaacatggtcagaggcttacatgaagatgagaccaacttccttgatgaggttctctcgacagctcggaactacttagcacactgcagcgacgagaagacgacctgaaagaactgagggacatccagaaataacctctagaaaggttggacttcctcaggagaacacgacggattctggcctgtgacacactgatctgtgaagcctatgtgagaacctaggaacgagttctcccaggcgaagctgttggccaggacgctgtgaaggctatacgacctcgagacattggcaacagtgttcacccagcactgagctctgtgtccttaagccaaattgaccaagacatacagaaagccccttcagtcctggaaaagtcttctcggaaaacaacctcacctagaagttgggccccttcaaaatcacaaatggcccctatcttgctcgaagtaatgttattcagacaattcttgccccccagggcatagtgagttggcactaacatgatggaggaacaatagtgcagacttcggaagtctcggattttctataaaaggacaaagtgaacactagtaataatgtgcaacccgggtcgatggaaattgttcacaccaatcacaaattatctcgagaacacaacataccgttatacacacgaaagagacccatcgttgtattgtttccgatcacattacgatggcgattactgtgat

SEQ ID NO: 721725 - DNA, 442 bp, Homo sapiens
ggcgcgcgtttctaccacggactctcgggagcctatggacgcagataacatctggcagtcttggatatctaattgtatatctcttaatctcaacatagaggccagttcatctattttatcagcttttcattcttgcaagattctcagcattatgttttcagtcccattttagctttacatagtccttgcaaaaatacattcactgtataatgtggacaattctgtaacagagcacttattcacttgaatgaataatcctcaaaattttcaatattttagctgcacagtttgcagatttgtggaatgaacaaacagcaattcagaaactttcatctgttcactttgtttcagtcatctgcaaagtctgcaagctgtcattctgaaatacacatccaagtgaatgagaattcaaattttctaaatattaatactaactgggaaa

SEQ ID NO: 721726 - DNA, 466 bp, Homo sapiens
ttaaaggcgagccgggtatacacgtacgtaacttcttgaagattgaagtcagcagtcgcatacagccatgacagcttctgctccctgctcctgaggcgcaaagctctaccaggaccatggcagcccccaggacagctcagaccaggggaggaagacgaagggatgcagctgctacagaccaaaaggactccatgggcaagggagctaggccggggcaagcgcggaaggctcgccggggtctggcctacacgctgctgaacaacccaaccctgcagggtcttcccgcaaggacgggccctgttgggtgccaatggtgcccaagccctgagggcagggaaaggtcaaaccacctgcccatctgtgctgaggcatgttcctgcctaccatcctcctccctcccggctctcctcccagcatcacaccagccatgcagccagcaggtcctccggatcactgtggttgggtg

SEQ ID NO: 721727 - DNA, 494 bp, Homo sapiens
  misc_feature (138)..(138): n is a, c, g, or t
gaaccccacatccccattaggtcctgtgtggcaatttaccactttgaagggtcaagcgagggccctatctctatggccgagggtgaagacctcagttttatggaaaaacacaaaggggccggctggacccgggtcagncgaaaaaagggaggcgagggttacgtgcccacctcctacctccgagtcacgctcaattgaaccctgccaaagacgggaaaaggggggctgtcggtttttgtttttgggccacggggagccccaggacctatgcactttatttttgaccccgtggcttgggttgagacctgtgtaacctgttgccccctccccccccaacccagtcttacctgtcacaccggagggacccgttgtgccttttaccatcgttcccccattgatggacaaactcatgttttacattttttttttttgccgctcggctccggccattttgttttatccaaaaatgggaaaaaaaaaaaagaatttatata

SEQ ID NO: 721728 - DNA, 201 bp, Homo sapiens
gggaagcgtctccgttggggccggccgctctgcggacctctgaggagaagctcgcaccaagtggacgcggatctgtcacatgggtaaaggagacccaacagccgcgggcaaaatgtcctcgtacgcttcttcgtcagacctccgggagagcacacgaagagacaccagactcttccgtcaatttcgcggattctcagagtg

SEQ ID NO: 721729 - DNA, 169 bp, Homo sapiens
  misc_feature (27)..(27): n is a, c, g, or t
ttttttggggccccccccgggaaaaantggggggtcctgttcctttgttcaaaaaaaaaccccccgccctgtttttgttccccaagaattttaaaaaaaaaaagctttccccgggggggggaatttgggttttttttcccctttttaaaaacccaagggccagggttta

SEQ ID NO: 721730 - DNA, 889 bp, Homo sapiens
gggtgggacccggtgaattggggcattatgggccggggcgggtaaggagagtaagagtgagaaaaccagggtagcgagcgcacttgtgagagggggccgcgtcgtcgggcgtggcccttgccgcttgttacacatcgcttctcacgtttataatcaagagaaccagttcaaacaaccctcctcccccgacacattccgtactaccggcgacatatcggcgtccccagcgccgcagtgggagagagttggcgtgggagcgataggtagtagagtagtgaatgaggcagctgagcccctcaacgggcatatctcaattatccagctctcaagacgggacatgacacccgacaccacaaaccacaggatagtgggaaatgagggttaatgggtgacgtttgattttggtggtgtattcggcttattagtttcttcactaactaacaacaccacattccacacccacaaccccgcactccatcagtatgaccacgtcatacatcagattactgtctgttccgtcagttccacctatttttacacacggagcaacgcatcgcggcgttcgtatgtaggcgcaattcataacattgtatagtagagttctaatactctcgaatgagcgtagaaatcgatagggactggtggcacgcgatccgcacgtgcagtacaccccgtctctcgccgatgcgcaacgtcttgatcgttccacggcgttgtcggcgggctactaatgaacgaactgtaacgtagtgagatcgtctttacctgtgtcgctctttgaatatgcgtgtttgtgtaagcgggtggtattccgtcacggcgatattcttacttaggagttctagtttattttctacaatcactcaacgcctgtctgtcccccatttcc

SEQ ID NO: 721731 - DNA, 127 bp, Homo sapiens
aaaaaaaaggacaagaataaaagaaaaatttctggagctggatgcgagtcacgggactttaaatcctagcagattaatttcattcactcaagcaaatggatatggagaacttcttgggtgccttggg

SEQ ID NO: 721732 - DNA, 156 bp, Homo sapiens
ttggcaggacatgctttcatggatactgcctgggtgggggttcacaacacttataagttagaagagtttcgagagccacgtggacaagtacagtggacagttgttactgacaataacgcccctggcaacttttctcgcatatgaacaaggagcaga

SEQ ID NO: 721733 - DNA, 99 bp, Homo sapiens
ccattcgggttttttcccccccccttttttggggggggaccttggtttcccccattttggaggggggggttttcccctttaaaaaatggatttcgggga

SEQ ID NO: 721734 - DNA, 943 bp, Homo sapiens
cagttaaagtcatgtcacccatgtaggtcgcggtggtagatcttgatacggtcgatgttccacagatttgggaatgcgttgggtcattgaccctcgcgcattgagaacggggtgtctcctgttgacctttcaatacataggaagcacaatgtccaggctcggtgttactgcgctatgtgcactcctgtccattcctcctcctccccgtcatatgaccctcagagtaggtggcattaaaatgagacctaagtgggatttgttgatacttgcgaatcgatctttgctctacagggcattgctactcaatgtcactttatcagtccctgcgatgtaatccgttgtcgtggcgcaccgtggaaagttcctataggacaccaaggcagtagtaaacctaaagactgatccttcttggggactcaaacaatccttcgtagtttattgcgcttgaacaagggtctacccacagtttgcttcgcgttactaggctgtggacacttgcctagtggggaggtccactcgcatgtagactagtagataatgttcaactgtacatctcatatactaaaatctatcatgggaccgtataaagcaggatgaaccgctcgtcgtatttgctcatgggacacagggttgccgataacgcacataccgtcttgtcctaactcggcctggaagggacatctatctatggacaaaagtatgaaccccatgctcttagcttattttgaggaattactacacgtggcagggaatcgcgattctttgctccgtaccagaacaaggccatcacagtagcgagcactcacattgagttggagaaatccataggtatcagcttggaatcggcggctccgggtggcaggggtggtaccagagtctgcttcccgtgagcccagatgcgggtcaaccccgtcgacaagtggggggccatccccgttccact

SEQ ID NO: 721735 - DNA, 530 bp, Homo sapiens
cccctcctatcatgcaccagaatttcatcacttccagaagcaaatgcagatgttcagcataaaccagacttgtttgtcgcaaacagtccaggcatagcgagcctactcttatcagttagggaaagatatataacagtgcaggaaactgtttcccagctaagttcccagacaccagccacaggctgaccttacaagcaggccttttctaaggataacaattccaggcctgctatgttaagtcttctttgaacagctctgtgtctctcccattcctgtctttacctttctcttcaaatatcttccaggatttctttccctatatctcagacctgactcagtcatgcctctgctcagagaccatcgatggctctcagcctgggctgagcattgacctgggaacccaaaaagtggatttgtggcccagccctatcactaactcactatatgacctcaggctaatgacattccttgcttaaccctcagtgtccccatctctgaaatggacaaggatagtggtatcagcgaagggc

SEQ ID NO: 721736 - DNA, 157 bp, Homo sapiens
accgattgcccaaatgatacgccccgcgcatcagttcaaaggcattgtcggcggtgactttggtgagggtttgcggtttggcaaaaatttgcactaggtgcgcctgacgcattttgtaccacgtcaccgtctttgagcgtacctgtgcgtggtaggt

SEQ ID NO: 721737 - DNA, 822 bp, Homo sapiens
cgaggctaggcttaaccccagcacagaggtcaagggcttccggaaaatttgttgtgtgtcctttggagtcgtttcgcggggaagacaaacgtcggttctgggagggaaacttcagtgggtcctggtggctttggtggccaccctggtggtgagtggaaataggtggccactggggatggctaaaactggaattggtaatagatggtggttatggagagaagcgcgccggttacttctggaggaacccgaggctatggaaatggtgtgaccgggttatggaaacccgggcaagtggcttatggcgggagtggccagctatgaaccagcgtataacgaacggaggcggagccggcctttggccggtggtagtggaagccaattttggaggtggtgtgaagctcaccaatgattttgggggattcccgaagcaattccagtctttccaaatttttggaccccatgaagggcaggaaattttggaggcagaagctgtggcgccctatggcggtggaggcccataactttgccgaagaccccgagacccaggtggctatgcgggttcccaccagcagccgtagctatggccagtggccagaagattttaattagggaggagtctgctactagtcgttatccagctctttgaaaaccagaaactcatctgtcgccagtttgtggccagaaagggaccgtccttgtgaagacccttatttgagcccctgtactttgttatcactgccaagccgtttacatgagctgttttgcaggtccaattcccttttgtgaatgggtttttttttttaataaactgtatttaactta

SEQ ID NO: 721738 - DNA, 546 bp, Homo sapiens
gccggccgcctgttttttttatacgggggccaccggggtgggattgtgggttttgccccaccaaaagagccctcccgggtggtgtccccgtcgggggcccccaaagggaaagtattttgtgtccaaaggcctccccgttaatgggtgcggcccccgcctgggtgtttggtgttgaggggaagaagggacccctgcccctgttttccaacaaaggcagttgggcccaaagggaaaagggggggggggccctggatgtctttccagcctttttaaaggaattggtcccctttcctttttttttttttagagacccaggccgggggccttccccccttgcccaaacttggggggccctttaaagggggggggggccctgttttttttttccttttatttgggggggggacccaaggggggggttttttttatggggggggggggggtttgggggtcccgttttttccctttccaagtttttgggggggggaaggggggagggattttggtttaagttttttaaaatggtaataaaatattttttcccga

SEQ ID NO: 721739 - DNA, 658 bp, Homo sapiens
  misc_feature (18)..(18): n is a, c, g, or t
  misc_feature (108)..(108): n is a, c, g, or t
  misc_feature (120)..(120): n is a, c, g, or t
  misc_feature (132)..(132): n is a, c, g, or t
  misc_feature (141)..(142): n is a, c, g, or t
  misc_feature (146)..(146): n is a, c, g, or t
  misc_feature (159)..(159): n is a, c, g, or t
  misc_feature (162)..(162): n is a, c, g, or t
  misc_feature (174)..(174): n is a, c, g, or t
  misc_feature (188)..(188): n is a, c, g, or t
  misc_feature (204)..(204): n is a, c, g, or t
  misc_feature (343)..(343): n is a, c, g, or t
  misc_feature (592)..(592): n is a, c, g, or t
  misc_feature (636)..(636): n is a, c, g, or t
ttttggaaaatggccgtnaaatgctcggagatgcgcttgaaaagatcctggatggccgtgctgttgaaaatgaaggtgggggagatttttagttcccgaggtgggatnttacagaaagcngttttaaaattnttggggatnnactnaaaaaaatatttnttntttttttttttnatattaagtatttntttatttatttttttnatggaaatgcggcccctgaaaaagggggaaaacgttaggtagcggccatggcgggggttgcaggaagcaatcatgtttttggcatcaaaaatttgctgggtgagctcgggcacggtaagagcccggtaatgttggatgntcaggttggttagttgggtaaagctgggcattaagaactgcagccggggaaacgggaccatgttcacagccagcttccgcagtccagcattgagctggcctgggaagcgcaggcaggtggtgacccactcatggtagcagacaccaggtggttcaggtcaccataggtgggcgtggtcagctttagggttctgaagcaaatgtcgtagagagcttcgttatcaatgcagtaggtctcgtctgtgttttntacgagctggtggactgagagggtggcgttgtaggggtgcacantgtgtctgaaatttgggggagg

SEQ ID NO: 721740 - DNA, 135 bp, Homo sapiens
ataccccgggtccgacacagtccaagcgcgagcccggagacacttcaagcaatccttcctaacttttattctcagttcgcatgcctcaacaggtaaacaaagcaaaaagcctacgctggacgggggccgcgcgga

SEQ ID NO: 721741 - DNA, 250 bp, Homo sapiens
gtcggcttcttatagaagacaacatgaagaggggaagacaacgaaaatcgaagtaaaactagatcaagaacaaacaaaatcccatagcccatattgcaaacatcagcagtgtaaaacttaggaacctaatatctatgacggtgagcgtcaatcccatacagcactggtaaaccattggtcttgtccatcagatcaccctcctccttcaaatctcctagcttatctccatcaaacgtacccttgttcttct

SEQ ID NO: 721742 - DNA, 152 bp, Homo sapiens
gtacggaagatggcgttgttgcaaggggatgatgtctggagctcccagaagatgctgcgcgtgtggcggtggtagtagtgtctcaagggaatgtactccaggccctctctgtgctgtccagccctctgtgctgtccacctcctctgtgctgt

SEQ ID NO: 721743 - DNA, 503 bp, Homo sapiens
  misc_feature (221)..(221): n is a, c, g, or t
  misc_feature (253)..(253): n is a, c, g, or t
  misc_feature (271)..(271): n is a, c, g, or t
atgcagcgaatggcaccaaccgcagtgagggtctgtggctggtaaacactccgaacaggacgtatgtttattgcagtgtgcaacacgaattaacaacacctatttcccagatgttagataaatgtagatatttgtcacaggatcaggcacgaggatgtagaaaacaggtgtctcatccataatcacatcgataacctctggacaaaatgaagtcaaattcncaccaagaataacgttaagtaactggccatcnccagtccccaagaataanacagtcctgttcattaccacggtgccataaacggatgtcaggtcggaatggatcaaggtagatgatgcgattggttggactctttcaggatgatccccttcactgcagtggctatcggccgtcatgaagtcccagctgaccctcgtggcgcgcacctgtatctcactcattatgaagaggcagagcgccgtggtggtgggggagcaccgctcatggccctcgccagcggccg

SEQ ID NO: 721744 - DNA, 144 bp, Homo sapiens
ttatcttccaagtttgagtgcaccagcttcaggttgttttagggtggcgacaaaaaccggcttcctttatcattttcagaacctggtttggggtgtgcaattagcatacactgggtgtcctgtaagaacggctggtggacaaaa

SEQ ID NO: 721745 - DNA, 343 bp, Homo sapiens
tttttttttttagaaatcgctaattaattttattcctttacagaatgtgctctggagatttaaattttcccagcttaagggatcttcagatgatgggaaaactcgagtaaagctgctgtttcagaatctggacaccaaacagattgagatgaaggtatgcggcatggggcatgggttattctgccaccacccacacataaagtacagctcagagggtccgctggtaaaaatctccacccctcccatgcacacaaaaataaaccaataggtcctgaagcacgagtccttcctgaaaattaggcaatagataacccgaaagagcctgtcgagcccacgcgtccgc

SEQ ID NO: 721746 - DNA, 111 bp, Homo sapiens
gctgccggctgactcttgagtatccccggtcatttgtctacacttatcaagtcaatggatacaatacagacttcatgctggttttctctttgaaagtttattgttttcttt

SEQ ID NO: 721747 - DNA, 1914 bp, Homo sapiens
  misc_feature (1909)..(1909): n is a, c, g, or t
  misc_feature (1911)..(1911): n is a, c, g, or t
  misc_feature (1914)..(1914): n is a, c, g, or t
cacgagccgagccggagccggcagaggggcgcgggcgggacgggcgcctggcggggccctgggaggctcggacggggtcctggcgttgagctcggccggcccggagcgcggacccagccgcagggcggcgaatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgacctaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagatgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacaatggcctcgttggcctcagcggtggagctctgcgncnagn

SEQ ID NO: 721748 - DNA, 105 bp, Homo sapiens
aactcggccccgtttacggaacaggcggatgtcagaggggtgctagggtacctctgggactcagaagtgaacagggggcatattcctagattttattgctcatag

SEQ ID NO: 721749 - DNA, 811 bp, Homo sapiens
  misc_feature (72)..(72): n is a, c, g, or t
  misc_feature (806)..(806): n is a, c, g, or t
  misc_feature (808)..(808): n is a, c, g, or t
  misc_feature (811)..(811): n is a, c, g, or t
acccgatggcctagccagccgctgactgactgttgacggcaagccgctgaccttgaacttcagtgctcaggntttccagtcgtatcaacacactgcgatccacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagatgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacaatggcctcgttggcctcagcggtggagctctgcgncnagn

SEQ ID NO: 721750 - DNA, 433 bp, Homo sapiens
  misc_feature (12)..(12): n is a, c, g, or t
  misc_feature (83)..(83): n is a, c, g, or t
tctggagctganaagccattatccctaactgaacttaaccacaggaactgaaaacggaaatactgcatctttgtcactttacnaagtgggagcttaaaccactgagtacacatggatgcaaagaaaggaacaacagaccttggggcctacttgacgatggatggtgggaggagggtgagaatcaaaaaattgcctaccagatactgtgcttattacccaagtgacaaaatatctgtacacacgcaacccctgtgacacacaatttacctgtttaacaaagctgcacatgcactcctgaacctaaaataagagttaaaaagaaataaaaaccaaataccccaggagaattgcttgaacccaggggacagaggttgcagtgagccaagatttgccactgcactccagccagggtgacagcataggactccatacc

SEQ ID NO: 721751 - DNA, 471 bp, Homo sapiens
  misc_feature (466)..(466): n is a, c, g, or t
  misc_feature (468)..(468): n is a, c, g, or t
  misc_feature (471)..(471): n is a, c, g, or t
gccattaggtaatgattgggaaaactaagaacccaggatggctgctcatcggaggggccagtcatctcacagacactttgtgacaaatgtccagcagtttgtgcactgagacggaaaaatggaccgtgccgtaaggaggtgtgatttccactggaggagattgattgaggacatttggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacaatggcctcgttggcctcagcggtggagctctgcgncnagn

SEQ ID NO: 721752 - DNA, 134 bp, Homo sapiens
tgatagaggatctcggtgatgatgtgatggggactgtgtgcagtatgtacaaagggagaggtcactgtcacagaggctgggtgaggtggggtgctggaggcgaggctgctgggagatagtcaaaagtagatctc

SEQ ID NO: 721753 - DNA, 411 bp, Homo sapiens
gccatgtgaagcctcccaacaggaagtaggcacgtgaagcctcccaacaggaggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagcactcaccttatttcagaagaagaaggcagatgggctctatagtagtcataatggaaacagacctactacagataagcagattttgaaaagtgatactgcaagtcagaattatactgctaaatactctaatttgttttgcaaaggagagtatcatgtttaaatagtcataccaaaaa

SEQ ID NO: 721754 - DNA, 772 bp, Homo sapiens
  misc_feature (1)..(1): n is a, c, g, or t
  misc_feature (77)..(77): n is a, c, g, or t
  misc_feature (99)..(99): n is a, c, g, or t
  misc_feature (104)..(104): n is a, c, g, or t
  misc_feature (111)..(111): n is a, c, g, or t
  misc_feature (136)..(137): n is a, c, g, or t
  misc_feature (139)..(139): n is a, c, g, or t
  misc_feature (141)..(141): n is a, c, g, or t
  misc_feature (144)..(144): n is a, c, g, or t
  misc_feature (149)..(149): n is a, c, g, or t
  misc_feature (151)..(151): n is a, c, g, or t
  misc_feature (156)..(156): n is a, c, g, or t
  misc_feature (170)..(170): n is a, c, g, or t
  misc_feature (210)..(210): n is a, c, g, or t
  misc_feature (312)..(312): n is a, c, g, or t
  misc_feature (346)..(347): n is a, c, g, or t
  misc_feature (357)..(358): n is a, c, g, or t
  misc_feature (420)..(420): n is a, c, g, or t
  misc_feature (422)..(424): n is a, c, g, or t
  misc_feature (426)..(426): n is a, c, g, or t
  misc_feature (446)..(446): n is a, c, g, or t
  misc_feature (456)..(456): n is a, c, g, or t
  misc_feature (471)..(472): n is a, c, g, or t
  misc_feature (476)..(476): n is a, c, g, or t
  misc_feature (489)..(489): n is a, c, g, or t
  misc_feature (525)..(525): n is a, c, g, or t
  misc_feature (535)..(535): n is a, c, g, or t
  misc_feature (541)..(541): n is a, c, g, or t
  misc_feature (543)..(544): n is a, c, g, or t
  misc_feature (548)..(548): n is a, c, g, or t
  misc_feature (554)..(554): n is a, c, g, or t
  misc_feature (560)..(560): n is a, c, g, or t
  misc_feature (564)..(564): n is a, c, g, or t
  misc_feature (569)..(569): n is a, c, g, or t
  misc_feature (571)..(571): n is a, c, g, or t
  misc_feature (576)..(577): n is a, c, g, or t
  misc_feature (587)..(588): n is a, c, g, or t
  misc_feature (604)..(604): n is a, c, g, or t
  misc_feature (606)..(606): n is a, c, g, or t
  misc_feature (657)..(657): n is a, c, g, or t
  misc_feature (659)..(659): n is a, c, g, or t
  misc_feature (671)..(671): n is a, c, g, or t
  misc_feature (690)..(690): n is a, c, g, or t
  misc_feature (734)..(734): n is a, c, g, or t
naaagcaaggctcagtactggaggtaagcaactgaaatgtctgtctgacttcaagtgtacaaggttgtatgtagctnttttagcagaagtagaacaagnaagcnaaatttnttcacctggtttatcgagtgtttgnntngnctnaaaantnaacangtatataaattcanatgtcagttggtggctgtacttcctctagatctaagatangtaccctacctagttacatacattccattaatcatgggccaagataaaaaaagttagtggatcatttaacatagtttttgagtgccaaacagtaactacgtntttacagcagaaacatacatgctcataggattcnncagccaaaanncaagatgacagtatatttctgaatttgaatcttgaagcaggatgaattattgaaatcaactntnnngngaaatgtaataaatgaaaanagcattcgancagaaaacgcatagnncccncacaatccaaagngccataaatgtcccctccatgatcataatacctctnattcaactancgggantnngtcnaatggngttgcnatanccacncngcacnntcctgtccanncacgcccacagcagcntncttccagatccatatagacaaaaacattctctgtagcttaaatattaatcncngaggtatttgcnttaagtctcccttattaanaacagtagcttccaaaaggtctttaataccgatggtttattgtngactataagctcctgcagctagaaccaggtttcttcga

SEQ ID NO: 721755 - DNA, 405 bp, Homo sapiens
tccttgatgtatacttgtatacccggctatcccagttcatgagagttgaacagagatggtccccatccttctccactacaggtggcctgttcctggtcatgcatagcccagtgccccggtcccttcgccactccttcatctccagttcgaagcgctggcagttcagagagactgtggtgtggacgcttgtgtgtccagaacctgtgctggccgcctggaggtgcacccagtcctcaagcagccagtagacttgtacagatccccttctgtgtgcaagactcatgctagaagctgcaggggatctaaagaagcactgcctgccttgcatcgaacccgagacaccagaccgactgcgtgggggaccattgctttctttcctgtcaaggaaagaagtgccctgacagt

SEQ ID NO: 721756 - DNA, 1796 bp, Homo sapiens
  misc_feature (1791)..(1791): n is a, c, g, or t
  misc_feature (1793)..(1793): n is a, c, g, or t
  misc_feature (1796)..(1796): n is a, c, g, or t
cacgagccgagccggagccggcagaggggcgcgggcgggacgggcgcctggcggggccctgggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgacctaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagatgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacaatggcctcgttggcctcagcggtggagctctgcgncnagn

SEQ ID NO: 721757 - DNA, 160 bp, Homo sapiens
  misc_feature (156)..(156): n is a, c, g, or t
cttcgttacccttcctctggcttcgaagcgacgctgcgtgcgctgctcgtccaattgcagcatggataaggagcgagccgtggctgcagggactgcgaggcggaatgccatcctcgtcatcgaggatgagccggtcatgcgcctcatggctgtcgncctc

SEQ ID NO: 721758 - DNA, 153 bp, Homo sapiens
tcatagattcaaggtttatgctttgctgttcattgggtttgaaggccaggctttcacaggaaggcacacgatttatatgtaacttcggttataagcttctatgaggtttgtggagaatcctcgttcaaatggacagacacctatcagcaactg

SEQ ID NO: 721759 - DNA, 322 bp, Homo sapiens
cggaccggtcatactggatgaggatgtcattatgatctccttcttggaagcctcataccatgatatattctaggtaataggccaccagggctttggcagcatggactgaccgatagcataaatctgggccacgtgacctgacacccttatacacggacacggctgtctacaccagcgaatcgccccttgcccgagaagcagaactaggctccagcagcttgtactgtagcgtgcgcggtcaatcatctccaggggccgcccgttcaccttgatgagaccattgccgcgtatgcagtgcgccacagctgtcgctgtcttcttg

SEQ ID NO: 721760 - DNA, 1218 bp, Homo sapiens
cacgagccgagccggagccggcagaggggcgcgggcgggacgggcgcctggcggggccctgggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgacctaggttgtgcatatggggtgggtaaatgagaaactccaaggagctgactcctctcaaaccttcagacccaagttcctagcactgaagggcccgtccttctacgttttcagcactcctccgcaacctacctcctatctgaactacaagctacgcagaacctaaccaacacacgagatgctcttcttggataccttggacatggttttatcttaaataacccccttctgttacatggtcatgttcggccttgaattgttgtagcctagatattttctagagctataactcgtgaaataaaaagtgagaagagccctaatgg

SEQ ID NO: 721761 - DNA, 90 bp, Homo sapiens
acatctgtgtacttctgtgccagcagtccgggactagcgggagggcctaacgagcagtacttcgggccgggcaccaggctcacagttgta

SEQ ID NO: 721762 - DNA, 760 bp, Homo sapiens
gccatgtgaagcctcccaacaggaagtaggcacgtgaagcctcccaacaggaggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaagattgtaaaggagctgaaaatccctactgcctggtgacatcaaccatcgtaacctcacagtgaaagatatgactcacgtgtttgtggtgatgctgacgtagacaaacctactgcactgccaatcatataaaaggaaacagtaatgtcctggaccttcacattcactcactcctcactcatggcttcacccagaacaacttccagtcctgaaggctctattcatgactcaccttatttcagaagaagaaggcagatgggctctatagtagtcataatggaaacagacctactacagataagcagattttgaaaagtgatactgcaagtcagaattatactgctaaatactctaatttgttttgcaaaggagagtatcatgtttaaatagtcataccaaaaa

SEQ ID NO: 721763 - DNA, 991 bp, Homo sapiens
gggttcctgggctccgggctctgggtagcggctggtgtgagcggcggactgcgtgtgcagcgggggaggccatgcggtgcgccgtcgtgtgtgctggccctgtcggccgcgggatgaggaagcggaccgagcccgtcgccttggagcatgagcgctgcgccgccgcgggtcgtcctcctccggctcggcctgccgggcgctggacgccgactgcacgcctgaagcagaacctacgcctgacggggccctagagtgacggctgacgccgccgctgcgcagaccgactgcgggaatgaagcgggcgctgggcaggcgcaaagggcgtgtggttgcgcctgaggaagatacttttctgtgtaagaggtagaacattgccatttccatttcctcatcacactatgtcctgtaataccagtgccaaacttgacttttacttgaaacttacgtaaagcagtttccccctaatatccatctgcatttcagacaaaacacccagcaaggaatcgaagggttttgacatcaccaacagtgtaactaacttaccctgcacgccaagagagaaaggacgcttggaaccatttgcgaggtcttggcaaacaccgtaccctgaaaatcgtagagtgcaacagcaccccgccgaaagggcacaatgaccacatgctggaatggaggattgccttggctttccaggcaaaccatatccattctgtaccctggcattgggaaagcacgcatacccgaggagggaaaccaacctagttgaagctacacaaaggtgcaacagatccatggtaaccatgtgtcactatagactacagaagtatgaggtactcaaagacacggcaaatcaaacgagattacttaaaaggatccagataatgatagataaacagacgtgtagccaccgcggttaacactggacaatacaagacaagacgagaaaaaacaataaggcctataacaaacccaaaccttttggactctcaaaaag

SEQ ID NO: 721764 - DNA, 1009 bp, Homo sapiens
gccatgtgaagcctcccaacaggaagtaggcacgtgaagcctcccaacaggaggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaagattgtaaaggagctgaaaatccctactgcctggtgacatcaaccatcgtaacctcacagtgaaagatatgactcacgtgtttgtggtgatgctgacgtagacaaacctactgcactgccaatcatataaaaggaaacagtaatgtcctggaccttcacattcactcactcctcactcatggcttcacccagaacaacttccagtcctgaaggctctattcatgtcctcatgggtcaggagtccggcagctcccggctggtcctctgcttgggatctcaccaggctgaaaccaaggtgtcggctgggctgtgttcccatcttcaaggctcactcagggttgctggcagaattcagtcccttgactttataggactcagttccccacctttgtcagccaagggctgctctccaccaccagagaccaccatgttcattgacatggtcaccctctgccctcaagccagcagcaggcactcaccttatttcagaagaagaaggcagatgggctctatagtagtcataatggaaacagacctactacagataagcagattttgaaaagtgatactgcaagtcagaattatactgctaaatactctaatttgttttgcaaaggagagtatcatgtttaaatagtcataccaaaaa

SEQ ID NO: 721765 - DNA, 1590 bp, Homo sapiens
cacgagccgagccggagccggcagaggggcgcgggcgggacgggcgcctggcggggccctgggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgacctaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggcaaatacatcactcacaaatttgaatgtataccatgtgaagggatgaggaagaatgcattataatcctccttatcctaaatagcgggatgatccttcagggaggatgtgtgctgcaggaatgaagagtgacaggagataaatgaggcagcgcatcccagaggagctctgacttcacaccaaagtccagggctcccgcctggctgagcgcggagaatgctgagtgtgaacttagtaactaaagatggctacttcatttccatatccatatataccttgaatgtgaaaaaaaaa

SEQ ID NO: 721766 - DNA, 294 bp, Homo sapiens
acgcacgtctcggtgcgtgtttcagaggcgaggcggcttcccagaggcggtcatctcaaaggcggggttgggttgtgattcagaggcgaggcgcagtcccagagacgagagttgcctgaacttcggggcgtcacacttgctgcgggtagatcccgggcttcagccgacacatgcacatcagtcagaagacgcacacggtcatggacacccagatccagaagtcctcgtagggctcggcgtgcggcctacggcaggcacggccagggcgctcgtcttcctcccgccggaaaggct

SEQ ID NO: 721767 - DNA, 122 bp, Homo sapiens
gcggccgcctactactactactgctcgaattcaagcttctaacgatgtacggggacatgcagaccccacaaagagctctatcttgtcgtgtaccatcaataaagtcctctgtacccaaaaaa

SEQ ID NO: 721768 - DNA, 200 bp, Homo sapiens
tgtttgagtttccatctttcacattagccatgttcctcagctctcccatagtccctggtccaaaggaggggaataagaagcagagaggtcactctaggctcatgggggaggcttgttaactgaaagctttcctataggatgatacagctgaacttttaattagggaaatggaaaatccacattttagggtttttttcctc

SEQ ID NO: 721769 - DNA, 203 bp, Homo sapiens
ggggccggccccccccagggacgccctacaaaactgtggccaggaaatggccgggataaaggatgccccagggctggacgtgtgtaggagttagcgggtttgaaattggtaaaataataataattattaaaggaccgcttttggatggatgttgaacagggtcccgggttttaaagcttgatataaaaccgaattccaaagtg

SEQ ID NO: 721770 - DNA, 267 bp, Homo sapiens
ctattcctgttacagcaataacactggtctacgtgggatagcttttaggctgataagtcaaagaaaccaaatcccatatctcgtccgactcctccgacctcttccttggcttcaaccttagctggggctgcagcagcagcagaagcagctgtggtggcagcagccacaggggcagcagccacaaaggcagatggatcagcccaaaaaggccttgcaccttttccagcaagtgggcaaggtagtaatccagtctcccacagcacacag

SEQ ID NO: 721771 - DNA, 842 bp, Homo sapiens
gttaggtcggtatcgtggggcggtgctaggtatttcgctcgtcgactgcggctcttcctcgagtgcagtgggaagcggcgcggcggtcggagaagtggtctagaacttcggcgtcgggtgaaagaaaatggcccgaaccaagcagactgctcgtaagtccaccggtgggaaagcgcccccggaaatatcacgctggccagcgaatcgtcgcgctcacggaaaatgcgctccctctaccggcgggcgtgaagaaagcctcatcgctacaaggtccgggaccgatggcgcttcagagagattcgtcgttaatcagaagtcgatcgagctgctcatccggaagctggccttccagaggttgggtgagggagatcgcgcaggatttcaagcaccgaggcctgaggtttacagcagcgcgagctcatcggtgcgctgcaaggagggcatagcgaacgtggtagctgggtgggtcgtgtgcgaagatagccaacctgtgtgccatccacgctaagagagtccaccatcatgcccaaggacatccagttggctcgccggatacggggagagagagcttccctgaaggcagggataggatggcagtggggtagtagaattcgtgtcacatacttgggtaaacgttgtgcgaccttattggtaatgacaggtggtttaatacatatgtgagcattatgtacttaagtcggttccatctttcacctccaggatgaatgcgaaatgtcgccttggttcgcagaccctcaggcattgtgagccacagtagactccagaatgacaagctgctcattatgccgacgggatgggtcgcccatctaggcgcccaagct

SEQ ID NO: 721772 - DNA, 511 bp, Homo sapiens
cgatggcacgcctgccttgacgttcagtgtaaagagcggccagacgctgtgacttggctgtacacatataacaacgctgtccatggcagctcccataagtatcagtgttaatcactctaagttgcgtgcacctagctcaacaatgagccctgggaaatttcgtggaatggattattaaacatgagagtctgttagcacttagaaaagggcacggtgagtcccaggggccagcactgttcgcaatgtacggcattactctttgtaacaggattagtagcctgctgtgcccagggagaacatgcaggacagcgcatctcgagtcagcaggattttgacggcttctgacaaaatcttgtagacacgatggagctaataggggttggaggagagaacatataggaaaaatcagagccaaatgaaccacagacccctaaggccacagttgaacaatggactgattccaggcttgaaccggggggaatctggcagaagtccatcccgttcattcaac

SEQ ID NO: 721773 - DNA, 91 bp, Homo sapiens
  misc_feature (65)..(65): n is a, c, g, or t
cagctcagagacccaaagatctcggcaaagctacccccagcggccagccttagccccccaagacnaggtagcgctccagcttctaccaaag

SEQ ID NO: 721774 - DNA, 310 bp, Homo sapiens
cggacctctccctactgtatctaatgcatacttagtgcactaagtaactgttaagaaaccccacctaggtcctgtttatttcatggtggaaaacaggcttcttcaagtcctgtatacaaagagcttgtatctgaattgcagaaaactgtcaccctaaagcagcaatccccaatctttttggcaccagtgaccagttttgtggaagacaattaaggagcatgcaacctagatccctcgcaggcgcagttcataatagggtttgaactcctatgagaatctaatgctgctgatctaggatacagtagggaga

SEQ ID NO: 721775 - DNA, 423 bp, Homo sapiens
ttcacttgtgcctaagcatcgcttgtgtacacgtactagtacctttcaggaacacgctcatccccctatatgggttctggatcggaatcagatataatcaggtgtatgctggtaggagtgtagtctagaattggtagtcatgaagtctgattgtctggatcggaattgcatcattaatctgatgtaattttaaaatcaagataccctaatagtatgagtgagaattggactaagtatctggtgagagtaggaaagagatgaaatatttcttcttcccctaaaggaatttataacctaactgagcaataaagcttaaacacacaaaatgtttttaaaagtaagaagaaaatacgcattagaaatcatattcctacttcagtagaaagtgaactaaactacatgaattggtctgttagaaactgg

SEQ ID NO: 721776 - DNA, 263 bp, Homo sapiens
cccccccccccttttttgggggccccctggggggggtccccctttttggggaaagttttttttccccccccccccgtggaaaaaactttttttttgtgggccccccttggggggggttttttttttgtccccccccccccccccccccccctttttttccgggggcgttttttggtttttcccctttttttcccccggcggaccccaattcccaattaatatccaaaatttttaattaactttacccttttgttcccctggga

SEQ ID NO: 721777 - DNA, 165 bp, Homo sapiens
gacagcatgagcaacatggtgacaaccccatgtctactagaaatataacaatacagacggatgtggtggcacggtacctgtacatcccagctacttggcaggctgcggcgggaagactcccttgaacccaggcgatggcggttgcagtgatccaagatcacaaca

SEQ ID NO: 721778 - DNA, 941 bp, Homo sapiens
ttgcctacatctgtgtatgaacaactttacggtcaatacgcgccgagagaatgtcatatgcgactgatgaaaatcactgtagaacaataattaacgaatggtgtgaacgcaacttttacatacggtaggcgcctgggaatctctggctcgaatcattcaggaggttgagttcgattagcgtggctgaaggacatctctctctgaagaaggttgtgaaaatgcaatgttagtgggatattatcaatacgactcagcaatcgtaaagagtagcctctcaggaggtgtgcacgcagcaacgatcgttgcttggatgcaggacaggttgaactgaaattggtgagggaactgtacgcagatatgcctggcctatggttcaccaggtataacctgccgcgggaaactactgatatacctgggatatttctgaggctggtgcctgggcctctattgtccgtcgcggttgcactgatcaatctgtcaacttttactgtgactggcccgtgatctgcgttcacgcccgctaacccctttgtcctgtgcacttgagctctactcaggcgaccacttcttccgaaggcgatgacattattgcctccctttgtcatttgttcttctgtcggtcaccaccttgggcctagggtatgcgcagtaacttttgtgtccggaggccttttcgtccacttctgtttcacatatcttgctttcctgtggtggagttcctgttggacccacgcgtgtccatcactgaatttgtccctgaaggctcgctagtggttcaatctacattcgtaactatggtctcgtcggcattaccaataacctccctgggcccgtttctacgaatgcgttgaccccctgcgttctcgcttggcgttgctcgacggggtcttcgaccagcaccttcccttgcgactctgatccgcctggttcccccgccaagt

SEQ ID NO: 721779 - DNA, 1382 bp, Homo sapiens
ggagagaactagtctcgagttttttttttttaatgtttaccctttccttatgaccatgcctgtagtagggttgacaaaagtaaaaggacccccggcaaattcttaccccgccgtgttataccaaaaacattcaccttctagcattcaccagtatataaaggcaccgccttgcccaggtgacacagtgttataacggccgcggaaacccttaaccggtgcaaaggatagctataactccacttgtgttcctttaaatatgagggaaccctgttcagtacaagtggcactcccacgaaggagttatccagccgtgatcctcatataattttatacacccagggaacaattgcaccgtgtccccggtgaaagaagaggcgtgcgccacatacaccccgagccagagaagcgagaagagaacccctatagtggaggcccttaaatcttatactatacagtcgcacaacgagaatcacctgtatacaacaaaaccccgcaagagagaacactataaaactgtcacccaaaccacgtgacatctctcacacatactctcacgcggaatgaggagcggcgacacactctcgcggaggaccagcaaaccgcccagacacctctcgcgaaaggacgagaatacacaagtgccgtcagagacacacgtaatcaccccaagtgtacaagagcagagaacccatcaaactatatcacgtaccaaaagaggggaaacaccaccacaaataacaccatgtagaacaccaccagcgggacacacaacaaggtgtataaaccccccttaggcgagcaaataaaccaacgcgcacacaacacacacccctagatatccatagacgaagatcacccaaagtaatacaacaacaaactaagggggttcatatagcaagacgccacagagaacgagacgcaggagaactaccagggaaccaactccccacggaaaggagagagaacacgcccggccaacacaaaagagcggtcccgaaatcggagcacaaccccgaaataataacaggggcccccaacaaagaaaaacaaacaacaacaagacacacaaacaaaagacaacacaaaaacaggcaaacaaaaacaacaaacacgtacgaaaaaacagatacccccctatcgacgcgtcacacccacacaagcaaagagaataagcacaagaagaaaacaagcagagatgaacaacacgacccaaaaacacctcgcgacgaaaaataagaaaaagaagaaccacacaaaccacacaaagaagcaacacaaaaagacacaaccgcggagaggaggaaaaaagaccatcaaatagggagcaacccacgcaattcgacgaaaaaaaaaaagagcgcggaaaaaacaacagggcacaa

SEQ ID NO: 721780 - DNA, 109 bp, Homo sapiens
gctcgtccaggagggactatttggacgggattttggaagactggcatgttaaagcctagatggtgtttacacaggtgcttgctatataattatattcctttataactag

SEQ ID NO: 721781 - DNA, 897 bp, Homo sapiens
ttgtgaacatagactatgtgtgcgcgcgatgggtgccgtgtgtaactaggcaggccgattaaccttgtccccgacccctttttggcgccgcattttcactattcgccgtccgctcatatcggggtcccttcccgcggggccccatttctctcctccgccccgggttccttgtttctccccttctttttggtgccccttccattagcaggaaaacctttgtgcatagcggggtcccccttttccggctgctaagttgctgcccctagagggcctcgtgtcgttggcgacacccccgggtctctcccctcgtccggggcattccggctactctcatatcctgggcgggttctattgcagcattgccaccccctttatccactgtggcgaggccctcctcccctggaaccatcaggtcttcctcccaaaggccccaatgttcttcccagccccaccgccttgtccccacccacgtacctcctgggcggcaccctgggggaagaagcaaaactcggaagtgccaacagaggacgccacagatgtgtctccggggagccccatctcttcacatagtcataagctcttttcgcgagtgctgtcccccactccccccccccgcgtttgggagcacccgtcgcccccggccacagaggagttaaaatgggcgtggggggacaccaccgacacccagctcaaggagggccccaaaccacgcccaggcagactaaaaatagtggacctcgggaggcttttctacacaatgctttcttgacgcactataatttgttaacagagtcatctgtcccctccccccagtgcgaaggcggcaggaaaattataagaggctcttgttcccccccccaaaaaaaaaaaggaatccttttcaaaaaaaaacataac

SEQ ID NO: 721782 - DNA, 1391 bp, Homo sapiens
tggaaaaagtcatggaggccatggggttggcttaaaaccagctttggggggttcgattccttccttttttggtctaaattttatgttatacgggttcttcgaaatgtgtggtaagggtgggggtgcatccatatagtcactcccaggttatatggagggtttctatctatctattaggatctttatcgcttcgaaagcgaaggtcttctcaaatcatgaaaattctattaaatattacgtgctgcttgaaaaaattgaattgaccctaacagattgaaataggattgtttacagtgtgtggggttagtgcactcgagggatagctccgagtataacgttcggggcattctccggaataggccgagaaaagtgtgttttgtgtgggaaagaaagagttataaatttatcacgcccgaagtgaaatatattgcattaggtgaaaaagtggatttagggggcgataggttatgggctcatagggtgtgttagcccttgaagacaatctagggggaaacattctaagtgagaaatttgacacgcctctggcgtatttgagtggggcaaaattaacaggctctcccataattgagaatgagagcacatatggtgtggcgaaaggtgacgctttacaacacgtataaaatacagattaattaaggagataaataacgagaagtgtatctaagggtgaataaaagtaggagcgaaaataaacaaattggacacaggtacaaggagaccaaccaaacacgggtggaacacaacagaaacagaatagaaatcccataaggggcccaagaggcaacatggaagcagacaatacataacgaaaaaagagagccaccccagtaagaaagtttgttggacaaactacaccaaaaaaaacagaacgaaacaaccagcataagagagcaaaagaggaaaggaataatggggcaaccagagaaggggaccaaaaaggccaccgaggtggtacaccaggctcaaataccaacataggaaaattaaagtgatagttgatacaccagacaacaacaccaaagaccagccgaatggatagataacagacgacacacccaaaacaatagaaacacaaacgaggagataaaaacccacggaagaaacaacgacacaaaaagagagcacaataacagacaaaagaaaaaacaaaaaaataaacaaaagacacagaagaaaagaacggaaaagaaaataagggacaacacccaggagaagacacaatcgaacaaaaaataaaacaacaaatagacgaatcccagaacaaaaagaaaaaataacacaaacagagagaaaagaagaactaataaaaacaaaaaagacaaaaaaaacacaaacccagacataaaaaaaagaaagacacctatataaac

SEQ ID NO: 721783 - DNA, 81 bp, Homo sapiens
ctcgaggacacggctgtatattattgtgcgaggggcagggcgtccagtaacttcggggggtctgactactggggccaagga

SEQ ID NO: 721784 - DNA, 790 bp, Homo sapiens
tctgtagctccttggtactatcttgtctcgcgttttctggtatcccatgaagggttcacgaaagtcccgctcgaactttgagaagttccttctgtgcgtcctagatcgtatacccattcatgcgctggcaccaccggaccaacggtcagcaatcctctagatgatcatcctgtcctacatgaggcggcagtcagccctagggattcaagaggaagtaactgaaggtccgtctcatcccatgtccaccatgtaggaggagggactttgctcacggatagaaatccgtgtctcctacaccacactatctacccatcacagacccctttcctatcactcaaggccccagcctggcacaaatggatgcatacagttctgtgtactcgaccaggcattgtgcggtgtgcggtgcatgtgggtcgtttacacacatgcctacaggtatgcgtgattgtgtgtgtgcgcatgggtgtacagccacgtgtctacctatgtgtctttctgggaactgtgtaccatcatgtgtgcctgcagctgtgtagtgctggacagtgacaaccctttctctccacgttctccactccaaatgataatagttcacatcacacctaaatcccgaaaggaaaaaccaggctctaggctcgcaattgttctgctctaatctgataccatcaaccttggggccagcatctcccactgcctccaaatagttagtaactatgatctgacgtccaccagaagattctgggtctaccacactccccaaccccctgctccttcggaggacgtgcca

SEQ ID NO: 721785 - DNA, 289 bp, Homo sapiens
aaaaaaaaacaaaaacgacaaaaaaaaacaaaacagaaaaaataaactaagggcaaggacagtcccgggcaaaggctggggagggaggcagcacggggtcagggaaggtaaccctgaagcaggactggtaaaggcaaataagatggggaggccaagggggggggatcacgaggtcaggagttcgagaccagccgggccaacatagtgaaaccccgttcttttactaaaaatacaaaaaaattagccaggggtggtggtgggtgcctgtagtcccagctacttaggagac

SEQ ID NO: 721786 - DNA, 355 bp, Homo sapiens
cagctgggactacaggtgtgcaccaacacacccggttaatgtttatatttttagtagagacggggtttcaccatgttggccaagctggtcttgagctcctgacctcaggtgatcacctgccttggcttcccaaagtgcagggattacaggtgtgagccaccatgcccagccaggaatctttttgtttatttgttttttattttttggagacagagtcttgctttgttgcccaggctgcagtgtagtgcacagtcttagcttactgcagccttaaactcccaggactcctcctacctcagcttcctgagtgatcctcctacatcagcctcctgagtagctaggactataggtgtgt

SEQ ID NO: 721787 - DNA, 415 bp, Homo sapiens
  misc_feature (320)..(320): n is a, c, g, or t
  misc_feature (329)..(329): n is a, c, g, or t
  misc_feature (338)..(338): n is a, c, g, or t
  misc_feature (353)..(353): n is a, c, g, or t
  misc_feature (364)..(364): n is a, c, g, or t
  misc_feature (367)..(367): n is a, c, g, or t
tagggccatggttaagagtccaagaatccccctttttaaaattttatagttttaggccccgtagttttaaaactccaatgttttaagtttttaagattttaaagggccccaggtttagactattaggggcaatttcaaggttctaaccctaaactgtagtattttttggggggcccctctcctttttagctatcattgcttcctcctccccaactgtgggggtgtgcccccttcaagcctgtgcaatgcattagggatgcctccttttccccaggggatgggcgatttccccccctttcgggccatgttgcccccgtgancccatcccnccccttttnagtacaaagtgtggnctttggggccnccnaagggggtcaggtcccataaaactttgtttatccccgaaaaaaaaaaa

SEQ ID NO: 721788 - DNA, 286 bp, Homo sapiens
  misc_feature (76)..(76): n is a, c, g, or t
  misc_feature (127)..(127): n is a, c, g, or t
  misc_feature (215)..(215): n is a, c, g, or t
  misc_feature (237)..(237): n is a, c, g, or t
  misc_feature (257)..(257): n is a, c, g, or t
taatccaaaatatgcttatcaacttgagtcttctggatgagaaactaaagtggaaaatgttatcatctcttaaatnataaagtgcagatcttagaattttaaaagacatactaaaaaagaaaaattntttctattggtcttacttttttaatttttatttttggcagaaggtatcctctatcataaaaagaaaccaaatcaggcttaaaaagggngtgaggtattaatgactttatntataaaaatcttggaggttnagcttttaaacttggccgtttcgccattt

SEQ ID NO: 721789 - DNA, 303 bp, Homo sapiens
tggggggccagggccccccaaaatttgggtcacaaaggggggggggggttgggcccccattcccccccccccccctttggggccccccccccccggggttggggggggggggggttttcccccccttttggcccccggggtttagggggggggggccccccccccccgggccccctcccggggtttggggggcccttgggctttccccccaccgggggggggtttttcaaaatttttccggggggggggggccccttttgggttcccccccccccccccccccccgggggggccccgcccgga

SEQ ID NO: 721790 - DNA, 862 bp, Homo sapiens
  misc_feature (27)..(27): n is a, c, g, or t
  misc_feature (64)..(64): n is a, c, g, or t
  misc_feature (72)..(72): n is a, c, g, or t
  misc_feature (78)..(78): n is a, c, g, or t
  misc_feature (94)..(94): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (108)..(108): n is a, c, g, or t
  misc_feature (116)..(116): n is a, c, g, or t
  misc_feature (118)..(118): n is a, c, g, or t
  misc_feature (126)..(126): n is a, c, g, or t
  misc_feature (158)..(158): n is a, c, g, or t
  misc_feature (162)..(162): n is a, c, g, or t
  misc_feature (165)..(165): n is a, c, g, or t
  misc_feature (175)..(175): n is a, c, g, or t
  misc_feature (182)..(182): n is a, c, g, or t
  misc_feature (187)..(187): n is a, c, g, or t
  misc_feature (194)..(194): n is a, c, g, or t
  misc_feature (196)..(196): n is a, c, g, or t
  misc_feature (206)..(206): n is a, c, g, or t
  misc_feature (212)..(213): n is a, c, g, or t
  misc_feature (217)..(217): n is a, c, g, or t
  misc_feature (219)..(219): n is a, c, g, or t
  misc_feature (223)..(223): n is a, c, g, or t
  misc_feature (233)..(233): n is a, c, g, or t
  misc_feature (240)..(240): n is a, c, g, or t
  misc_feature (248)..(248): n is a, c, g, or t
  misc_feature (256)..(256): n is a, c, g, or t
  misc_feature (265)..(265): n is a, c, g, or t
  misc_feature (267)..(267): n is a, c, g, or t
  misc_feature (281)..(281): n is a, c, g, or t
  misc_feature (285)..(285): n is a, c, g, or t
  misc_feature (293)..(296): n is a, c, g, or t
  misc_feature (300)..(300): n is a, c, g, or t
  misc_feature (307)..(307): n is a, c, g, or t
  misc_feature (328)..(328): n is a, c, g, or t
  misc_feature (331)..(331): n is a, c, g, or t
  misc_feature (340)..(340): n is a, c, g, or t
  misc_feature (344)..(344): n is a, c, g, or t
  misc_feature (348)..(348): n is a, c, g, or t
  misc_feature (353)..(353): n is a, c, g, or t
  misc_feature (357)..(359): n is a, c, g, or t
  misc_feature (361)..(361): n is a, c, g, or t
  misc_feature (387)..(388): n is a, c, g, or t
  misc_feature (390)..(390): n is a, c, g, or t
  misc_feature (404)..(404): n is a, c, g, or t
  misc_feature (439)..(439): n is a, c, g, or t
  misc_feature (445)..(445): n is a, c, g, or t
  misc_feature (459)..(460): n is a, c, g, or t
  misc_feature (463)..(463): n is a, c, g, or t
  misc_feature (503)..(503): n is a, c, g, or t
  misc_feature (512)..(512): n is a, c, g, or t
  misc_feature (521)..(521): n is a, c, g, or t
  misc_feature (616)..(616): n is a, c, g, or t
  misc_feature (690)..(690): n is a, c, g, or t
  misc_feature (717)..(717): n is a, c, g, or t
  misc_feature (719)..(719): n is a, c, g, or t
  misc_feature (828)..(828): n is a, c, g, or t
attggtttgtttgttgctgttggctcngtgtctccctcggggcaggcggctctggggtttcctnctcccccntcttcncctcttgctgaggtcnccncctttncntcntatcttgntnagttgtcnacttctctggattgggagcctttgggggattngggntcntgctgtctcngtgtgcnccggntttgacncngatgcttgcnctgtcnnggcncngccnattgtctccnttgctcngtgtgacntccttcanacgcttctncngaggtgacagcccnacanattccccnnnngccntgattgncatccctttgcctccctggcnggngaaaactgntgantccntaganaccnnnanagcccgcctgctctatgagagccganngnggggaatgttgganaactgccttcttcttagtctttttgctaaacaacntctgcngcacatgacagacnngcngctgaacctctatgaccgcctgattaacgagcctagtaangactggganatttactantgggccacagaagctaaaccagccccagaaatatttgaaaatgaagtcatggccctgctgagagactttgctaaaaacaaaaacaaagagcaganactgcgtgccccagatcttgagtacctctttgaaaagccacgttgagctgtgctccacggcctggcatgggggntcagtctgtggatggtaactacttatnanggacgttagccttgcttccggcttcttagatgcccagctgccctaccccagaccactggtcctgcctcaagtgatggacataaccctctcctaggacatacatgtaaangcacaatgtgactcattctcatactttttgttca

SEQ ID NO: 721791 - DNA, 222 bp, Homo sapiens
ggaaactctgttatatgatgataccgtgagcactctctttaatcaaggacattccttttcagcgaaagcagcgctctgatttaccaagtctgtgcggaccgcgcgcgctttaaaggaatgaggttccagcggtcgcgccaagcagcgtacgcagcctattttaagttatgctaccttcgccacagaaacccagaacgtttgtaatggtcctgaggcggaacg

SEQ ID NO: 721792 - DNA, 395 bp, Homo sapiens
tgttgtgagtcagaaccattccgcagggctccactcctctgactgtccatctactagagaccatgcggctgaaagtgcactttcagtgtagtgcagttgaggctaatatacaaacaaaaacagcataaaccagcactagaccaaggtgcagaagcaaatcattacaccctcgttggcaatgaaaacatccacggcacggactagttagatatatttgggtgccaagttctctctcccgcactccatcacttgttggactgagcaagaactaatctgtcttcccaaagtcgatctcacccctgaaatgagggaggggaacaaaaatcacagtttaagcgcacaacaaggacgaaaggtcccccagtacaatacaaactacatttaaagtggtcaca

SEQ ID NO: 721793 - DNA, 627 bp, Homo sapiens
gggctggggaggaagacgaccagaaaatccacattgtatagctcttcaacgttgggcatttgataggcattcaggttttctccatgaaaagagggacagtcacccaactattaatatggtgtcatctgtagttggaacatcaaattgaagcatattgcgttgagtatttgtctctaatctaacaaatgactgtgggacacggggacacgagaacaaaatgacttggttcatcttttacatacagtgcatcttaagaaaagtcaaatcattcccactattacccaggctgtgacaacacaaatagcacaaatggccgaaagccataatgctgcggggcgcgtgccctgcccggccaacgaactcttgcacctaattggtgggcgccgcccgtaccaagtattggaaacataaacctgtgcccatcctacggttcactcagtacaacacaggtggctaagtgcctacgtggcttggtctaccacaactcgatggaagaccgtgcgcgcggggcctacggtggttcttcggcataacaagtcaagaaggctaactggacgacaacacgggattctaacacaagggggttcccaagagaaagccaaatttaaaaatagccccccccggggg

SEQ ID NO: 721794 - DNA, 1039 bp, Homo sapiens
ggacgcgcctgaggaggaggaggaggcgggggcggcatggtgctgtggtggtggggactgcggttggcgcgggaccggcggtctgcaggtggccgtctctaccgggcctgtcgcgttgtgcacccgcgcccgtgggacttgggctcggtgtcacccagagcaagttgcgtgttcatccccaaggttggccccgggattggggcacgacagagtagagtagccccagatgaaggagagggcacaggtcgaccaaatggcagatctatcaacgagccaaaccttttaataggaagggcttacacgcgcagacaaacgatccccaagggtgtattagacgaatgtatcaagcccccaggttgaattgagcaacatcccgacattgaaagaaaacgtgcgagagtgtgaatattatgaggaaagcaaaagaccaagttgggtgatcactccagaggagcaaggggtgtaataaacgaccaggtgtttgtggaaacagaacaaacatgaataggcagttggggaacaaacgagttgttctgtaaaacacgagagaggatctacgaataagggccgaccggaccttccgagttcacaattctttaagaattggcgcattggcataagaaggaacatgttgaggaaacaagtataagacagatgggggaagccattttgagtgcagcaaacaggaaagagcatcacacgcagattatcttcgctgagaaacacacaattatgattcgatctctgtgcaacgcggcactcagtcactggaacaacaacatcatatgttgccccgcccaaagaagcgacagtgtacaagattgtagagacacacgaggcaacgtactgacacccattcagtggcattaatacaatatcgaaccctgtgggaacagtaacgaagcaacagtattataatcaacacgtgcacatagcgaaaaggaatgggtaacgtagcaaaacgtcccgatttatctattttgtaggcctggcacgacacagtccttatacatgcggagcaaagagagtggcaaagcta

SEQ ID NO: 721795 - DNA, 480 bp, Homo sapiens
gtagacttcatacaatagagcttatacgctaatgagacgacaggaagaaacagcaggaacacatatagctgaaatgcatacgggatctgagctacttacgctagccatgggatgataagaacaagataagagacatgaggaagactacttcaaggaagtgcttaaggcatgttttggaaaagagaactcaaggtctggcatggagaaaggagcaagggcaagtgatagctgcagctgtctggcgtcactgtaacgctgactactactctgagtgagttcaacctgcatcttctccaatgtgacatgcacaggtattacgtatacatgtttcactgatagaaatttgagtccaatgctgggatgacaaggaagacatgggatacctaatcctaggtgctgccactgggacaaacaagaagcaccagacacagtgctgcattagtgcggtgcagctatgctgagggctatttctacccgtgc

SEQ ID NO: 721796 - DNA, 215 bp, Homo sapiens
tgtgtgcagtactctagtagagtcagaatcaggcctagatcagtggtcgctggcagatctggcgctagtcccagtgctggatatctgtcactgctttgaaacaggacctcacggacaggagcatgaaggatccacaggaaggctggaccagatgtacaatttcaacgctgggcaggctaaggtgggccacattatggcggggtacgagctcgaat

SEQ ID NO: 721797 - DNA, 168 bp, Homo sapiens
tgtcatcaggtggctccaggccagactctgtgctgagtgctgaggctgagggaccctggtgcaccccaaatggggagacaacgggtgagcgagcagtctgaggagacagagagggtgataagctgggggacatggccgctgtagacagggagccttcatggctgatgg

SEQ ID NO: 721798 - DNA, 464 bp, Homo sapiens
aggcccacccgttttcatggccacatctgtccctgtggccacatctgtcttggtggccacacatggctgcaggctgtgcagcacctgttccagccggaccggcagcctcagcgctttcggtggcgccttggaacagacgttccctccctgtgcacttcccctcacatcagggcccggatctcatgtctggcaaggccaatggctcagagtgggcccgcatcaacatgccaaagtcatcgtattacaagctcaggggccttctaccatgggctgggtcggtcctcccgtaaggcacggtaggcggacaagccaggtggaagatcaggagtaaagaacaatgagcaatggaaaccttctctccgttcgtaagagtgaaagagcctctgccgctcatggtcggacggcttcgggccctgcccaggcgggccaagataggccagtagacagcgtaagaacaggcctat

SEQ ID NO: 721799 - DNA, 1752 bp, Homo sapiens
  misc_feature (1752)..(1752): n is a, c, g, or t
ggaatgccggtgaacgagagcgggctcggggtcgccctgttgacgctgggatggaggcagccgacggtggagactatccgcagtacaggtgatcaggacaaggagagacaatccggggagcccgggagttcggccgtgacgagagagcggtcgccggcgggccgtcgggcagcgtgatgtcgtcgtcagagtcacaggctcgtacagaataagcgcagtggaatggacgtgtgaagcgaagataggagagcgtcctagagtctgaggtgaacagtgaagagaactcagaaatcccgtgaggagcgtggtactctcatcatacatgtcctccctgcacttcatcaccgagaactccgagaagagtcgagtagtccttgtactctcctggaggtgcgcgtgctcctgagatgaatgaagggcttttcggtacatcattaatggcccatgatgtccaggaagtcatgaacctggttgctccggagcccatgaagacaaagcgagggatatacacacgagccagattggataagccataatccgagaggggagctatggaatgtgaggcgcagcgctgcgctgtgccaggagggtgtatggagaaattgccatcacgacatgcaaggggtggagacccaattcgagccaattccacgctatgtgtggtcccagtccacatactcggtgggcctcgaaaaggcgtgcatcttcgaaatcgaattcgcgctcggataggctgccgggcatggacttatcgatggggaggcgaccccccagaagaaatctagggcataaagagggacaaaaatctttgttttcccattttacttctggggtgtagcccgggggcaaggtttggcaaggatcctggctcgactagaggtgacaggcgctcaagtcgcgcttggcaaccgcaaggctggggcaagcattggggacacttcacgactggtccacaggggatgcctgtggggggcgcctttaaccgaaaaggctgtggcgagtccaatggaaactcagggaggggagcccttccggaaatgaaacttgtgtgtgacacatccctttaaagagacccggggggagttttgaacctggtgggcgaacccctctttgaggggaaaatactcccggaccatcaggggcccacgggttggagtgggccagctctccctaacgaaaacactttaacaggattaccttgtggaacccccccaggacttctgtgcgaacagggaacctgggtggtttccccaaagcgtcccggcatctcacagggagtacagcttagcacgcactcttgtgtgagacacaccagccagcaaagttctccgccaccagaggagaccaagggcctcagagggtggagcaccccaggcgcgttattttacccagaaacagaccacaagcacactccatcactcacaaagggagacagaagaaagacccccactggatattattctctcggagggacaaaataaagaactagtaattcggatggacacctacaaaaagaggaggcgccgacaatctcgtacgacactgatgcatgcaacaatactactagctagtgcgtcccatgatatcgtgggactgaataaatcagtcaaatctacttacagccgtcacacaactcaacgtgcagaagagacagcagaaaatagacactacagacagatagaagcagcggacacaagacgagccgagcgaccacgtcgagtcacacacaggaatcccacgcacagagtgagn

SEQ ID NO: 721800 - DNA, 267 bp, Homo sapiens
acagacataagtaaatggccacatactatttattatgaataggaagactcataaaaatatctgtttcttcaaactctacaaattccgtgtacgtccaatgaaaatactcacaggctttttcctggaacctgatggttgaatcacacaatttatatcggaagagtaccggaccaagaaaagttaaagtgatttctgatagataagaggagcaggacgcattgacatacaaatggtgcaggcttataaaaaacatcagtgacacgaggc

SEQ ID NO: 721801 - DNA, 618 bp, Homo sapiens
gaacattaaagactggccggaattgggtgcgctgaccttgaatatcgtcctgaaagtgtgctcgaagatcctcgacgaagtgaccaccaccgacgaactgattccttccggtgaaacctcttcttatcgttcaaatccgattggtctggcggagtttaccctgtctcgccgcgatcccggttatgttagcagaagtaaagcgactgctgagctggaaaatcagcgtctggcggggaatgtcagcgagctgacagaggtgtttgcgcgcattaagcagattgctggtcaggagcatattgatccgctgcaaactgaaattggcagcatggtctatgcggtgaaaccaggcgatggttctgcgcgtgaacaggcggcgagctgccagcgtgtgattggcggtctggcgaatattgccgaggagtacgcgactaaacgctatcgttctaacgtcatcaactgggggatgttaccgctgcaaatggcggaagtaccaacctttgaagtgggggattacatttacatccctggcattaaagcggcgctggataatccgggtacgacgtttaaaggttatgtgatccatgaagatgcgccggtaacagaaattacgctctatat

SEQ ID NO: 721802 - DNA, 183 bp, Homo sapiens
cagcaggggccatgctgggggatttctgaaggctgattccaagcagaatatagaactgcggcacgggagaccaggggctgtggatggtgctctcctgggaaccaaagaatgtggttctgcaattggcttggtctagactattctccagaaaaggataaaacatgtttttgagcaactgcctag

SEQ ID NO: 721803 - DNA, 164 bp, Homo sapiens
aataagcggcatggtggtaacattgcatcaggagatagtctagaggtctctaattctgcaggactataccgacgtatcaggattcagtgacctcattcacgatgtctgcattgtttacgacctatgtccgctctagggtatgtagcctccactagcgtctgtta

SEQ ID NO: 721804 - DNA, 153 bp, Homo sapiens
tcccttcacaaaactttagctgagaaccaagtggcatcagttttcatctaatcagctagaagttaaatagcccctgattaagtttcatgggcttaaaataatttgtaagaattagcagaatgttccccctttttttttgagttttaatatgta

SEQ ID NO: 721805 - DNA, 752 bp, Homo sapiens
agtggtcatgcgacgcacagggttggccccgtcaccttcaaaaccgacaagaccttcaccactgtcgcccgaagaaaggttcatggtgacatgctcaccagaggtcatcgagcgcgcggtttcattgatgaccttagccggcaccaaagcagtagcctcagcgtcggtggcgctgggattccaggtgatttccttgagagccatccggtaacggtctgtagccagcagcgagagggtctctccgttgatttcgacgcgcacacccgtaaagaccggcaatagctcatcacgaccagcagccacgacgacctgagcaacagccctggagaaaacactagcgtcaacagtgcccgttgctgcaggcatgtgcggcagatcaggatactcatcaacaggtagggcctgaagggtaaagcgagcagacccgcacaccagatccatcttggcggggtccgtcgtgatctgaaccggcttgttaggcaagctacgagcaatatcagcaagcagcttgccagagacaagagattctcccggctcgtcaacttgagcggaaagggtaattcgtgcgctggtctcattgtcggaggccgacatcaccaccgagtcgccctcagctcgcacgagcagtccagctaaaatcggcactgtcggccggttcggcagactgcgagcatgccaggcaacagcttcggccatgacatcgcgttccagacggattccactgcgtccccttgatttggcgtctcgcactc

SEQ ID NO: 721806 - DNA, 331 bp, Homo sapiens
ccccagtatagcccaggtacacagcgagactctgttcaaaaaaaaaaagaaaatttaaaaaagcagaatcacgcagggcctgtgtaaagccatatacctattccatattggcctttaaagaaaatttgaattgatttatttaaatttaatttcacttaaattgagttattaaaacagtttcaacacagggtgaaccaaaaatctcaaaaaacaaaggcacaaattagatgtggcatttaacaaccagaaaaaaaaccttcactcttcagaatttgtgaattaacatttttacctttaatctctttcaagccttataaggtttcaaggtctc

SEQ ID NO: 721807 - DNA, 535 bp, Homo sapiens
  misc_feature (352)..(352): n is a, c, g, or t
  misc_feature (362)..(362): n is a, c, g, or t
gttaaactctagattaaattcctcccgcggttagcctgacccatgcccgggactcagtggggacagccacacaagttagactctagattaaattcctcccgcggttagcctgacccatgcccgggactcagtggagtcagccacacaagttaaactctagattaaattcctcccgcggttagcctgacccgtgcccgggactcagtggggacagccacgcaagttaaactctagattaaattcctcccgcggttagccttgacccgtgcccgggactcagtggagtcagccacgcaagttagactctagattaaattcctcccgcggttagcctgacccgtgcccggaagtnagtggagtcngccacgcaagttagactctagattaaattcctcccgcggttagcctgacccatgcccgggactcggtggaatcagccaccccagacctctctcactgttatcatttttgcacaggtggtttcagcagcttgatgccaaaaaaaataaaaaaggaaaagtattctgaaaagcca

SEQ ID NO: 721808 - DNA, 525 bp, Homo sapiens
tctgcaccacagcagtatcatcacacacagacgtatcatcaccacagccgtcatacatcacacacagcactcatttggcacgggagttaagtgtgattatcggaacaggaggacacgtctgacagaccacgcggaaagaagaggccgtcacagaggccacgtgttttgattccgcttttatgaaatacccagacgaggcagatccacagacacagacagcagggaccggggacggtggggtgtctgctaaaaagacggtttttctttctgggggatgaaaatgcaccaactttagatcatggtgttggctgcgcaattctgtgaacatgctaaagaccaatgaatgacacattttaaagggtgatttgagggtatatgaatcacatctcagagaaagctgttatgaaacacctatcgggcggggtcctaaagtggagtcacagatcatccctcagagggcactggcccagaaaccaatggagggagacgaatctcccccaaaccctgtacttttccagggacagg

SEQ ID NO: 721809 - DNA, 137 bp, Homo sapiens
cctagaacccctgccagggctgggggtgagaaggggagtcattactcaccattatcataggccccccccaaaagagtccaaggaaataaatgagttatttcggtgcaaaaaaataaacaaaaaacgctctgcggccg

SEQ ID NO: 721810 - DNA, 670 bp, Homo sapiens
ccagaccatggatttctcagtaacttagaattgctggtaagcttcacatggcctataaggtataggtcgctcagtttagctccctcattggcaatgtcttgcatactgtctcagcgatatcatggatatgcatcgtgtctttgcaaggttcgtgtcgctgagctgctagctaggctacattctcgccagtgctaactatctcatgattatctgggtcatatatttcctgcagatatcatatacttgagtcatgtgtcattctcgatgcttcatacttcatcatctcttataccattctcctggccgtctaagtagcagcgtctttcatatttggtcatgatcattcatctggattataagtgagttggagtactcctatctgctgtttgtcttctgatgcattgttttcaccatgatgtaagatgtctctcacagcctgtagatcctagtatcctttggtctgatcagtagtcagtgctattcgcattagtcatggtagttgctctaaaactcctgagtctattcatcttacattcagcagttgtcgctggtcgctatataagctacacatgttctagagagttatagtagagcatagaagtagagtctttcatagagagggtgcatgatcccgcgcatcatgtaggagtgcctgcagcttcaaccctag

SEQ ID NO: 721811 - DNA, 334 bp, Homo sapiens
gctatgttgcccaggctagagtgcagtggtgcaatctcacctcactgcaacctctgcttccgacgttcgggcgattctcctgcctcggcctcccaagtggctgggatttacaggcgcctgccaccacatcctggctaattttttgtgttttgggtggagatggggttttgccatgttggccaggctggtctcaaggcaagtgatccacctgccctggcctcccaaagtgctgggattgcagatatcagccaccgcgcctggaccagaaatgtttatttatttgggttcacaaaaacaatgaggttcaggaaagcaatgagaattactctgagtc

SEQ ID NO: 721812 - DNA, 539 bp, Homo sapiens
ggctgtatactatcaggatcacttagcagagtctacagcatcagatacagaggaagcttcaattcaactttcagaaaagattccagctcgcatgatctcatcaacccagaaaattgtggggggcaccagtgcaggaatgaagaagctgtttctttacacaatcgttatccccataatgcctggttcttgtgctaccacgggctcaactaaaaggcaacaaagtaaattcagtcaataagaaccaacaatattgtgtgtggctaagcttatcaccgatgactcatttcctccagtataaactatgggaatacaaagcttctctgatagcccaattttctactctaaaccatgacccctatccacaatatttgcaggagtgtctgacttcaacttagaagacctgaacgccctctctccttctggatacctttctgtttacccatactaaagtacagcactgcaactctaatctggctacaatggactgctcatttccctcattccagacatcttttttattacatcataatgatttctgg

SEQ ID NO: 721813 - DNA, 418 bp, Homo sapiens
  misc_feature (347)..(347): n is a, c, g, or t
gtttatcggaggcacagtacagttcctttgtcccgggacgggatgtggcaccttcaattcctctcagatcgattaaatcaaggtttgactttggtgttccattttgttttcaacatttccatgaattaccaagacacagctttctacagagaagcacctttctccagatcttcatggccatttgggacacacagctccaaacccaaaaggtgtccacgggatcaacccacaaggcaaacaacggctttctaaggaaaagccgagtttctaggaggcagcccacttcggacgtgtccttcagttaacaggctgcagtggacagcgtgtggtgggtggaggaagacggnagatgagaaattcaaggagattcaccacagagcagctttctggctcagctgttctagggtggcatcgataa

SEQ ID NO: 721814 - DNA, 85 bp, Homo sapiens
ccctcccccgcgcgggccgaggccccccccccttcccccatttttggaaaacccaaaaaaacccctgggggcaaaccaaaaaaaa

SEQ ID NO: 721815 - DNA, 592 bp, Homo sapiens
tacgcgcactttatgtggatataacaggatttccacatataggtaggagtatccctaaaccaaaaatcgtgaaattgaaatcctgggccaggcaaagtggctcacgcctgtagtcccagtactggggaggctgaggtaggaggatggcttgagtctgggacgtcagagctgcagtgagctgtgatggtgccactacattccagcctgggcaacagagtaagacctgcctccaaacagaaagcagccttctccgtgtcagcaataaagctgctttgctttattattatttatgtcttcactggagtagcagttttaatttccctcaagaacctttctttggcattcacaacttggcaaactggtgcaggagggctagcttttggcctgtcggcttttgacatgccttcttcactaagcttaagcatttctagcttttgatcgaaatgagagacaggtgactcttcctttcctacaggattaaattgacctaacgttattacgttattactgttgtgtctcagggagtagggagccctgaggagagggggagagactcagggaaatggccggacagacaggtgcagcgtagaat

SEQ ID NO: 721816 - DNA, 103 bp, Homo sapiens
tatacctctagttagaagttcaatagcacattgctgctggggtcagagggaggcggctgcttcctgccccaccctttccccgggctgctgtgctgcttttgtg

SEQ ID NO: 721817 - DNA, 631 bp, Homo sapiens
gagctgggggcatgtccgcggggggcgccgtctagaggaaggccaagcagccgcaccacgctgtcggtcgcggagagacgcaagtcgagccaggccgaggcccgtggcggtgaattgctgcgtaacggggttgcccgtcagcggggccaacctttccggatgcccgatgagctttgcggaggtaacggagcggcggtgaccatcgaaggtggtggaaggtgcgctgtttccggccggcgatcgggctcgtgcggcgcgggtgccggggcggtcagggggcggcggtcccatgcgtcttccaccggaggtgggcacgcgacaaagctcttggagcgtgtggcctcttcgggggacagactcgttgaggggctgccggtgaacgacggggacaccgttgtcggtattgagggggttgaagcccgaaggcagaaaaagacatgttgcgacacactttctcgcttgacccacgcagtaattcactcggcctacagtcgtgtctgcccagtgggggaccaacactcggggaagtgacttggatccataagcccaagaacgtacgtggcggccccttggtggattggttggcatacattttttgtgggacactcacgatttgggggacagttgccat

SEQ ID NO: 721818 - DNA, 383 bp, Homo sapiens
cagccaaaaggggtgctggcctaatcccaggcagtattctgactcccaacccaaacctattgttggtccactagagactttggatagaaaccagaggagaattggaagggccaggaaaaactcaggcatgtaaaacaaggaaccaattttaagggtggaaagctaaggtggagatacatagcatgtataaatacaactaaagagccacggcgatttggcacattttagaggacagttaagactcttactatcctccagttagcagtagatttcctcctattcgcacacctgccattgccattttccctttctgttccaaacgacttcagaatggcttacaattacacccagctaacatctgtatcaggtttatattcagtgtc
